United States Patent 11,931,406 (FLAVIVIRUS VACCINE) - sequence listing, part 23

SEQ ID NO: 10108 - RNA, 9873 nt, Artificial Sequence
  derived and/or modified CDS sequence (opt1) from DENV-3__KJ189297__SS-prME
accagccucugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgacccugcccgaguacggcacccuggggcucgagugcuccccgcgcacgggccuggacuucaacgagaugauccugcucaccaugaagaacaaggccuggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgcgccgugcaagauccccuucagcacggaggacgggcacggcaaggcccacaacggccgccugaucaccgccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacacggcgugggacuucggguccgugggcggggugcucaacagccugggcaagaugguccaccagaucuucggguccgccuacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggcggacauggggugcgucaucaacuggaagggcaaggagcugaagugcggcagcgggaucuucgugaccaacgaggugcacaccuggaccgagcaguacaaguuccaggccgacucccccaagcgccucgccacggccaucgccggcgcgugggagaacggggucugcggcauccgcagcaccacccggauggagaaccugcuguggaagcagaucgccaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgcgucccgggccuggaacgucugggagguggaggacuacggguucggcguguucaccaccaacaucuggcuccgccugcgggaggucuacacccagcugugcgaccaccgccucaugagcgccgccgugaaggacgagcgggccgugcacgcggacaugggcuacuggaucgagagccagaagaacggguccuggaagcuggagaaggccagccugaucgaggucaagacgugcaccuggccgaagucccacacccucuggagcaacggcgugcuggaguccgacaugaucauccccaagagccuggccgggcccaucucccagcacaaccaccgcccgggcuaccacacccagacggccgggcccuggcaccucggcaagcuggagcuggacuucaacuacugcgagggcaccaccguggucaucaccgagaacugcgggacgcggggccccagccuccgcaccaccaccguguccgggaagcugauccacgaguggugcugccggagcugcacgcugcccccgcuccgcuacaugggcgaggacgggugcugguacggcauggagauccggcccaucuccgagaaggaggagaacauggucaagagccuggucuccgccggcagcgggaagguggacaacuucaccaugggcgugcugugccucgcgauccuguucgaggaggucaugcgcgggaaguucggcaagaagcacaugaucgccgggguguucuucaccuucgugcugcuccuguccggccagaucaccuggcgggacauggcccacacgcugaucaugaucggcagcaacgccuccgaccgcauggggaugggcgucaccuaccucgcccugaucgcgaccuucaagauccagcccuuccuggcccucggguucuuccugcggaagcugaccagccgcgagaaccuccugcugggcgugggccucgccauggccacgacccugcagcugcccgaggacaucgagcagauggcgaacgggaucgcccucggccugauggcccugaagcucaucacccaguucgagaccuaccagcuguggacggcccugaucagccugaccugcuccaacaccaucuucacccugacgguggccuggcggaccgcgacccugauccucgccggggucagccugcugccggugugccaguccagcuccaugcgcaagaccgacuggcuccccauggccgucgccgccaugggcgugccgccccucccgcuguucaucuucagccucaaggacacgcugaagcgccgguccuggccccugaacgagggggugauggcggucggccucgugagcauccuggccuccagccugcuccgcaacgacgugcccauggccggcccccuggucgccgggggccugcucaucgccugcuacgugaucaccgggaccuccgcggaccugaccguggagaaggccgccgacaucacgugggaggaggaggccgagcagaccggcgucagccacaaccugaugaucaccguggacgacgacgggaccaugcggaucaaggacgacgagaccgagaacauccucacggugcugcugaagaccgcccuccugaucgucuccggcaucuucccguacagcauccccgcgacccugcucguguggcacaccuggcagaagcagacgcagcgcuccggcgugcugugggacguccccagcccgcccgagacccagaaggccgagcuggaggaggggguguaccggaucaagcagcagggcaucuucgggaagacccaggugggcgucggggugcagaaggagggcguguuccacaccauguggcacgucacgcgcggcgccgugcucaccuacaacgggaagcggcuggagcccaacugggccuccgugaagaaggaccugaucagcuacggcgggggcuggcgccucuccacccaguggcagaagggggaggagguccaggugaucgcgguggagcccggcaagaaccccaagaacuuccagaccaugcccggcacguuccagaccaccaccggggagaucggcgccaucgcccuggacuucaagcccgggacgagcggcagccccaucaucaaccgggagggcaaggucguggggcuguacggcaacgggguggucaccaagaacggcggguacguguccggcaucgcccagaccaacgccgagccggacggccccacccccgagcuggaggaggagauguucaagaagcgcaaccucacgaucauggaccugcaccccgggagcggcaagacccggaaguaccugccggcgaucgugcgcgaggccaucaagcggcgccuccggacccugauccuggcccccacccgcgucguggccgccgagauggaggaggcgcucaaggggcugcccauccgguaccagacgaccgccaccaaguccgagcacaccggccgcgagaucguggaccugaugugccacgccacguucaccaugcggcuccugagccccguccgcgugccgaacuacaaccugaucaucauggacgaggcccacuucaccgaccccgccuccaucgcggcccggggguacaucagcacccgcgugggcaugggcgaggccgccgcgaucuucaugacggccacgccgcccgggaccgccgacgccuucccgcaguccaacgcccccauccaggacgaggagcgcgacauccccgagcggagcuggaacuccggcaacgaguggaucaccgacuucgcggggaagacggucugguucgugcccagcaucaaggccggcaacgacaucgccaacugccuccgcaagaacgggaagaaggugauccagcugucccggaagaccuucgacaccgaguaccagaagaccaagcugaacgacugggacuucgucgugacgaccgacaucagcgagaugggcgccaacuucaaggccgaccgcgugaucgacccgcggcgcugccucaagcccgucauccugaccgacggccccgagcgggugauccuggcggggcccaugccggugaccgccgccuccgccgcccagcgccggggccgcgucgggcggaacccccagaaggagaacgaccaguacaucuucaccggccagccccucaacaacgacgaggaccacgcgcacuggacggaggccaagaugcugcuggacaacaucaacacccccgaggggaucaucccggcccucuucgagcccgagcgcgagaaguccgccgcgaucgacggcgaguaccggcugaagggcgagucccgcaagaccuucguggagcugaugcggcgcggggaccuccccguguggcuggcccacaaggucgccagcgagggcaucaaguacaccgaccggaaguggugcuucgacgggcagcgcaacaaccagauccuggaggagaacauggacguggagaucuggacgaaggagggcgagaagaagaagcuccggccccgcuggcuggacgcccgcaccuacuccgacccgcuggcccucaaggaguucaaggacuucgcggccggccgcaagagcaucgcccuggaccuggucaccgagaucgggcgcgugcccucccaccucgcccaccggacccgcaacgcccuggacaaccuggugaugcuccacacgagcgagcacggcgggcgggcguaccgccacgccgucgaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggccgagaucccgcugcaguggaucgcgagcgccaucgugcuggaguucuucaugaugguccuccugauccccgagcccgagaagcagcggacgccccaggacaaccagcuggccuacguggugaucgggauccucacccuggccgccaucaucgcggccaacgagaugggccugcucgagaccacgaagcgcgaccugggcauguccaaggagccgggggucgugagccccaccuccuaccuggacguggaccuccaccccgccagcgccuggacccuguacgcggucgccaccacggugaucacccccaugcugcggcacaccaucgagaacuccaccgccaacgugagccucgccgccaucgcgaaccaggccgucgugcugaugggccuggacaagggguggccgaucuccaagauggaccucggcgugccccugcuggcccucgggugcuacagccaggucaacccccugacgcugaccgccgccgugcuccugcugaucacccacuacgcgaucaucggccccggccuccaggccaaggccacccgcgaggcccagaagcggacggccgcggggaucaugaagaacccgaccguggacggcaucaugaccaucgaccuggaccccgucaucuacgacuccaaguucgagaagcagcugggccaggugaugcuccuggugcugugcgccguccagcuccugcugaugcgcaccagcugggcccucugcgaggcccugacgcuggcgaccggccccaucaccacccucugggagggcucccccgggaaguucuggaacacgaccaucgccgugagcauggccaacaucuuccggggcuccuaccuggccggggccggccuggcguucagcaucaugaaguccguggggaccggcaagcgcggcaccgggagccagggcgagacccucggggagaaguggaagaagaagcugaaccagcugagccggaaggaguucgaccucuacaagaaguccggcaucacggaggucgaccgcaccgaggccaaggaggggcugaagcggggcgagaucacccaccacgccgugagccgcggcuccgccaagcugcagugguucguggagcggaacauggucaucccggaggggcgcgugaucgaccucggcugcgggcggggcggguggagcuacuacugcgccggccugaagaaggugaccgagguccgcggcuacacgaagggcgggcccgggcacgaggagcccgugcccauguccaccuacggcuggaacaucgugaagcugaugagcgggaaggacgucuucuaccucccgcccgagaagugcgacacccugcugugcgacaucggcgaguccagccccucccccaccguggaggagagccgcacgauccgggugcugaagauggucgagccguggcucaagaacaaccaguucugcaucaaggugcugaaccccuacaugcccaccgugaucgagcaccuggagcgccuccagcggaagcacggcgggaugcugguccgcaacccccugucccggaacagcacccacgagauguacuggaucuccaacggcaccgggaacaucguggcgagcgugaacauggucucccgccuccugcugaaccgguucacgaugacccaccgccggccgaccaucgagaaggacguggaccucggcgccggcacccgccacgugaacgccgagcccgagacgcccaacauggacgucaucggggagcggaucaagcgcaucaaggaggagcacaacagcaccuggcacuacgacgacgagaacccguacaagaccugggccuaccacggcuccuacgaggugaaggccaccgggagcgcguccagcaugaucaacggcguggucaagcugcugacgaagcccugggacgugguccccauggugacccagauggccaugaccgacaccacgcccuucgggcagcagcggguguucaaggagaaggucgacacccgcaccccgcggagcaugcccggcacccgccgggugaugggcaucacggccgaguggcucuggcgcacccuggggcggaacaagaagccccgccugugcacccgcgaggaguucaccaagaaggugcggacgaacgccgcgaugggcgccgucuucaccgaggagaaccagugggacuccgccaaggccgccguggaggacgaggacuucuggaagcucguggaccgcgagcgggagcugcacaagcuggggaagugcggcagcugcgucuacaacaugauggggaagcgcgagaagaagcucggcgaguucggcaaggcgaaggggucccgggccaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucucccagauccccgggggcgccauguacgcggacgacaccgccgggugggacacccggaucacggaggacgaccugcacaacgaggagaagaucacccagcagauggacccggagcaccgccagcucgccaacgccaucuucaagcugaccuaccagaacaagguggucaaggugcagcggcccacccccaccggcacggugauggacaucaucagccgcaaggaccagcggggcuccgggcaggucggcaccuacgggcugaacaccuucaccaacauggaggcccagcucauccgccagauggagggcgagggggugcugagcaaggcggaccuggagaacccccaccucccggagaagaagaucacgcaguggcuggagaccaagggcguggagcggcugaagcgcauggccaucuccggcgacgacugcgucgugaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcugguggugcccugccgcccccaggacgagcugaucggccgggcgcgcaucagccagggggccggcuggucccuccgcgagaccgccugccugggcaaggccuacgcgcagauguggagccugauguacuuccaccggcgcgaccuccggcuggccuccaacgccaucugcagcgccguccccgugcacugggugccgaccucccgcacgaccuggagcauccacgcccaccaccaguggaugaccaccgaggacaugcugacggucuggaaccggguguggaucgaggacaaccccuggauggaggacaagacccccgugaccaccugggaggacguccccuaccucgggaagcgcgaggaccaguggugcggcagccugaucgggcugacgucccgggcgaccugggcccagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10109 - RNA, 9873 nt, Artificial Sequence
  derived and/or modified CDS sequence (opt1) from DENV-3__KJ189298__SS-prME
accagccucugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgacccugcccgaguacggcacccuggggcucgagugcuccccgcgcacgggccuggacuucaacgagaugauccugcucaccaugaagaacaaggccuggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgcgccgugcaagauccccuucagcacggaggacgggcacggcaaggcccacaacggccgccugaucaccgccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacacggcgugggacuucggguccgugggcggggugcucaacagccugggcaagaugguccaccagaucuucggguccgccuacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggcggacauggggugcgucaucaacuggaagggcaaggagcugaagugcggcagcgggaucuucgugaccaacgaggugcacaccuggaccgagcaguacaaguuccaggccgacucccccaagcgccucgccacggccaucgccggcgcgugggagaacggggucugcggcauccgcagcaccacccggauggagaaccugcuguggaagcagaucgccaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgcgucccgggccuggaacgucugggagguggaggacuacggguucggcguguucaccaccaacaucuggcuccgccugcgggaggucuacacccagcugugcgaccaccgccucaugagcgccgccgugaaggacgagcgggccgugcacgcggacaugggcuacuggaucgagagccagaagaacggguccuggaagcuggagaaggccagccugaucgaggucaagacgugcaccuggccgaagucccacacccucuggagcaacggcgugcuggaguccgacaugaucauccccaagagccuggccgggcccaucucccagcacaaccaccgcccgggcuaccacacccagacggccgggcccuggcaccucggcaagcuggagcuggacuucaacuacugcgagggcaccaccguggucaucaccgagaacugcgggacgcggggccccagccuccgcaccaccaccguguccgggaagcugauccacgaguggugcugccggagcugcacgcugcccccgcuccgcuacaugggcgaggacgggugcugguacggcauggagauccggcccaucuccgagaaggaggagaacauggucaagagccuggucuccgccggcagcgggaagguggacaacuucaccaugggcgugcugugccucgcgauccuguucgaggaggucaugcgcgggaaguucggcaagaagcacaugaucgccgggguguucuucaccuucgugcugcuccuguccggccagaucaccuggcggaacauggcccacacgcugaucaugaucggcagcaacgccuccgaccgcauggggaugggcgucaccuaccucgcccugaucgcgaccuucaagauccagcccuuccuggcccucggguucuuccugcggaagcugaccagccgcgagaaccuccugcugggcgugggccucgccauggccacgacccugcagcugcccgaggacaucgagcagauggcgaacgggaucgcccucggccugauggcccugaagcucaucacccaguucgagaccuaccagcuguggacggcccugaucagccugaccugcuccaacaccaucuucacccugacgguggccuggcggaccgcgacccugauccucgccggggucagccugcugccggugugccaguccagcuccaugcgcaagaccgacuggcuccccauggccgucgccgccaugggcgugccgccccucccgcuguucaucuucagccucaaggacacgcugaagcgccgguccuggccccugaacgagggggugauggcggucggccucgugagcauccuggccuccagccugcuccgcaacgacgugcccauggccggcccccuggucgccgggggccugcucaucgccugcuacgugaucaccgggaccuccgcggaccugaccguggagaaggccgccgacaucacgugggaggaggaggccgagcagaccggcgucagccacaaccugaugaucaccguggacgacgacgggaccaugcggaucaaggacgacgagaccgagaacauccucacggugcugcugaagaccgcccuccugaucgucuccggcaucuucccguacagcauccccgcgacccugcucguguggcacaccuggcagaagcagacgcagcgcuccggcgugcugugggacguccccagcccgcccgagacccagaaggccgagcuggaggaggggguguaccggaucaagcagcagggcaucuucgggaagacccaggugggcgucggggugcagaaggagggcguguuccacaccauguggcacgucacgcgcggcgccgugcucaccuacaacgggaagcggcuggagcccaacugggccuccgugaagaaggaccugaucagcuacggcgggggcuggcgccucuccacccaguggcagaagggggaggagguccaggugaucgcgguggagcccggcaagaaccccaagaacuuccagaccaugcccggcacguuccagaccaccaccggggagaucggcgccaucgcccuggacuucaagcccgggacgagcggcagccccaucaucaaccgggagggcaaggucguggggcuguacggcaacgggguggucaccaagaacggcggguacguguccggcaucgcccagaccaacgccgagccggacggccccacccccgagcuggaggaggagauguucaagaagcgcaaccucacgaucauggaccugcaccccgggagcggcaagacccggaaguaccugccggcgaucgugcgcgaggccaucaagcggcgccuccggacccugauccuggcccccacccgcgucguggccgccgagauggaggaggcgcucaaggggcugcccauccgguaccagacgaccgccaccaaguccgagcacaccggccgcgagaucguggaccugaugugccacgccacguucaccaugcggcuccugagccccguccgcgugccgaacuacaaccugaucaucauggacgaggcccacuucaccgaccccgccuccaucgcggcccggggguacaucagcacccgcgugggcaugggcgaggccgccgcgaucuucaugacggccacgccgcccgggaccgccgacgccuucccgcaguccaacgcccccauccaggacgaggagcgcgacauccccgagcggagcuggaacuccggcaacgaguggaucaccgacuucgcggggaagacggucugguucgugcccagcaucaaggccggcaacgacaucgccaacugccuccgcaagaacgggaagaaggugauccagcugucccggaagaccuucgacaccgaguaccagaagaccaagcugaacgacugggacuucgucgugacgaccgacaucagcgagaugggcgccaacuucaaggccgaccgcgugaucgacccgcggcgcugccucaagcccgucauccugaccgacggccccgagcgggugauccuggcggggcccaugccggugaccgccgccuccgccgcccagcgccggggccgcgucgggcggaacccccagaaggagaacgaccaguacaucuucaccggccagccccucaacaacgacgaggaccacgcgcacuggacggaggccaagaugcugcuggacaacaucaacacccccgaggggaucaucccggcccucuucgagcccgagcgcgagaaguccgccgcgaucgacggcgaguaccggcugaagggcgagucccgcaagaccuucguggagcugaugcggcgcggggaccuccccguguggcuggcccacaaggucgccagcgagggcaucaaguacaccgaccggaaguggugcuucgacgggcagcgcaacaaccagauccuggaggagaacauggacguggagaucuggacgaaggagggcgagaagaagaagcuccggccccgcuggcuggacgcccgcaccuacuccgacccgcuggcccucaaggaguucaaggacuucgcggccggccgcaagagcaucgcccuggaccuggucaccgagaucgggcgcgugcccucccaccucgcccaccggacccgcaacgcccuggacaaccuggugaugcuccacacgagcgagcacggcgggcgggcguaccgccacgccgucgaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggccgagaucccgcugcaguggaucgcgagcgccaucgugcuggaguucuucaugaugguccuccugauccccgagcccgagaagcagcggacgccccaggacaaccagcuggccuacguggugaucgggauccucacccuggccgccaucaucgcggccaacgagaugggccugcucgagaccacgaagcgcgaccugggcauguccaaggagccgggggucgugagccccaccuccuaccuggacguggaccuccaccccgccagcgccuggacccuguacgcggucgccaccacggugaucacccccaugcugcggcacaccaucgagaacuccaccgccaacgugagccucgccgccaucgcgaaccaggccgucgugcugaugggccuggacaagggguggccgaucuccaagauggaccucggcgugccccugcuggcccucgggugcuacagccaggucaacccccugacgcugaccgccgccgugcuccugcugaucacccacuacgcgaucaucggccccggccuccaggccaaggccacccgcgaggcccagaagcggacggccgcggggaucaugaagaacccgaccguggacggcaucaugaccaucgaccuggaccccgucaucuacgacuccaaguucgagaagcagcugggccaggugaugcuccuggugcugugcgccguccagcuccugcugaugcgcaccagcugggcccucugcgaggcccugacgcuggcgaccggccccaucaccacccucugggagggcucccccgggaaguucuggaacacgaccaucgccgugagcauggccaacaucuuccggggcuccuaccuggccggggccggccuggcguucagcaucaugaaguccguggggaccggcaagcgcggcaccgggagccagggcgagacccucggggagaaguggaagaagaagcugaaccagcugagccggaaggaguucgaccucuacaagaaguccggcaucacggaggucgaccgcaccgaggccaaggaggggcugaagcggggcgagaucacccaccacgccgugagccgcggcuccgccaagcugcagugguucguggagcggaacauggucaucccggaggggcgcgugaucgaccucggcugcgggcggggcggguggagcuacuacugcgccggccugaagaaggugaccgagguccgcggcuacacgaagggcgggcccgggcacgaggagcccgugcccauguccaccuacggcuggaacaucgugaagcugaugagcgggaaggacgucuucuaccucccgcccgagaagugcgacacccugcugugcgacaucggcgaguccagccccucccccaccguggaggagagccgcacgauccgggugcugaagauggucgagccguggcucaagaacaaccaguucugcaucaaggugcugaaccccuacaugcccaccgugaucgagcaccuggagcgccuccagcggaagcacggcgggaugcugguccgcaacccccugucccggaacagcacccacgagauguacuggaucuccaacggcaccgggaacaucguggcgagcgugaacauggucucccgccuccugcugaaccgguucacgaugacccaccgccggccgaccaucgagaaggacguggaccucggcgccggcacccgccacgugaacgccgagcccgagacgcccaacauggacgucaucggggagcggaucaagcgcaucaaggaggagcacaacagcaccuggcacuacgacgaggagaacccguacaagaccugggccuaccacggcuccuacgaggugaaggccaccgggagcgcguccagcaugaucaacggcguggucaagcugcugacgaagcccugggacgugguccccauggugacccagauggccaugaccgacaccacgcccuucgggcagcagcggguguucaaggagaaggucgacacccgcaccccgcggagcaugcccggcacccgccgggugaugggcaucacggccgaguggcucuggcgcacccuggggcggaacaagaagccccgccugugcacccgcgaggaguucaccaagaaggugcggacgaacgccgcgaugggcgccgucuucaccgaggagaaccagugggacuccgccaaggccgccguggaggacgaggacuucuggaagcucguggaccgcgagcgggagcugcacaagcuggggaagugcggcagcugcgucuacaacaugauggggaagcgcgagaagaagcucggcgaguucggcaaggcgaaggggucccgggccaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgcggacgacaccgccgggugggacacccggaucacggaggacgaccugcacaacgaggagaagaucacccagcagauggacccggagcaccgccagcucgccaacgccaucuucaagcugaccuaccagaacaagguggucaaggugcagcggcccacccccaccggcacggugauggacaucaucagccgcaaggaccagcggggcuccgggcaggucggcaccuacgggcugaacaccuucaccaacauggaggcccagcucauccgccagauggagggcgagggggugcugagcaaggcggaccuggagaacccccaccucccggagaagaagaucacgcaguggcuggagaccaagggcguggagcggcugaagcgcauggccaucuccggcgacgacugcgucgugaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcugguggugcccugccgcccccaggacgagcugaucggccgggcgcgcaucagccagggggccggcuggucccuccgcgagaccgccugccugggcaaggccuacgcgcagauguggagccugauguacuuccaccggcgcgaccuccggcuggccuccaacgccaucugcagcgccguccccgugcacugggugccgaccucccgcacgaccuggagcauccacgcccaccaccaguggaugaccaccgaggacaugcugacggucuggaaccggguguggaucgaggacaaccccuggauggaggacaagacccccgugaccaccugggaggacguccccuaccucgggaagcgcgaggaccaguggugcggcagccugaucgggcugacgucccgggcgaccugggcccagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10110 - RNA, 9873 nt, Artificial Sequence
  derived and/or modified CDS sequence (opt1) from DENV-3__KJ189301__SS-prME
accagccucugccucaugaugauccugcccgccgcccuggcguuccaccucaccagccgggacggggagccccggaugaucguggggaagaacgagcggggcaagagccugcuguucaagaccgccuccgggaccaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagacguggaugagcgccgagggcgccuggcgccagguggagaagguggagaccugggcccugcgccacccgggguucaccauccucgcgcuguuccuggcccacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggcgacccuccggaagcugugcaucgagggcaagaucaccaacaucaccacggacagccgcugccccacccagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacacggugaucaucaccguccacaccggggaccagcaccaggugggcaacgagacccagggggucacggccgagaucacgccccaggccagcaccaccgaggcgacccugcccgaguacggcacgcuggggcucgagugcuccccgcgcaccggccuggacuucaacgagaugauccugcucaccaugaagaacaaggccuggauggugcaccggcagugguucuucgaccugccccugcccuggaccagcggcgccacgaccgagacccccaccuggaaccgcaaggagcuccuggugacguucaagaacgcccacgccaagaagcaggaggucguggugcuggggucccaggagggcgcgaugcacaccgcccucaccggggccaccgagauccagaacagcggcgggacguccaucuucgccggccaccugaagugccggcugaagauggacaagcucgagcugaagggcaugagcuacgccaugugcaccaacaccuucguccugaagaaggagguguccgagacccagcacgggacgauccucaucaagguggaguacaagggcgaggacgcgccgugcaagauccccuucagcaccgaggacgggcacggcaaggcccacaacggccgccugaucaccgccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccacggcccggggcgcccgccggauggccauccugggcgacaccgcgugggacuucggguccgugggcggggugcucaacagccugggcaagaugguccaccagaucuucggguccgccuacaccgcccuguucagcggcguguccugggugaugaagaucggcaucgggguccuccugaccuggaucggccugaacagcaagaacacguccaugagcuucuccugcaucgccaucgggaucaucacccucuaccugggcgccguggugcaggcggacauggggugcgucaucaacuggaagggcaaggagcugaagugcggcagcgggaucuucgugaccaacgaggugcacaccuggacggagcaguacaaguuccaggccgacucccccaagcgccucgccaccgccaucgccggcgcgugggagaacggggucugcggcauccgcagcaccacccggauggagaaccugcuguggaagcagaucgccaacgagcucaacuacauccugugggagaacaacgugaagcugacgguggucgugggggacaucaucggcgugcucgagcgcggcaagcggacccugacgccccagccgauggagcugaaguacuccuggaagaccugggggaaggccaagaucgucacggccgagacccagaacagcuccuucaucaucgacggccccaacacccccgagugccccagcgcgucccgcgccuggaacgugugggagguggaggacuacggguucggcgucuucaccaccaacaucuggcuccggcugcgcgaggccuacacgcagcugugcgaccaccggcucaugagcgccgccgugaaggacgagcgcgcggugcacgccgacaugggcuacuggaucgagagccagaagaacggguccuggaagcuggagaaggccagccugaucgaggucaagaccugcaccuggccgaagucccacacccucuggagcaacggcgugcuggaguccgacaugaucauccccaagagccuggccgggcccaucucccagcacaaccaccggccgggcuaccacacgcagaccgccgggcccuggcaccucggcaagcuggagcuggacuucaacuacugcgagggcaccaccguggucaucacggagaacugcgggacccgcggccccagccuccggaccaccacgguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgcgggcagcgggaagguggacaacuucaccaugggcgugcugugccucgccauccuguucgaggaggucaugcgggggaaguucggcaagaagcacaugaucgccgggguguucuucaccuucgugcugcuccuguccggccagaucacguggcgcgacauggcccacacccugaucaugaucggcagcaacgccuccgaccggauggggaugggcgucaccuaccucgcgcugaucgccaccuucaagauccagcccuuccuggcccucggguucuuccugcgcaagcugacgagccgggagaaccuccugcugggcgugggccucgccauggcgaccacccugcagcugcccgaggacaucgagcagauggccaacgggaucgcccucggccugauggcccugaagcucaucacccaguucgagacguaccagcuguggaccgcccugaucagccugaccugcuccaacaccaucuucacgcugaccguggcguggcgcaccgccacccugauccucgccggggucagccugcugccggugugccaguccagcuccaugcgcaagacggacuggcuccccauggccgucgccgcgaugggcgugccgccccucccgcuguucaucuucagccucaaggacacccugaagcggcgcuccuggccccugaacgagggggugauggccgucggccucgugagcauccuggccuccagccugcuccggaacgacgugcccauggccggcccccuggucgccgggggccugcucaucgcgugcuacgugaucaccgggaccuccgccgaccugacgguggagaaggccgccgacaucaccugggaggaggaggccgagcagaccggcgucagccacaaccugaugaucaccguggacgacgacgggaccaugcgcaucaaggacgacgagacggagaacauccucaccgugcugcugaagaccgcgcuccugaucgucuccggcaucuucccguacagcauccccgccacccugcucguguggcacacguggcagaagcagacccagcgguccggcgugcugugggacguccccagcccgcccgagacccagaaggccgagcuggaggaggggguguaccgcaucaagcagcagggcaucuucgggaagacccaggugggcgucggggugcagaaggagggcguguuccacacgauguggcacgucacccggggcgccgugcucaccuacaacgggaagcgccuggagcccaacugggcguccgugaagaaggaccugaucagcuacggcgggggcuggcggcucuccacccaguggcagaagggggaggagguccaggugaucgccguggagcccggcaagaaccccaagaacuuccagacgaugcccggcaccuuccagaccaccacgggggagaucggcgccaucgcccuggacuucaagcccgggaccagcggcagccccaucaucaaccgcgagggcaaggucguggggcuguacggcaacgggguggucaccaagaacggcggguacguguccggcaucgcccagaccaacgcggagccggacggccccacgcccgagcuggaggaggagauguucaagaagcggaaccucaccaucauggaccugcaccccgggagcggcaagacccgcaaguaccugccggccaucgugcgggaggccaucaagcgccggcuccgcacccugauccuggcccccacgcgggucguggccgcggagauggaggaggcccucaaggggcugcccauccgcuaccagaccaccgccaccaaguccgagcacacgggccgggagaucguggaccugaugugccacgccaccuucaccaugcgccuccugagccccguccgggugccgaacuacaaccugaucaucauggacgaggcccacuucaccgaccccgcguccaucgccgcccgcggguacaucagcacgcgcgugggcaugggcgaggccgcggccaucuucaugaccgccacgccgcccgggaccgccgacgccuucccgcaguccaacgcgcccauccaggacgaggagcgggacauccccgagcgcagcuggaacuccggcaacgaguggaucacggacuucgccgggaagaccgucugguucgugcccagcaucaaggccggcaacgacaucgccaacugccuccggaagaacgggaagaaggugauccagcugucccgcaagaccuucgacaccgaguaccagaagacgaagcugaacgacugggacuucgucgugaccaccgacaucagcgagaugggcgccaacuucaaggcggaccgggugaucgacccgcgccggugccucaagcccgucauccugaccgacggccccgagcgcgugauccuggccgggcccaugccggugaccgccgccuccgccgcgcagcggcgcggccgggucgggcgcaacccccagaaggagaacgaccaguacaucuucacgggccagccccucaacaacgacgaggaccacgcccacuggaccgaggccaagaugcugcuggacaacaucaacacccccgaggggaucaucccggcccucuucgagcccgagcgggagaaguccgcggccaucgacggcgaguaccgccugaagggcgagucccggaagaccuucguggagcugaugcgccgcggggaccuccccguguggcuggcccacaaggucgccagcgagggcaucaaguacacggaccgcaaguggugcuucgacgggcagcggaacaaccagauccuggaggagaacauggacguggagaucuggaccaaggagggcgagaagaagaagcuccgcccccgcuggcuggacgcccggaccuacuccgacccgcuggcgcucaaggaguucaaggacuucgccgccggccgcaagagcaucgcccuggaccuggucaccgagaucgggcgggugcccucccaccucgcccaccgcacgcggaacgcgcuggacaaccuggugaugcuccacaccagcgagcacggcgggcgcgccuaccggcacgccgucgaggagcugcccgagaccauggagacccugcuccugcugggccucaugauccugcugaccggcggggccaugcuguuccugaucagcgggaaggggaucggcaagaccuccaucgggcugaucugcgugaucgccagcuccggcaugcucuggauggcggagaucccgcugcaguggaucgccagcgccaucgugcuggaguucuucaugaugguccuccuggugcccgagcccgagaagcagcgcacgccccaggacaaccagcuggccuacguggucaucgggauccucacccuggccgcgaucaucgccgccaacgagaugggccugcucgagacgaccaagcgggaccugggcauguccaaggagccggggguggugagccccaccuccuaccuggacgucgaccuccaccccgccagcgcguggacccuguacgccguggccacgaccgugaucacccccaugcugcgccacaccaucgagaacuccacggccaacgucagccucgccgcgaucgccaaccaggccguggugcugaugggccuggacaagggguggccgaucuccaagauggaccucggcgucccccugcuggcccucgggugcuacagccaggugaacccccugacccugaccgccgcggugcuccugcugaucacccacuacgccaucaucggccccggccuccaggccaaggccacgcgggaggcccagaagcgcaccgcggccgggaucaugaagaacccgaccgucgacggcaucaugaccaucgaccuggaccccgugaucuacgacuccaaguucgagaagcagcugggccaggugaugcuccugguccugugcgccgugcagcuccugcugaugcggacgagcugggcccucugcgaggcgcugacccuggccaccggccccaucaccacgcucugggagggcucccccgggaaguucuggaacaccaccaucgccgugagcauggccaacaucuuccgcggcuccuaccuggccggggcgggccuggccuucagcaucaugaaguccgucgggaccggcaagcggggcaccgggagccagggcgagacgcucggggagaaguggaagaagaagcugaaccagcugagccgcaaggaguucgaccucuacaagaaguccggcaucaccgagguggaccggaccgaggccaaggaggggcugaagcgcggcgagaucacccaccacgccgugagccggggcuccgccaagcugcagugguucgucgagcgcaacauggugaucccggaggggcgggugaucgaccucggcugcgggcgcggcggguggagcuacuacugcgcgggccugaagaaggucacggaggugcgcggcuacaccaagggcgggcccgggcacgaggagcccgugcccauguccaccuacggcuggaacaucgucaagcugaugagcgggaaggacguguucuaccucccgcccgagaagugcgacacccugcugugcgacaucggcgaguccagccccucccccacgguggaggagagccggaccauccgcguccugaagaugguggagccguggcucaagaacaaccaguucugcaucaaggugcugaaccccuacaugcccaccgucaucgagcaccuggagcggcuccagcgcaagcacggcgggaugcuggugcggaacccccugucccgcaacagcacccacgagauguacuggaucuccaacggcacggggaacaucguggccagcgucaacauggugucccggcuccugcugaaccgcuucaccaugacccaccggcgcccgaccaucgagaaggacguggaccucggcgccggcacgcggcacgucaacgccgagcccgagacccccaacauggacgugaucggggagcgcaucaagcggaucaaggaggagcacaacagcaccuggcacuacgacgacgagaacccguacaagaccugggccuaccacggcuccuacgaggugaaggcgacggggagcgccuccagcaugaucaacggcgucgugaagcugcugaccaagcccugggacgucgugcccauggugacccagauggccaugaccgacacgacccccuucgggcagcagcgcgucuucaaggagaagguggacacccggaccccgcgcagcaugcccggcacgcggcgcgugaugggcaucaccgccgaguggcucuggcggacccuggggcgcaacaagaagccccgccugugcacccgggaggaguucacgaagaagguccgcaccaacgcggccaugggcgccguguucaccgaggagaaccagugggacuccgccaaggccgcgguggaggacgaggacuucuggaagcucgucgaccgggagcgcgagcugcacaagcuggggaagugcggcagcugcguguacaacaugauggggaagcgggagaagaagcucggcgaguucggcaaggccaaggggucccgcgccaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgcgauguacgccgacgacaccgccgggugggacacgcgcaucaccgaggacgaccugcacaacgaggagaagaucacccagcagauggacccggagcaccggcagcucgccaacgccaucuucaagcugaccuaccagaacaaggucgugaaggugcagcgccccacccccacgggcaccgucauggacaucaucagccggaaggaccagcgcggcuccggccaggugggcaccuacgggcugaacaccuucacgaacauggaggcgcagcucauccggcagauggagggcgagggggugcugagcaaggccgaccuggagaacccccaccucccggagaagaagaucacccaguggcuggagaccaagggcgucgagcgccugaagcggauggccaucuccggcgacgacugcguggugaagcccaucgacgaccgcuucgccaacgcccuccuggcgcugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcccgcaucagccagggggccggcuggucccuccgggagaccgccugccugggcaaggcguacgcccagauguggagccugauguacuuccaccgccgggaccuccgccuggccuccaacgccaucugcagcgccgugcccgugcacugggucccgacgucccggaccaccuggagcauccacgcgcaccaccaguggaugaccacggaggacaugcugaccguguggaaccgcguguggaucgaggacaaccccuggauggaggacaagacccccgucaccacgugggaggacgugcccuaccucgggaagcgggaggaccaguggugcggcagccugaucgggcugaccucccgcgccaccugggcccagaacaucccgaccgccauccagcagguccggagccucaucggcaacgaggaguuccuggacuacaugcccuccaugaagcgcuuccggaaggaggaggagagcgagggggccaucugguga

SEQ ID NO: 10111 - RNA, 9873 nt, Artificial Sequence
  derived and/or modified CDS sequence (opt1) from DENV-3__KF955456__SS-prME
accagccugugccucaugaugauccugcccgccgcccuggccuuccaccucaccagccgggacggggagccccggaugaucguggggaagaacgagcgcggcaagagccugcuguucaagaccgccagcgggaucaacaugugcacccucaucgccauggaccugggcgagaugugcgacgacaccgugaccuacaagugcccccacaucgccgagguggagcccgaggacaucgacugcuggugcaaccugaccagcaccugggugaccuacgggaccugcaaccaggccggcgagcaccggcgcgacaagcgguccguggcgcucgcgccccacgugggcauggggcuggacacgcgcacccagaccuggaugagcgccgagggcgccuggcgccagguggagaagguggagaccugggcgcugcgccacccgggguucacgauccucgcccuguuccuggcccacuacaucggcaccucccucacccagaagguggugaucuucguccugcugaugcucgugacccccagcaugacgaugcggugcgugggggucggcaaccgcgacuucguggagggccuguccggggccaccuggguggacgucgugcuggagcacggcgggugcgugaccaccauggccaagaacaagcccacgcucgacaucgagcugcagaagaccgaggcgacccagcuggccacccuccggaagcugugcaucgagggcaagaucacgaacaucaccaccgacagccgcugccccacccagggcgaggccguccugccggaggagcaggaccagaacuacgugugcaagcacacguacguggaccggggguggggcaacgggugcggccucuucgggaagggcucccuggugaccugcgccaaguuccagugccuggagcccaucgagggcaagguggugcaguacgagaaccucaaguacaccgucaucaucaccgugcacacgggggaccagcaccaggucggcaacgagacccagggggugaccgccgagaucacgccccaggcgagcacgaccgaggccauccugcccgaguacggcacccuggggcucgagugcuccccgcgcaccggccuggacuucaacgagaugauccugcucaccaugaagaacaaggccuggauggugcaccggcagugguucuucgaccugccccugcccuggacgagcggcgccaccaccgagacccccacguggaaccgcaaggagcuccuggucaccuucaagaacgcccacgcgaagaagcaggagguggugguccuggggucccaggagggcgccaugcacaccgcccucaccggggccacggagauccagaacagcggcgggaccuccaucuucgccggccaccugaagugccggcugaagauggacaagcucgagcugaagggcaugagcuacgcgaugugcaccaacaccuucgugcugaagaaggagguguccgagacgcagcacgggaccauccucaucaaggucgaguacaagggcgaggacgccccgugcaagauccccuucagcaccgaggacgggcagggcaaggcccacaacggccgccugaucaccgccaaccccguggugacgaagaaggaggagcccgucaacaucgaggcggagccgcccuucggggagagcaacaucgugaucggcaucggggacaacgcccugaagaucaacugguacaagaagggcuccagcaucgggaagauguucgaggccaccgcccggggcgcccgccggauggcgauccugggcgacaccgccugggacuucggguccgugggcgggguccucaacagccugggcaagauggugcaccagaucuucggguccgccuacaccgcccuguucagcggcguguccugggucaugaagaucggcaucggggugcuccugacguggaucggccugaacagcaagaacaccuccaugagcuucuccugcaucgccaucgggaucaucacccucuaccugggcgcggugguccaggccgacaccgggugcgugaucaacuggaagggcaaggagcugaagugcggcagcgggaucuucgugacgaacgagguccacaccuggaccgagcaguacaaguuccaggccgacucccccaagcgccucgccaccgccaucgcgggcgccugggagaacggggugugcggcauccgcagcacgacccggauggagaaccugcuguggaagcaggucgccaacgagcucaacuacauccugugggagaacaacaucaagcugaccgucguggugggggacaucaucggcguccucgagcagggcaagcgcacccugacgccccagccgauggagcugaaguacuccuggaagaccugggggaaggccaagaucgugaccgcggagacccagaacagcuccuucaucaucgacggccccaacacgcccgagugccccagcgccucccgggccuggaacgugugggaggucgaggacuacggguucggcguguucaccaccaacaucuggcucaagcugcgcgagguguacacccagcugugcgaccaccggcucaugagcgccgccgucaaggacgagcgcgcggugcacgccgacaugggcuacuggaucgagagccagaagaacggguccuggaagcuggagaaggccagccugaucgaggugaagaccugcacguggccgaagucccacacccucuggagcaacggcguccuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgcgggcagcgggaaggucgacaacuucacgaugggcgugcugugccucgccauccuguucgaggaggugaugcgggggaaguucggcaagaagcacaugaucgccggggucuucuucaccuucgugcugcuccuguccggccagaucaccuggcgcgacauggcccacacccuggugaugaucggcagcaacgccuccgaccggauggggaugggcgucacguaccucgcgcugaucgccaccuucaagauccagcccuuccuggcccucggguucuuccugcgcaagcugaccagccgggagaaccuccugcugggcgugggccucgccauggcgaccacgcugcagcugcccgaggacaucgagcagauggccaacgggaucgcccucggccugauggcccugaagcucaucacccaguucgagaccuaccagcuguggaccgcccugaucagccucacgugcuccaacaccaucuucacccugaccgucgcguggcgcacggccacccugauccucgccggggugagccugcugccggugugccaguccagcuccaugcggaaguccgacuggcuccccaugaccgucgccgccaugggcgugccgccccucccgcuguucaucuucucccucaaggacacccugaagcgccgcagcuggccccugaacgagggggugauggcggucggccucguguccauccuggccagcucccugcuccggaacgacgugcccauggccggcccccuggucgccgggggccugcucaucgccugcuacgugaucacggggaccagcgcggaccugaccguggagaaggccgccgacgucaccugggaggaggaggccgagcagacgggcgugucccacaaccugaugaucaccguggacgacgacgggaccaugcgcaucaaggacgacgagaccgagaacauccucaccguccugcugaagacggcccuccugaucgugagcggcaucuucccguacuccauccccgcgacccugcucguguggcacaccuggcagaagcagacccggcgcagcggcguccugugggacgugcccagcccgcccgagacgcagaaggccgagcuggaggaggggguguaccggaucaagcagcagggcaucuucgggaagacccaggucggcgugggggugcagaaggagggcgucuuccacaccauguggcacgugacccgcggcgccgugcucacguacaacgggaagcggcuggagcccaacugggccagcgucaagaaggaccugaucuccuacggcgggggcuggcgccucagcgcgcaguggcagaagggggaggagguccaggugaucgccgucgagcccggcaagaaccccaagaacuuccagaccaugcccggcaccuuccagaccacgaccggggagaucggcgccaucgcccuggacuucaagcccgggaccagcggcucccccaucaucaaccgggagggcaaggugguggggcuguacggcaacggggucgugaccaagaacggcggguacgugagcggcaucgcccagacgaacgcggagccggacggccccacccccgagcuggaggaggagauguucaagaagcgcaaccucaccaucauggaccugcaccccggguccggcaagacccggaaguaccugccggccaucguccgcgaggccaucaagcggcgccuccggacgcugauccuggcccccacccgcgugguggccgcggagauggaggaggcccucaaggggcugcccauccgguaccagaccaccgccaccaagagcgagcacaccggccgcgagaucgucgaccugaugugccacgccaccuucaccaugcggcuccugucccccgugcgcgugccgaacuacaaccugaucaucauggacgaggcccacuucacggaccccgcgagcaucgccgcccggggguacaucuccacccgcgucggcaugggcgaggccgcggccaucuucaugaccgccacgccgcccgggacggccgacgccuucccgcagagcaacgcgcccauccaggacgaggagcgcgacauccccgagcgguccuggaacagcggcaacgaguggaucaccgacuucgccgggaagaccgugugguucgugcccuccaucaaggccggcaacgacaucgccaacugccuccgcaagaacgggaagaaggucauccagcugagccggaagaccuucgacacggaguaccagaagaccaagcugaacgacugggacuucguggugaccaccgacaucuccgagaugggcgccaacuucaaggcggaccgcgucaucgacccgcggcgcugccucaagcccgugauccugacggacggccccgagcgggugauccuggccgggcccaugccggucaccgccgccagcgccgcgcagcgccggggccgcguggggcggaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgcgagaaguccgcggccaucgacggcgaguaccggcugaagggcgagagccgcaagacguucgucgagcugaugcggcgcggggaccuccccguguggcuggcccacaagguggccuccgagggcaucaaguacaccgaccggaaguggugcuucgacgggcagcgcaacaaccagauccuggaggagaacauggacgucgagaucuggaccaaggagggcgagaagaagaagcuccggccccgcuggcuggacgcccgcaccuacagcgacccgcuggcgcucaaggaguucaaggacuucgccgccggccggaaguccaucgcccuggaccuggugacggagaucgggcgcgugcccagccaccucgcccaccggacccgcaacgcgcuggacaaccuggucaugcuccacaccagcgagcacggcgggaaggccuaccggcacgccguggaggagcugcccgagaccauggagacgcugcuccugcugggccucaugauccugcugaccgggggcgccaugcuguuccugaucuccggcaaggggaucggcaagaccagcaucgggcugaucugcgugaucgccuccagcggcaugcucuggauggcggagaucccgcugcaguggaucgccuccgccaucguccuggaguucuucaugauggugcuccugauccccgagcccgagaagcagcgcacgccccaggacaaccagcuggccuacguggucaucgggauccucacgcuggccgcgaucaucgccgccaacgagaugggccugcucgagaccaccaagcgggaccugggcaugagcaaggagccggggguggugucccccaccagcuaccuggacgucgaccuccaccccgccuccgcguggacgcuguacgccguggccaccaccgugaucacccccaugcugcgccacacgaucgagaacagcaccgccaacgucucccucgccgcgaucgccaaccaggccguggugcugaugggccuggacaagggguggccgaucagcaagauggaccucggcgucccccugcuggcccucgggugcuacucccaggugaacccccugacccugaccgccgcggugcuccugcugaucacgcacuacgccaucaucggccccggccuccaggccaaggccacccgggaggcccagaagcgcaccgcggccgggaucaugaagaacccgaccgucgacggcaucaugacgaucgaccuggaccccgugaucuacgacagcaaguucgagaagcagcugggccaggugaugcuccugguccugugcgccauccagcuccugcugaugcggaccuccugggcccucugcgaggcgcugacccuggccaccggccccaucacgacccucugggagggcagccccgggaaguucuggaacaccaccaucgccguguccauggccaacaucuuccgcggcagcuaccuggccggggcgggccuggccuucuccaucaugaaguccguggggacgggcaagcggggcaccgggagccagggcgagacccucggggagaaguggaagaagaagcugaaccagcugucccgcaaggaguucgaccucuacaagaaguccggcaucaccgaggucgaccggaccgaggccaaggaggggcugaagcgcggcgagaucacgcaccacgccgugucccggggcagcgccaagcugcagugguucguggagcgcaacauggucaucccggaggggcgggugaucgaccucggcugcgggcgcggcgggugguccuacuacugcgcgggccugaagaaggugaccgagguccggggcuacaccaagggcgggcccgggcacgaggagcccgugcccaugagcaccuacggcuggaacaucgugaagcugauguccgggaaggacgucuucuaccucccgcccgagaagugcgacacgcugcugugcgacaucggcgagagcucccccagccccaccguggaggagucccgcaccauccgcgugcugaagauggucgagccguggcucaagaacaaccaguucugcaucaaggugcugaaccccuacaugcccaccgugaucgagcaccuggagcggcuccagcgcaaguacggcgggaugcugguccggaacccccugagccgcaacuccacgcacgagauguacuggaucagcaacggcaccgggaacaucguggccuccgugaacauggucagccggcuccugcugaaccgcuucaccaugacccaccggcgcccgacgaucgagaaggacguggaccucggcgccggcacccggcacgugaacgccgagcccgagacccccaacauggacgucaucggggagcgcaucaagcggaucaaggaggagcacaacuccaccuggcacuacgacgacgagaacccguacaagacgugggccuaccacggcagcuacgaggugaaggcgaccggguccgccagcagcaugaucaacggcgucgugaagcugcugaccaagcccugggacgugguccccauggugacccagauggccaugacggacaccacccccuucgggcagcagcgcguguucaaggagaaggucgacacccggacgccgcgcuccaugcccggcacccggcgcgugaugggcaucaccgccgaguggcucuggcggacccuggggcgcaacaagaagccccggcugugcacgcgcgaggaguucaccaagaaggugcgcaccaacgcggccaugggcgccgucuucaccgaggagaaccagugggacagcgccaaggccgcgguggaggacgaggacuucuggaagcucguggaccgggagcgcgagcugcacaagcuggggaagugcggcuccugcgucuacaacaugauggggaagcgggagaagaagcucggcgaguucggcaaggccaaggggagccgcgccaucugguacauguggcugggcgcccgguaccuggaguucgaggcccucggguuccugaacgaggaccacugguucucccgcgagaacagcuacuccggcguggagggggagggccugcacaagcucggcuacauccugcgggacaucagcaagauccccgggggcgcgauguacgccgacgacacggccgggugggacacccgcaucaccgaggacgaccugcacaacgaggagaagaucacccagcagauggacccggagcaccggcagcucgccaacgccaucuucaagcugacguaccagaacaagguggucaaggugcagcgccccacccccaccggcaccgugauggacaucaucucccggaaggaccagcgcggcagcgggcaggucggcaccuacgggcugaacacguucaccaacauggaggcgcagcucauccggcagauggagggcgagggggugcugaccaaggccgaccuggagaacccccaccucuccgagaagaagaucacccaguggcuggagacgaagggcguggagcgccugaagcggauggccaucagcggcgacgacugcgucgugaagccgaucgacgaccgcuucgccaacgcccuccuggcgcugaacgacauggggaaggugcggaaggacaucccccaguggcagcccuccaagggcuggcacgacuggcagcagguccccuucugcagccaccacuuccacgagcucaucaugaaggacgggcgcaagcugguggugccgugccggccccaggacgagcugaucggccgcgcccggaucucccagggggccggcuggagccuccgcgagaccgccugccugggcaaggcguacgcccagauguggucccugauguacuuccaccgccgggaccuccgccuggccagcaacgccaucugcuccgccguccccgugcacugggugcccaccagccggaccacguggagcauccacgcgcaccaccaguggaugaccaccgaggacaugcugaccgucuggaaccgcguguggaucgaggacaacccguggauggaggacaagacgcccgugaccaccugggagaacguccccuaccucgggaagcgggaggaccaguggugcggcucccugaucgggcugaccagccgcgccacgugggcccagaacauccccaccgccauccagcagguccggucccucaucggcaacgaggaguuccuggacuacaugccgagcaugaagcgcuuccggaaggaggaggaguccgagggggccaucugguga

SEQ ID NO: 10112 - RNA, 9873 nt, Artificial Sequence
  derived and/or modified CDS sequence (opt1) from DENV-3__KF955465__SS-prME
accagccugugcaucaugaugauccuccccgcggcgcuggcguuccaccugaccagccgggacggggagccgcggaugaucguggggaagaacgagcggggcaagagccuccuguucaagacggccuccgggaucaacaugugcacccugaucgccauggaccucggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccuggcgccccacgugggcauggggcucgacacccgcacccagaccuggaugagcgccgagggcgccuggcgccagguggagaagguggagacgugggcccugcgccacccgggguucaccauccuggcccucuuccuggcccacuacaucggcaccucccugacccagaagguggugaucuucauccuccugaugcuggugacgcccagcaugaccaugcggugcgugggggugggcaaccgcgacuucgucgagggccucuccggggccaccuggguggacgugguccuggagcacggcgggugcgugaccacgauggccaagaacaagcccacccuggacaucgagcuccagaagaccgaggccacccagcuggcgacgcugcggaagcucugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccuguucgggaagggcucccucgugaccugcgccaaguuccagugccuggagcccaucgagggcaaggucgugcaguacgagaaccugaaguacaccgugaucaucacgguccacaccggggaccagcaccaggugggcaacgagacccagggggucaccgccgagaucacgccccaggccagcaccaccgaggcgauccuccccgaguacggcacccuggggcuggagugcuccccgcgcaccggccucgacuucaacgagauggugcugcugacgaugaagaacaaggccuggauggugcaccggcagugguucuucgaccucccccugcccuggaccagcggcgccaccaccgagacgcccaccuggaaccgcaaggagcugcucgucaccuucaagaacgcccacgccaagaagcaggagguggugguccuggggucccaggagggcgcgaugcacaccgcccugacgggggccaccgagauccagaacagcggcgggaccuccaucuucgccggccaccucaagugccggcugaagauggacaagcuggagcucaagggcaugagcuacgccaugugcaccaacacguucgugcugaagaaggagguguccgagacccagcacgggaccauccugaucaaggucgaguacaagggcgaggacgugccgugcaagauccccuucagcaccgaggacgggcagggcaaggcgcacaacggccgccucaucacggccaaccccguggucaccaagaaggaggagcccgugaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgucggcggggugcugaacagccucggcaagauggugcaccagaucuucggguccgcguacacggcccuguucagcggcgucuccugggugaugaagaucggcaucggggugcugcucaccuggaucggccugaacagcaagaacaccuccaugagcuucuccugcaucgucaucgggaucaucacccuguaccucggcgccguggugcaggccgacauggggugcgucaucaacuggaagggcaaggagcugaagugcggcagcgggaucuucgugacgaacgaggugcacaccuggaccgagcaguacaaguuccaggccgacucccccaagcgccuggcgaccgccaucgccggcgccugggagaacggggucugcggcauccgcagcacgacccggauggagaaccuccuguggaagcagaucgccaacgagcugaacuacauccucugggagaacaacaucaagcugaccgugguggucggggacaucaucggcgugcuggagcagggcaagcgcacccucacgccccagccgauggagcugaaguacuccuggaagaccugggggaaggcgaagaucgugaccgccgagacccagaacagcuccuucaucaucgacggccccaacacgcccgagugccccagcgccucccgggccuggaacgucugggagguggaggacuacggguucggcguguucaccaccaacaucuggcugaagcuccgcgaggucuacacccagcugugcgaccaccggcugaugagcgcggccgugaaggacgagcgcgccgugcacgccgacaugggcuacuggaucgagagccagaagaacggguccuggaagcucgagaaggccagccugaucgaggucaagaccugcacguggccgaagucccacacccuguggagcaacggcgugcucgaguccgacaugaucauccccaagagccuggcggggcccaucucccagcacaacuaccggccgggcuaccacacccagaccgccgggcccuggcaccugggcaagcucgagcuggacuucaacuacugcgagggcacgaccguggucaucaccgagaacugcgggacccgcggccccagccugcggacgaccaccguguccgggaagcucauccacgaguggugcugccgcagcugcacccugcccccgcugcgguacaugggcgaggacgggugcugguacggcauggagauccgccccaucuccgagaaggaggagaacauggucaagagccucgucuccgccggcagcgggaagguggacaacuucacgaugggcgugcugugccuggccauccucuucgaggaggucaugcgggggaaguucggcaagaagcacaugaucgccgggguguucuucaccuucgugcugcugcucuccggccagaucaccuggcgcgacauggcgcacacccugaucaugaucggcagcaacgccuccgaccggauggggaugggcgucacguaccuggcccucaucgccaccuucaagauccagcccuuccuggcccugggguucuuccuccgcaagcugaccagccgggagaaccugcuccugggcgugggccuggcgauggccaccacgcuccagcugcccgaggacaucgagcagauggccaacgggaucgcccugggccucauggcgcugaagcugaucacccaguucgagaccuaccagcucuggaccgcccugaucagccugacgugcuccaacaccaucuucacccucaccgucgccuggcgcacggccacccugauccuggccggggugagccuccugccggugugccaguccagcuccaugcggaagaccgacuggcugcccaugaccgucgcggccaugggcgugccgccccucccgcuguucaucuucagccugaaggacacgcucaagcgccgcuccuggccccugaacgagggggugauggccgucggccuggugagcauccucgccuccagccugcugcggaacgacgugcccauggccggcccccucgucgccggcgggcugcugaucgccugcuacgugaucaccgggaccuccgccgaccucaccguggagaaggccgccgacgucacgugggaggaggaggcggagcagaccggggugagccacaaccugaugaucaccguggacgacgacgggaccaugcgcaucaaggacgacgagaccgagaacauccugacgguccuccugaagaccgcccugcucaucguguccggcaucuucccguacagcauccccgccacccugcugguguggcacaccuggcagaagcagacgcagcgguccggcguccucugggacgugcccagcccgcccgagacccagaaggccgagcuggaggaggggguguaccgcaucaagcagcagggcaucuucgggaagacccaggucggcgugggggugcagaaggagggcgucuuccacaccauguggcacgugacgcggggcgccgugcugaccuacaacgggaagcgccucgagcccaacugggcguccgucaagaaggaccugaucagcuacggcgggggcuggcggcuguccgcccaguggcagaagggggaggagguccaggugaucgccgucgagcccggcaagaaccccaagaacuuccagaccaugcccggcaccuuccagacgaccaccggggagaucggcgccaucgcgcucgacuucaagcccgggaccagcggcagccccaucaucaaccgcgagggcaaggugguggggcuguacggcaacggggucgugacgaagaacggcggguacguguccggcaucgcccagaccaacgccgagccggacggccccacccccgagcuggaggaggagauguucaagaagcggaaccugaccaucauggaccuccaccccgggagcggcaagacgcgcaaguaccugccggccaucguccgggaggccaucaagcgccggcugcgcacccucauccuggcgcccacccgggugguggccgccgagauggaggaggcccugaaggggcuccccauccgcuaccagaccacggccaccaaguccgagcacaccggccgggagaucgucgaccugaugugccacgcgaccuucacgaugcgccugcucagccccgugcgggugccgaacuacaaccugaucaucauggacgaggcccacuucaccgaccccgccuccaucgccgcccgcggguacaucagcacccgggucggcaugggcgaggcggccgccaucuucaugaccgccacgccgcccgggaccgcggacgccuucccgcaguccaacgcccccauccaggacgaggagcgcgacauccccgagcgcagcuggaacuccggcaacgaguggaucaccgacuucgccgggaagaccgugugguucgugcccagcaucaaggccggcaacgacaucgcgaacugccugcggaagaacgggaagaaggucauccagcucucccgcaagacguucgacaccgaguaccagaagaccaagcugaacgacugggacuucguggugaccacggacaucagcgagaugggcgccaacuucaaggccgaccgggucaucgacccgcgccggugccugaagcccgugauccucaccgacggccccgagcgcgugauccuggccgggcccaugccggucaccgccgcguccgccgcccagcggcgcggccggguggggcgcaacccccagaaggagaacgaccaguacaucuucaccggccagccccugaacaacgacgaggaccacgcccacuggaccgaggccaagaugcuccuggacaacaucaacacgcccgaggggaucaucccggcgcuguucgagcccgagcgggagaaguccgccgccaucgacggcgaguaccgccucaagggcgagucccggaagaccuucgucgagcugaugcgccgcggggaccugcccguguggcucgcccacaagguggcgagcgagggcaucaaguacaccgaccgcaaguggugcuucgacgggcagcggaacaaccagauccuggaggagaacauggacgucgagaucuggaccaaggagggcgagaagaagaagcugcgcccccgguggcucgacgcccgcacguacuccgacccgcuggcccugaaggaguucaaggacuucgccgccggccgcaagagcaucgcgcucgaccuggugaccgagaucgggcgggugcccucccaccuggcccaccgcacccggaacgcccucgacaaccuggucaugcugcacaccagcgagcacggcgggaaggccuaccgccacgccguggaggagcuccccgagacgauggagacccugcugcuccugggccugaugauccuccugaccgggggcgcgaugcuguuccucaucagcggcaaggggaucggcaagaccuccaucgggcugaucugcgugaucgccagcuccggcaugcuguggauggccgagaucccgcuccaguggaucgccagcgccaucguccuggaguucuucaugauggugcugcucauccccgagcccgagaagcagcggacgccccaggacaaccagcuggcguacguggucaucgggauccugacccucgccgccaucaucgccgccaacgagaugggccugcuggagaccaccaagcgcgaccucggcauguccaaggagccggggguggugagccccacguccuaccuggacgucgaccugcaccccgcgagcgccuggacccucuacgccguggccaccaccgugaucacgcccaugcugcggcacaccaucgagaacuccaccgcgaacgucagccuggccgccaucgccaaccaggccguggugcucaugggccuggacaagggguggccgaucuccaagauggaccugggcgucccccuccuggcgcuggggugcuacagccaggugaacccccucacccugacggccgccgugcugcuccugaucacccacuacgccaucaucggccccggccugcaggccaaggcgacccgcgaggcccagaagcggaccgccgccgggaucaugaagaacccgacggucgacggcaucaugaccaucgaccucgaccccgugaucuacgacuccaaguucgagaagcagcugggccaggugaugcugcucguccugugcgccgugcagcugcuccugaugcgcaccagcugggcgcugugcgaggcccucacccuggccacgggccccaucaccacccugugggagggcucccccgggaaguucuggaacaccacgaucgccgugagcauggcgaacaucuuccggggcuccuaccucgccggggccggccuggccuucagcaucaugaaguccgucgggaccggcaagcgcggcaccgggagccagggcgagacccugggggagaaguggaagaagaagcucaaccagcugagccggaaggaguucgaccuguacaagaaguccggcaucaccgagguggaccgcacggaggccaaggaggggcucaagcggggcgagaucacccaccacgcggugagccgcggcuccgccaagcugcagugguucgucgagcggaacauggugaucccggaggggcgcgugaucgaccugggcugcgggcggggcggguggagcuacuacugcgccggccucaagaaggucaccgaggugcgcggcuacaccaagggcgggcccgggcacgaggagcccgugcccauguccacguacggcuggaacaucgucaagcugaugagcgggaaggacguguucuaccugccgcccgagaagugcgacacccuccugugcgacaucggcgaguccagccccucccccaccguggaggagagccggaccauccgcguccugaagaugguggagccguggcugaagaacaaccaguucugcaucaaggugcucaaccccuacaugcccacggucaucgagcaccuggagcgccugcagcggaagcacggcgggaugcucgugcgcaacccccugucccggaacagcacccacgagauguacuggaucuccaacggcaccgggaacaucguggccagcgucaacauggugucccgccugcuccugaaccgguucaccaugacgcaccgccggccgaccaucgagaaggacguggaccugggcgccggcacccgccacgucaacgcggagcccgagacccccaacauggacgugaucggggagcggaucaagcgcaucaaggaggagcacaacagcacguggcacuacgacgacgagaacccguacaagaccugggccuaccacggcuccuacgaggucaaggccaccgggagcgccuccagcaugaucaacggcguggugaagcuccugaccaagcccugggacgucgugcccauggugacgcagauggccaugaccgacaccacccccuucgggcagcagcgggucuucaaggagaagguggacacgcgcaccccgcggagcaugcccggcacccgccgggugaugggcaucaccgcggaguggcuguggcgcacgcucgggcggaacaagaagccccgccugugcacccgggaggaguucaccaagaagguccgcaccaacgccgccaugggcgccguguucacggaggagaaccagugggacuccgcgaaggccgccguggaggacgaggacuucuggauccuggucgaccgcgagcgggagcuccacaagcuggggaagugcggcagcugcguguacaacaugauggggaagcgcgagaagaagcugggcgaguucggcaaggccaaggggucccgggccaucugguacauguggcucggcgcgcgcuaccuggaguucgaggcccugggguuccucaacgaggaccacugguucagccgggagaacuccuacagcggcguggagggggagggccugcacaagcugggcuacauccuccgcgacaucuccaagauccccgggggcgccauguacgccgacgacaccgccgggugggacacccggaucaccgaggacgaccugcacaacgaggagaagaucacgcagcagauggacccggagcaccgccagcuggcgaacgccaucuucaagcucaccuaccagaacaaggucgugaaggugcagcggcccacccccaccggcaccgucauggacaucaucagccgcaaggaccagcggggcuccggccaggugggcacguacgggcugaacaccuucaccaacauggaggcccagcugauccgccagauggagggcgagggggugcucagcaaggccgaccuggagaacccccaccuccccgagaagaagaucacccaguggcuggagacgaagggcgucgagcggcugaagcgcauggccaucuccggcgacgacugcguggugaagcccaucgacgaccgguucgcgaacgcccugcucgcccugaacgacauggggaagguccgcaaggacaucccccaguggcagcccagcaagggcuggcacgacuggcagcaggucccguucugcucccaccacuuccacgagcugaucaugaaggacgggcggaagcucgugguccccugccgcccccaggacgagcugaucggccgggcccgcaucagccagggggccggcuggucccugcgggagaccgcgugccucggcaaggccuacgcccagauguggagccugauguacuuccaccgccgcgaccugcggcucgccuccaacgcgaucugcagcgccgugcccgugcacugggucccgaccucccgcaccacguggagcauccacgcccaccaccaguggaugaccaccgaggacaugcugaccguguggaaccggguguggaucgaggacaaccccuggauggaggacaagacgcccgucaccaccugggagaacgugcccuaccuggggaagcgcgaggaccaguggugcggcagccucaucgggcugaccucccgggccacgugggcccagaacaucccgaccgcgauccagcagguccgcagccugaucggcaacgaggaguuccucgacuacaugcccuccaugaagcgguuccgcaaggaggaggagagcgagggggccaucugguga

SEQ ID NO: 10113 - RNA, 9873 nt, Artificial Sequence
  derived and/or modified CDS sequence (opt1) from DENV-3__KF955466__SS-prME
accagccugugccucaugaugauccugcccgcggcgcuggcguuccaccucaccagccgggacggcgagccccggaugaucguggggaagaacgagcgcggcaagagccugcuguucaagacggccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgugaucgggaucaucacccucuaccugggcgccgucgugcaggccgacauggggugcgugaucaacuggaagggcaaggagcugaagugcggcagcgggaucuucgucacgaacgaggugcacaccuggaccgagcaguacaaguuccaggccgacucccccaagcgccucgcgaccgccaucgccggcgccugggagaacggggugugcggcauccgcagcacgacccggauggagaaccugcuguggaagcagaucgccaacgagcucaacuacauccugugggagaacaacaucaagcugaccgucguggugggggacaucaucggcguccucgagcagggcaagcgcacccugacgccccagccgauggagcugaaguacuccuggaagaccugggggaaggcgaagaucgugaccgccgagacccagaacagcuccuucaucaucgacggccccaacacgcccgagugccccagcgccucccgggccuggaacgugugggaggucgaggacuacggguucggcguguucaccaccaacaucuggcucaagcugcgcgagguguacacccagcugugcgaccaccggcucaugagcgcggccgucaaggacgagcgcgccgugcacgccgacaugggcuacuggaucgagagccagaagaacggguccuggaagcuggagaaggccagccugaucgaggugaagaccugcacguggccgaagucccacacccucuggagcaacggcguccuggaguccgacaugaucauccccaagagccuggcggggcccaucucccagcacaacuaccggccgggcuaccacacccagaccgccgggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaaggucgacaacuucacgaugggcgugcugugccucgccauccuguucgaggaggugaugcgggggaaguucggcaagaagcacaugaucgccggggucuucuucaccuucgugcugcuccuguccggccagaucaccuggcgcgacauggcgcacacccugaucaugaucggcagcaacgccuccgaccggauggggaugggcgugacguaccucgcccugaucgccaccuucaagauccagcccuuccuggcccucggguucuuccugcgcaagcugaccagccgggagaaccuccugcugggcgucggccucgcgauggccaccacgcugcagcugcccgaggacaucgagcagauggccaacgggaucgcccucggccugauggcgcugaagcucaucacccaguucgagaccuaccagcuguggaccgcccugaucagccucacgugcuccaacaccaucuucacccugaccguggccuggcgcacggccacccugauccucgccggggucagccugcugccggugugccaguccagcuccaugcggaagaccgacuggcuccccaugaccguggcggccaugggcgugccgccccucccgcuguucaucuucagccucaaggacacgcugaagcgccgcuccuggccccugaacgagggggugauggccgugggccucgucagcauccuggccuccagccugcuccggaacgacgugcccauggccggcccccugguggccggcgggcugcucaucgccugcuacgucaucaccgggaccuccgccgaccugaccguggagaaggccgccgacgugacgugggaggaggaggcggagcagaccggggucagccacaaccugaugaucaccguggacgacgacgggaccaugcgcaucaaggacgacgagaccgagaacauccucacggugcugcugaagaccgcccuccugaucgucuccggcaucuucccguacagcauccccgccacccugcucguguggcacaccuggcagaagcagacgcagcgguccggcgugcugugggacguccccagcccgcccgagacccagaaggccgagcuggaggaggggguguaccgcaucaagcagcagggcaucuucgggaagacccaggugggcgucggggugcagaaggagggcguguuccacaccauguggcacgucacgcggggcgccgugcucaccuacaacgggaagcgccuggagcccaacugggcguccgugaagaaggaccugaucagcuacggcgggggcuggcggcucuccgcccaguggcagaagggggaggagguccaggugaucgccguggagcccggcaagaaccccaagaacuuccagaccaugcccggcaccuuccagacgaccaccggggagaucggcgccaucgcgcuggacuucaagcccgggaccagcggcagccccaucaucaaccgcgagggcaaggucguggggcuguacggcaacgggguggucacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggccaucaagcgccggcuccgcacccugauccuggcgcccacccgggucguggccgccgagauggaggaggcccucaaggggcugcccauccgcuaccagaccacggccaccaaguccgagcacaccggccgggagaucguggaccugaugugccacgcgaccuucacgaugcgccuccugagccccguccgggugccgaacuacaaccugaucaucauggacgaggcccacuucaccgaccccgccuccaucgccgcccgcggguacaucagcacccgggugggcaugggcgaggcggccgccaucuucaugaccgccacgccgcccgggaccgcggacgccuucccgcaguccaacgcccccauccaggacgaggagcgcgacauccccgagcgcagcuggaacuccggcaacgaguggaucaccgacuucgccgggaagaccgucugguucgugcccagcaucaaggccggcaacgacaucgcgaacugccuccggaagaacgggaagaaggugauccagcugucccgcaagacguucgacaccgaguaccagaagaccaagcugaacgacugggacuucgucgugaccacggacaucagcgagaugggcgccaacuucaaggccgaccgggugaucgacccgcgccggugccucaagcccgucauccugaccgacggccccgagcgcgugauccuggccgggcccaugccggugaccgccgcguccgccgcccagcggcgcggccgggucgggcgcaacccccagaaggagaacgaccaguacaucuucaccggccagccccucaacaacgacgaggaccacgcccacuggaccgaggccaagaugcugcuggacaacaucaacacgcccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcccacaagguggcgagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgccggccgcaagagcaucgcgcuggaccuggucaccgagaucgggcgggugcccucccaccucgcccaccgcacccggaacgcccuggacaaccuggugaugcuccacaccagcgagcacggcgggaaggccuaccgccacgccgucgaggagcugcccgagacgauggagacccugcuccugcugggccucaugauccugcugaccgggggcgcgaugcuguuccugaucagcggcaaggggaucggcaagaccuccaucgggcugaucugcgugaucgccagcuccggcaugcucuggauggccgagaucccgcugcaguggaucgccagcgccaucgugcuggaguucuucaugaugguccuccugauccccgagcccgagaagcagcggacgccccaggacaaccagcuggcguacguggugaucgggauccucacccuggccgccaucaucgccgccaacgagaugggccugcucgagaccaccaagcgcgaccugggcauguccaaggagccgggggucgugagccccacguccuaccuggacguggaccuccaccccgcgagcgccuggacccuguacgccgucgccaccaccgugaucacgcccaugcugcggcacaccaucgagaacuccaccgcgaacgugagccucgccgccaucgccaaccaggccgucgugcugaugggccuggacaagggguggccgaucuccaagauggaccucggcgugccccugcuggcgcucgggugcuacagccaggucaacccccugacccugacggccgccgugcuccugcugaucacccacuacgccaucaucggccccggccuccaggccaaggcgacccgcgaggcccagaagcggaccgccgccgggaucaugaagaacccgacgguggacggcaucaugaccaucgaccuggaccccgucaucuacgacuccaaguucgagaagcagcugggccaggugaugcuccuggugcugugcgccguccagcuccugcugaugcgcaccagcugggcgcucugcgaggcccugacccuggccacgggccccaucaccacccucugggagggcucccccgggaaguucuggaacaccacgaucgccgugagcauggcgaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggaguucgaccucuacaagaaguccggcaucaccgaggucgaccgcacggaggccaaggaggggcugaagcggggcgagaucacccaccacgcggugagccgcggcuccgccaagcugcagugguucguggagcggaacauggucaucccggaggggcgcgugaucgaccucggcugcgggcggggcggguggagcuacuacugcgccggccugaagaaggugaccgagguccgcggcuacaccaagggcgggcccgggcacgaggagcccgugcccauguccacguacggcuggaacaucgugaagcugaugagcgggaaggacgucuucuaccucccgcccgagaagugcgacacccugcugugcgacaucggcgaguccagccccucccccaccguggaggagagccggaccauccgcgugcugaagauggucgagccguggcucaagaacaaccaguucugcaucaaggugcugaaccccuacaugcccacggugaucgagcaccuggagcgccuccagcggaagcacggcgggaugcugguccgcaacccccugucccggaacagcacccacgagauguacuggaucuccaacggcaccgggaacaucguggccagcgugaacauggucucccgccuccugcugaaccgguucaccaugacgcaccgccggccgaccaucgagaaggacguggaccucggcgccggcacccgccacgugaacgcggagcccgagacccccaacauggacgucaucggggagcggaucaagcgcaucaaggaggagcacaacagcacguggcacuacgacgacgagaacccguacaagaccugggccuaccacggcuccuacgaggugaaggccaccgggagcgccuccagcaugaucaacggcgucgugaagcugcugaccaagcccugggacgugguccccauggugacgcagauggccaugaccgacaccacccccuucgggcagcagcggguguucaaggagaaggucgacacgcgcaccccgcggagcaugcccggcacccgccgggugaugggcaucaccgcggaguggcucuggcgcacgcuggggcggaacaagaagccccgccugugcacccgggaggaguucaccaagaaggugcgcaccaacgccgccaugggcgccgucuucacggaggagaaccagugggacuccgcgaaggccgccguggaggacgaggacuucuggaugcucguggaccgcgagcgggagcugcacaagcuggggaagugcggcagcugcgucuacaacaugauggggaagcgcgagaagaagcucggcgaguucggcaaggccaaggggucccgggccaucugguacauguggcugggcgcgcgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgccgacgacaccgccgggugggacacccggaucaccgaggacgaccugcacaacgaggagaagaucacgcagcagauggacccggagcaccgccagcucgcgaacgccaucuucaagcugaccuaccagaacaagguggucaaggugcagcggcccacccccaccggcaccgugauggacaucaucagccgcaaggaccagcggggcuccgggcaggucggcacguacgggcugaacaccuucaccaacauggaggcccagcucauccgccagauggagggcgagggggugcugagcaaggccgaccuggagaacccccaccucccggagaagaagaucacccaguggcuggagacgaagggcguggagcggcugaagcgcauggccaucuccggcgacgacugcgucgugaagcccaucgacgaccgguucgcgaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcugguggugcccugccgcccccaggacgagcugaucggccgggcccgcaucagccagggggccggcuggucccuccgggagaccgcgugccugggcaaggccuacgcccagauguggagccugauguacuuccaccgccgcgaccuccggcuggccuccaacgcgaucugcagcgccguccccgugcacugggugccgaccucccgcaccacguggagcauccacgcccaccaccaguggaugaccaccgaggacaugcugaccgucuggaaccggguguggaucgaggacaaccccuggauggaggacaagacgcccgugaccaccugggagaacguccccuaccucgggaagcgcgaggaccaguggugcggcagccugaucgggcugaccucccgggccacgugggcccagaacaucccgaccgcgauccagcagguccgcagccucaucggcaacgaggaguuccuggacuacaugcccuccaugaagcgguuccgcaaggaggaggagagcgagggggccaucugguga

SEQ ID NO: 10114 - RNA, 9873 nt, Artificial Sequence
  derived and/or modified CDS sequence (opt1) from DENV-3__KF955468__SS-prME
accagccugugccucaugaugauccugcccgcggcccuggcguuccaccucaccagccgggacggcgagccgcggaugaucguggggaagaacgagcgcggcaagagccugcuguucaagacggccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgugaucgggaucaucacccucuaccugggcgccgucgugcaggccgacauggggugcgugaucaacuggaagggcaaggagcugaagugcggcagcgggaucuucgucacgaacgaggugcacaccuggaccgagcaguacaaguuccaggccgacucccccaagcgccucgcgaccgccaucgccggcgccugggagaacggggugugcggcauccgcagcacgacccggauggagaaccugcuguggaagcagaucgccaacgagcucaacuacauccugugggagaacaacaucaagcugaccgucguggugggggacaucaucggcguccucgagcagggcaagcgcacccugacgccccagccgauggagcugaaguacuccuggaagaccugggggaaggcgaagaucgugaccgccgagacccagaacagcuccuucaucaucgacggccccaacacgcccgagugccccagcgccucccgggccuggaacgugugggaggucgaggacuacggguucggcguguucaccaccaacaucuggcucaagcugcgcgagguguacacccagcugugcgaccaccggcucaugagcgcggccgucaaggacgagcgcgccgugcacgccgacaugggcuacuggaucgagagccagaagaacggguccuggaagcuggagaaggccagccugaucgaggugaagaccugcacguggccgaagucccacacccucuggagcaacggcguccuggaguccgacaugaucauccccaagagccuggcggggcccaucucccagcacaacuaccggccgggcuaccacacccagaccgccgggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaaggucgacaacuucacgaugggcgugcugugccucgccauccuguucgaggaggugaugcgggggaaguucggcaagaagcacaugaucgccggggucuucuucaccuucgugcugcuccuguccggccagaucaccuggcgcgacauggcgcacacccugaucaugaucggcagcaacgccuccgaccggauggggaugggcgugacguaccucgcccugaucgccaccuucaagauccagcccuuccuggcccucggguucuuccugcgcaagcugaccagccgggagaaccuccugcugggcgucggccucgcgauggccaccacgcugcagcugcccgaggacaucgagcagauggccaacgggaucgcccucggccugauggcgcugaagcucaucacccaguucgagaccuaccagcuguggaccgcccugaucagccucacgugcuccaacaccauccugacccugaccguggccuggcgcacggccacccucauccuggccggggucagccugcucccggugugccaguccagcuccaugcggaagaccgacuggcugcccaugaccguggcggccaugggcgugccgccccugccccuguucaucuucagccugaaggacacgcugaagcgccgcuccuggccccucaacgagggggugauggccgugggccuggucagcauccuggccuccagccuccugcggaacgacgugcccauggccggcccccugguggccggcgggcuccugaucgccugcuacgucaucaccgggaccuccgccgaccugaccguggagaaggccgccgacgugacgugggaggaggaggcggagcagaccggggucagccacaaccucaugaucaccguggacgacgacgggaccaugcgcaucaaggacgacgagaccgagaacauccugacggugcugcucaagaccgcccugcugaucgucuccggcaucuucccguacagcauccccgccacccuccugguguggcacaccuggcagaagcagacgcagcgguccggcgugcugugggacguccccagcccgcccgagacccagaaggccgagcucgaggaggggguguaccgcaucaagcagcagggcaucuucgggaagacccaggugggcgucggggugcagaaggagggcguguuccacaccauguggcacgucacgcggggcgccgugcugaccuacaacgggaagcgccuggagcccaacugggcguccgugaagaaggaccucaucagcuacggcgggggcuggcggcuguccgcccaguggcagaagggggaggagguccaggugaucgccguggagcccggcaagaaccccaagaacuuccagaccaugcccggcaccuuccagacgaccaccggggagaucggcgccaucgcgcuggacuucaagcccgggaccagcggcagccccaucaucaaccgcgagggccgggucguggggcuguacggcaacgggguggucacgaagaacggcggguacguguccggcaucgcccagaccaacgccgagccggacggccccacccccgagcucgaggaggagauguucaagaagcgcaaccugaccaucauggaccugcaccccgggagcggcaagacgcggaaguaccucccggccaucgugcgcgaggccaucaagcggcgccugcggacccugauccucgcgcccacccgcgucguggccgccgagauggaggaggcccugaaggggcugcccauccgguaccagaccacggccaccaaguccgagcacaccggccgcgagaucguggaccucaugugccacgcgaccuucacgaugcggcugcugagccccguccgcgugccgaacuacaaccucaucaucauggacgaggcccacuucaccgaccccgccuccaucgccgcccggggguacaucagcacccgcgugggcaugggcgaggcggccgccaucuucaugaccgccacgccgcccgggaccgcggacgccuucccgcaguccaacgcccccauccaggacgaggagcgcgacauccccgagcggagcuggaacuccggcaacgaguggaucaccgacuucgccgggaagaccgucugguucgugcccagcaucaaggccggcaacgacaucgcgaacugccugcgcaagaacgggaagaaggugauccagcugucccggaagacguucgacaccgaguaccagaagaccaagcucaacgacugggacuucgucgugaccacggacaucagcgagaugggcgccaacuucaaggccgaccgcgugaucgacccgcggcgcugccugaagcccgucauccugaccgacggccccgagcgggugauccucgccgggcccaugccggugaccgccgcguccgccgcccagcgccggggccgcgucgggcggaacccccagaaggagaacgaccaguacaucuucaccggccagccccugaacaacgacgaggaccacgcccacuggaccgaggccaagaugcugcucgacaacaucaacacgcccgaggggaucaucccggcgcuguucgagcccgagcgcgagaaguccgccgccaucgacggcgaguaccggcugaagggcgagucccgcaagaccuucguggagcucaugcggcgcggggaccugcccgucuggcuggcccacaagguggcgagcgagggcaucaaguacaccgaccggaaguggugcuucgacgggcagcgcaacaaccagauccucgaggagaacauggacguggagaucuggaccaaggagggcgagaagaagaagcugcggccccgcuggcuggacgcccgcacguacuccgacccgcucgcccugaaggaguucaaggacuucgccgccggccgcaagagcaucgcgcuggaccucgucaccgagaucgggcgcgugcccucccaccuggcccaccggacccgcaacgcccuggacaaccucgugaugcugcacaccagcgagcacggcgggaaggccuaccggcacgccgucgaggagcugcccgagacgauggagacccuccugcugcucggccugaugauccugcucaccgggggcgcgaugcuguuccugaucagcggcaaggggaucggcaagaccuccaucgggcucaucugcgugaucgccagcuccggcaugcuguggauggccgagaucccgcugcaguggaucgccagcgccaucgugcucgaguucuucaugaugguccugcugauccccgagcccgagaagcagcgcacgccccaggacaaccagcucgcguacguggugaucgggauccugacccuggccgccaucaucgccgccaacgagaugggccuccuggagaccaccaagcgggaccugggcauguccaaggagccgggggucgugagccccacguccuaccucgacguggaccugcaccccgcgagcgccuggacccuguacgccgucgccaccaccgugaucacgcccaugcuccgccacaccaucgagaacuccaccgcgaacgugagccuggccgccaucgccaaccaggccgucgugcugaugggccucgacaagggguggccgaucuccaagauggaccugggcgugccccugcucgcgcuggggugcuacagccaggucaacccccugacccucacggccgccgugcugcugcucaucacccacuacgccaucaucggccccggccugcaggccaaggcgacccgggaggcccagaagcgcaccgccgccgggaucaugaagaacccgacgguggacggcaucaugaccaucgaccuggaccccgucaucuacgacuccaaguucgagaagcagcucggccaggugaugcugcuggugcucugcgccguccagcugcugcucaugcggaccagcugggcgcugugcgaggcccugacccucgccacgggccccaucaccacccugugggagggcucccccgggaaguucuggaacaccacgaucgccgugagcauggcgaacaucuuccgcggcuccuaccuggccggggccggccucgccuucagcaucaugaaguccguggggaccggcaagcggggcaccgggagccagggcgagacccugggggagaaguggaagaagaagcugaaccagcucagccgcaaggaguucgaccuguacaagaaguccggcaucaccgaggucgaccggacggaggccaaggaggggcugaagcgcggcgagaucacccaccacgcggugagccggggcuccgccaagcuccagugguucguggagcgcaacauggucaucccggaggggcgggugaucgaccugggcugcgggcgcggcggguggagcuacuacugcgccggccugaagaaggugaccgagguccggggcuacaccaagggcgggcccgggcacgaggagcccgugcccauguccacguacggcuggaacaucgugaagcucaugagcgggaaggacgucuucuaccugccgcccgagaagugcgacacccugcugugcgacaucggcgaguccagccccucccccaccguggaggagagccgcaccauccgcgugcucaagauggucgagccguggcugaagaacaaccaguucugcaucaaggugcugaaccccuacaugcccacggugaucgagcaccucgagcggcugcagcgcaagcacggcgggaugcugguccggaacccccucucccgcaacagcacccacgagauguacuggaucuccaacggcaccgggaacaucguggccagcgugaacauggucucccggcugcugcucaaccgcuucaccaugacgcaccggcgcccgaccaucgagaaggacguggaccugggcgccggcacccggcacgugaacgcggagcccgagacccccaacauggacgucaucggggagcgcaucaagcggaucaaggaggagcacaacagcacguggcacuacgacgacgagaacccguacaagaccugggccuaccacggcuccuacgaggugaaggccaccgggagcgccuccagcaugaucaacggcgucgugaagcugcucaccaagcccugggacgugguccccauggugacgcagauggccaugaccgacaccacccccuucgggcagcagcgcguguucaaggagaaggucgacacgcggaccccgcgcagcaugcccggcacccggcgcgugaugggcaucaccgcggaguggcuguggcggacgcuggggcgcaacaagaagccccggcucugcacccgcgaggaguucaccaagaaggugcgcaccaacgccgccaugggcgccgucuucacggaggagaaccagugggacuccgcgaaggccgccguggaggacgaggacuucuggacccugguggaccgggagcgcgagcugcacaagcucgggaagugcggcagcugcgucuacaacaugauggggaagcgggagaagaagcugggcgaguucggcaaggccaaggggucccgcgccaucugguacauguggcugggcgcgcgguaccucgaguucgaggcccugggguuccugaacgaggaccacugguucagccgcgagaacuccuacagcggcguggagggggagggccuccacaagcugggcuacauccugcgggacaucuccaagauccccgggggcgccauguacgccgacgacaccgccgggugggacacccgcaucacggaggacgaccuccacaacgaggagaagaucacccagcagauggacccggagcaccggcagcuggcgaacgccaucuucaagcugaccuaccagaacaagguggucaaggugcagcgccccacccccaccggcacggugauggacaucaucagccggaaggaccagcgcggcuccgggcaggucggcaccuacgggcucaacaccuucaccaacauggaggcccagcugauccggcagauggagggcgagggggugcugagcaaggccgaccucgagaacccccaccucccggagaagaagaucacgcaguggcuggagaccaagggcguggagcgccucaagcggauggccaucuccggcgacgacugcgucgugaagcccaucgacgaccgcuucgcgaacgcccugcuggcccucaacgacauggggaaggugcggaaggacaucccccaguggcagcccagcaagggcuggcacgacuggcagcaggucccguucugcucccaccacuuccacgagcugaucaugaaggacgggcgcaagcugguggugcccugccggccccaggacgagcucaucggccgcgcccggaucagccagggggccggcuggucccugcgcgagaccgcgugccugggcaaggccuacgcccagauguggagccucauguacuuccaccgccgggaccugcgccuggccuccaacgcgaucugcagcgccguccccgugcacugggugccgaccucccggacgaccuggagcauccacgcccaccaccaguggaugaccaccgaggacaugcucacggucuggaaccgcguguggaucgaggacaaccccuggauggaggacaagacccccgugaccaccugggagaacguccccuaccuggggaagcgggaggaccaguggugcggcagccugaucgggcucacgucccgcgccaccugggcccagaacaucccgaccgcgauccagcagguccggagccugaucggcaacgaggaguuccuggacuacaugcccuccaugaagcgcuuccggaaggaggaggagagcgagggggccaucugguga

SEQ ID NO: 10115 - RNA, 9873 nt, Artificial Sequence
  derived and/or modified CDS sequence (opt1) from DENV-3__FJ744726__SS-prME
accagccugugccucaugaugaugcugcccgccacccuggccuuccaccucaccagccgggacggcgagccgcggaugaucguggccaagaacgagcggggcaagagccugcuguucaagaccgccuccggcaucaacaugugcacccucaucgccauggaccugggggagaugugcgacgacaccgugaccuacaagugcccccugaucgccgagguggagcccgaggacaucgacugcuggugcaaccucaccagcaccugggugaccuacggcacgugcaaccaggccggggagcaccggcgcgacaagcgguccgucgcgcuggcgccccacgugggcaugggccuggacacccggacccagaccuggaugagcgccgagggggccuggcgccagguggagaagguggagacgugggcgcuccggcacccgggcuucaccauccuggcccuguuccucgcccacuacaucgggaccucccugacccagaagguggugaucuucauccugcucaugcuggugacgcccagcaugaccaugcggugcgugggcguggggaaccgggacuucgucgagggccuguccggcgccaccuggguggacgugguccucgagcacgggggcugcgugaccacgauggccaagaacaagcccacccuggacaucgagcugcagaagaccgaggcgacccagcucgccacgcugcggaagcugugcaucgaggggaagaucaccaacaucaccaccgacagccgcugccccacgcagggcgaggccauccucccggaggagcaggaccagaacuacgugugcaagcacaccuacgucgaccggggcugggggaacggcugcgggcuguucggcaaggggucccuggugaccugcgccaaguuccagugccucgagcccaucgagggcaaggugguccagcacgagaaccugaaguacaccgugaucaucacggugcacaccggcgaccagcaccaggucgggaacgacacccagggcgugaccgucgagaucacgccccaggccagcaccguggaggcgauccugcccgaguacgggacccucggccuggagugcuccccgcgcaccgggcuggacuucaacgagaugauccuccugaccaugaagaacaaggccuggauggugcaccggcagugguucuucgaccugccccuccccuggacgagcggcgccaccaccgagacccccacguggaaccgcaaggagcugcuggucaccuucaagaacgcccacgccaagaagcaggagguggugguccucggcucccaggagggggcgaugcacaccgcccugaccggcgccacggagauccagaacagcgggggcaccuccaucuucgccgggcaccugaagugccggcucaagauggacaagcuggagcugaagggcaugagcuacgccaugugccucaacaccuucgugcugaagaaggagguguccgagacccagcacggcacgauccugaucaaggucgaguacaagggggaggacgcgccgugcaagauccccuucagcaccgaggacggccaggggaaggcccacaacggccgccugaucaccgccaaccccguggugaccaagaaggaggagcccgucaacaucgaggccgagccgcccuucggcgagagcaacaucgugaucgggaucggcgacaaggcgcucaagaucaacugguacaagaagggguccagcaucggcaagauguucgaggccacggcccgcggggcccgccggauggccauccugggcgacaccgcgugggacuucggcuccgucggcgggguccugaacagccucgggaagauggugcaccagaucuucggguccgccuacaccgcccuguucagcgggguguccuggaucaugaagaucggcaucggcguccugcucaccuggaucgggcugaacagcaagaacacguccaugagcuucuccugcaucgugaucggcaucaucacccuguaccucggggccgugguccaggccgacaugggcugcgugaucaacuggaaggggaaggagcugaagugcggcagcggcaucuucgugaccaacgagguccacaccuggacggagcaguacaaguuccaggcggacucccccaagcgccuggccaccgccaucgccggggccugggagaacggcgugugcgggauccgcagcaccacccggauggagaaccuccuguggaagcagaucgcgaacgagcugaacuacauccucugggagaacaacaucaagcugacgguggucgugggcgacaucaucggggugcuggagcagggcaagcgcacccucacgccccagccgauggagcugaaguacuccuggaagaccuggggcaaggccaagaucgucacggccgagacccagaacagcuccuucaucaucgacgggcccaacacccccgagugccccagcgccucccgggcguggaacgugugggagguggaggacuacggcuucggggucuucaccacgaacaucuggcugaagcuccgcgagguguacacccagagcugcgaccaccggcugaugagcgccgccaucaaggacgagcgcgccgugcacgccgacaugggcuacuggaucgagucccagaagaacggcagcuggaagcuggagaaggcguccuucaucgaggucaagaccugcaccuggcccaagagccacacccucugguccaacggggugcuggagagcgacaugaucauccccaagucccuggccggccccaucagccagcacaaccaccggccgggguaccacacgcagaccgccggccccuggcaccucgggaagcuggagcuggacuucaacuacugcgagggcaccaccguggucaucacggagaacugcggcacccgcgggcccucccuccggaccaccacggugagcggcaagcugauccacgaguggugcugccgcuccugcacccugcccccgcuccgguacaugggggaggacggcugcugguacgggauggagauccgccccaucaacgagaaggaggagaacauggucaagagccuggucuccgccggcagcggcaagauggacaacuucaccauggggauccugugccucgccauccuguucgaggaggugaugcggggcaaguucgggaagaagcacaugaucgcgggcgugcuguucaccuucguccuccugcuguccgggcagaucacguggcgcgacauggcccacacccucaucaugaucggcagcaacgccuccgaccggaugggcaugggggugaccuaccuggcccugaucgccaccuucaagauccagcccuuccucgcgcugggcuucuuccugcgcaagcucacgagccgggagaaccugcugcucggggugggccuggccauggccaccacccugcagcuccccgaggacaucgagcagauggccaacggcaucgcgcuggggcugaugacccucaagcugaucacgcaguucgagaccuaccagcuguggaccgcccucgucagccugaccugcuccaacacgaucuucacccugaccguggccuggcgcaccgccacgcucauccuggccggcgugagccugcucccgcugugccaguccagcuccaugcggaagaccgacuggcugcccaugaccgucgcggccaugggggugccgccccugccgcuguucaucuucagccugaaggacacccccaagcgccgcuccuggccccucaacgagggcgucauggccguggggcuggugagcauccuggccuccagccuccugcggaacgacguccccauggccggcccgcugguggcgggcgggcuccugaucgccugcuacgugaucacgggcaccuccgccgaccugaccgucgagaaggccgccgacgugaccugggaggaggaggcggagcagacgggggugagccacaaccucaugaucaccgucgacgacgacggcaccaugcgcaucaaggacgacgagaccgagaacauccugaccgugcugcucaagacggcccugcugaucguguccgggaucuuccccuacagcauccccgccacccuccuggucuggcacaccuggcagaagcagacccagcgguccggcgugcugugggacgugcccagcccgcccgagacgcagaaggccgagcucgaggagggcgucuaccgcaucaagcagcaggggaucuucggcaagacccaggugggggugggcguccagaaggaggggguguuccacaccauguggcacgugacccggggcgccguccugacgcacaacggcaagcgccuggagcccaacugggcguccgugaagaaggaccucaucagcuacgggggcggguggcggcuguccgcccaguggcagaagggcgaggaggugcaggucaucgccguggagcccgggaagaacccgaagaacuuccagaccaugcccggcaucuuccagaccaccacgggcgagaucggggccaucgcgcuggacuucaagcccggcaccagcgggagcccgaucaucaaccgcgagggcaagguggucggccuguacgggaacggcguggugaccaagaacgggggcuacgucuccgggaucgcccagaccaacgccgagcccgacggccccacgcccgagcucgaggaggagauguucaagaagcggaaccugaccaucauggaccugcacccgggcagcgggaagacccgcaaguaccuccccgccaucgugcgggaggccaucaagcgccggcugcgcacccugauccucgcgcccacgcggguggucgccgccgagauggaggaggcccugaagggccugcccauccgcuaccagaccaccgccaucaaguccgagcacaccgggcgggagaucguggaccucaugugccacgcgacguucaccaugcgccugcugagcccggugcggguccccaacuacaaccucaucaucauggacgaggcccacuucaccgaccccgccuccaucgccgcccgcggcuacaucagcacccggguggggaugggcgaggcggccgccaucuucaugacggccacgccgcccggcaccgcggaggccuucccccaguccaacgcccccauccaggacgaggagaaggacauccccgagcgcagcuggaacuccgggaacgaguggaucaccgacuucgugggcaagacggucugguucgugcccagcaucaaggccgggaacgacaucgccaacugccugcgcaagaacggcaagaaggugauccagcugucccggaagaccuucgacaccgaguaccagaagacccgccucaacgacugggacuucgucgugacgaccgacaucagcgagaugggggcgaacuucaaggccgaccgggugaucgacccccgccggugccugaagcccgucauccugaccgacggccccgagcgcgugauccucgccggcccgaugcccgugaccgccgccuccgcggcccagcggcgcgggcgggucggccgcaacccccagaaggagaacgaccaguacaucuucacggggcagccccugaacaacgacgaggaccacgcccacuggaccgaggccaagaugcugcucgacaacaucaacaccccggagggcaucauccccgcccuguucgagcccgagcgggagaaguccgcggccaucgacggggaguaccgccugaagggcgagucccggaagaccuucguggagcucaugcgccggggcgaccugcccguguggcuggcccacaaggucgccagcgaggggaucaaguacaccgaccgcaaguggugcuucgacggcgagcggaacaaccagauccucgaggagaacauggacguggagaucuggacgaaggagggggagcgcaagaagcugcggccgcgcuggcuggacgcgcgcaccuacuccgacccccucgcccugaaggaguucaaggacuucgccgccggccgcaagagcaucgcccuggaccucgucaccgagaucggccgcgugcccucccaccuggcgcaccggacccgcaacgcccuggacaaccucgugaugcugcacacgagcgagcacgggggccgggccuaccgccacgccgucgaggagcugccggagaccauggagacccuccugcugcucgggcugaugauccugcucaccggcggggccaugcuguuccugaucagcggcaagggcaucgggaagacguccaucggccucaucugcgugaucgugagcuccgggaugcuguggauggcggacgucccccugcaguggaucgccagcgccaucgugcucgaguucuucaugauggugcugcugauccccgagcccgagaagcagcggaccccgcaggacaaccagcucgccuacgucgugaucggcauccugacccuggccgcgaucgugaccgccaacgagauggggcuccuggagacgaccaagcgcgaccugggcauguccaaggagcccggcgucgugagccccaccuccuaccucgacguggaccugcaccccgccagcgccuggacccuguacgccgucgcgacgaccgugaucaccccgaugcuccggcacaccaucgagaacuccacggccaacgugagccuggccgccaucgcgaaccaggccgucgugcugauggggcucgacaagggcuggcccaucuccaagauggaccugggggugccccugcucgcccugggcugcuacagccaggucaacccccugacccucaccgccgccgugcugcugcucgugacccacuacgcgaucaucgggccgggccugcaggccaaggccacgcgcgaggcccagaagcggaccgccgcgggcaucaugaagaaccccaccgucgacgggaucaugaccaucgaccuggaccccgugaucuacgacuccaaguucgagaagcagcucggccaggugaugcugcugguccucugcgccgugcagcugcugcucaugcgcacgagcugggcccugugcgaggcccugacccucgccaccgggcccaucaccacgcugugggagggcuccccgggcaaguucuggaacaccaccaucgcggugagcauggccaacaucuuccggggguccuaccuggccggcgccgggcucgcguucagcaucaugaaguccgucggcaccgggaagcgcggcacgggcagccagggggagacccugggcgagaaguggaagaagaagcugaaccagcucagccggaaggaguucgaccuguacaagaaguccgggaucaccgagguggaccgcaccgaggccaaggagggccugaagcgcggggagaccacgcaccacgccgugagccgcggcuccgccaagcuccagugguucgucgagcggaacauggugauccccgagggccgcgugaucgaccuggggugcggccgcgggggcuggagcuacuacugcgccgggcugaagaaggucaccgaggugcgcggcuacaccaagggcgggcccggccacgaggagcccgugccgauguccaccuacggguggaacaucgucaagcucaugagcggcaaggacguguucuaccugccgcccgagaagugcgacacgcugcugugcgacaucggggaguccagccccuccccgaccguggaggagagccgcaccauccggguccucaagaugguggagcccuggcugaagaacaaccaguucugcaucaaggugcugaaccccuacaugcccaccgucaucgagcaccucgagcgccugcagcggaagcacggcggcaugcuggugcgcaacccgcucucccggaacagcacgcacgagauguacuggaucuccaacgggaccggcaacaucgugagcuccgucaacauggugagccgccugcugcucaaccgguucaccaugacccaccgccggcccacgaucgagaaggacguggaccugggggcgggcacccgccacgucaacgccgagcccgagaccccgaacauggacgugaucggcgagcggaucaagcgcaucaaggaggagcacuccagcaccuggcacuacgacgacgagaaccccuacaagacgugggccuaccacggguccuacgaggucaaggccaccggcagcgccagcuccaugaucaacgggguggugaagcugcucaccaagcccugggacgucgugcccauggugacccagauggcgaugacggacaccaccccguucggccagcagcgggucuucaaggagaagguggacacccgcacgccccggcccaugcccgggacccgcaaggugauggagaucaccgccgaguggcuguggcggacccugggccgcaacaagcggccgcgccucugcacgcgcgaggaguucaccaagaagguccggaccaacgccgccaugggcgccguguucaccgaggagaaccagugggacagcgcgcgcgccgccguggaggacgaggaguucuggaagcuggucgaccgggagcgcgagcugcacaagcucgggaagugcggcuccugcguguacaacaugauggggaagcgggagaagaagcugggcgaguucgggaaggccaagggcagccgcgcgaucugguacauguggcugggcgcccgguaccucgaguucgaggcccugggguuccugaacgaggaccacugguucucccgcgagaacagcuacuccggcguggagggggagggccuccacaagcugggguacauccugcgggacaucagcaagauccccggcggcgccauguacgccgacgacacggcggggugggacacccgcaucaccgaggacgaccuccacaacgaggagaagaucacccagcagauggaccccgagcaccggcagcuggccaacgccaucuucaagcugacguaccagaacaaggucgugaaggugcagcgccccaccccgaagggcaccgucauggacaucaucucccggaaggaccagcgcgggagcggccaggugggcaccuacgggcucaacaccuucacgaacauggaggcccagcuggugcggcagauggagggcgaggggguccuguccaagguggaccucgagaacccccaccuccuggagaagaagaucacccaguggcucgagaccaagggcguggagcgccugcggcgcauggccaucagcggggacgacugcgucgugaagcccaucgacgaccgguucgcgaacgcccugcucgcccugaacgacaugggcaaggugcgcaaggacaucccccaguggcagccguccaagggcuggcacgacuggcagcagguccccuucugcagccaccacuuccacgagcugaucaugaaggacgggcggaagcucguggugcccugccgcccccaggacgagcugaucggccgcgcccggaucucccagggggccggcuggagccugaaggagaccgcgugccucgggaaggccuacgcccagauguggucccugauguacuuccaccgccgggaccugcgccucgccagcaacgccaucugcuccgcggucccggugcacugggugcccacgagccggaccaccuggagcauccacgcccaccaccaguggaugaccacggaggacaugcugaccgucuggaaccgcguguggaucgaggacaaccccuggauggaggacaagacccccgugaccacgugggaggacgucccguaccugggcaagcgggaggaccaguggugcggcucccucaucgggcugaccagccgcgccaccugggcccagaacauccugaccgcgauccagcagguccggucccucaucggcgacgaggaguuccuggacuacaugcccagcaugaagcgcuuccggaaggaggaggaguccgagggggccaucugguga

SEQ ID NO: 10116 - RNA, 9873 nt, Artificial Sequence
  derived and/or modified CDS sequence (opt1) from DENV-3__FJ744729__SS-prME
accagccugugccucaugaugaugcugcccgccacccuggccuuccaccucaccagccgggacggcgagccgcggaugaucguggccaagaacgagcggggcaagagccugcuguucaagaccgccuccggcaucaacaugugcacccucaucgccauggaccugggggagaugugcgacgacaccgugaccuacaagugcccccugaucgccgagguggagcccgaggacaucgacugcuggugcaaccucaccagcaccugggugaccuacggcacgugcaaccaggccggggagcaccggcgcgacaagcgguccgucgcgcuggcgccccacgugggcaugggccuggacacccggacccagaccuggaugagcgccgagggggccuggcgccagguggagaagguggagacgugggcgcuccgccacccgggcuucaccauccuggcccuguuccucgcccacuacaucgggaccucccugacccagaagguggugaucuucauccugcucaugcuggugacgcccagcaugaccaugcggugcgugggcguggggaaccgcgacuucgucgagggccuguccggcgccaccuggguggacgugguccucgagcacgggggcugcgugaccacgauggccaagaacaagcccacccuggacaucgagcugcagaagaccgaggcgacccagcucgccacgcugcggaagcugugcaucgaggggaagaucaccaacaucaccaccgacagccgcugccccacgcagggcgaggccauccucccggaggagcaggaccagaacuacgugugcaagcacaccuacgucgaccggggcugggggaacggcugcgggcuguucggcaaggggucccuggugaccugcgccaaguuccagugccucaagcccaucgagggcaaggugguccagcacgagaaccugaaguacaccgugaucaucacggugcacaccggcgaccagcaccaggucgggaacgacacccagggcgugaccgucgagaucacgccccaggccagcaccguggaggcgauccugcccgaguacgggacccucggccuggagugcuccccgcgcaccgggcuggacuucaacgagaugauccuccugaccaugaagaacaaggccuggauggugcaccggcagugguucuucgaccugccccuccccuggacgagcggcgccaccaccgagacccccacguggaaccgcaaggagcugcuggucaccuucaagaacgcccacgccaagaagcaggagguggugguccucggcucccaggagggggcgaugcacaccgcccugaccggcgccacggagauccagaacagcgggggcaccuccaucuucgccgggcaccugaagugccggcucaagauggacaagcuggagcugaagggcaugagcuacgccaugugccucaacaccuucgugcugaagaaggagguguccgagacccagcacggcacgauccugaucaaggucgaguacaagggggaggacgcgccgugcaagauccccuucagcaccgaggacggccaggggaaggcccacaacggccgccugaucaccgccaaccccguggugaccaagaaggaggagcccgucaacaucgaggccgagccgcccuucggcgagagcaacaucgugaucgggaucggcgacaaggcgcucaagaucaacugguacaagaagggguccagcaucggcaagauguucgaggccacggcccgcggggcccgccggauggccauccugggcgacaccgcgugggacuucggcuccgucggcgggguccugaacagccucgggaagauggugcaccagaucuucggguccgccuacaccgcccuguucagcgggguguccuggaucaugaagaucggcaucggcguccugcucaccuggaucgggcugaacagcaagaacacguccaugagcuucuccugcaucgugaucggcaucaucacccuguaccucggggccgugguccaggccgacaugggcugcgugaucaacuggaaggggaaggagcugaagugcggcagcggcaucuucgugaccaacgagguccacaccuggacggagcaguacaaguuccaggcggacucccccaagcgccuggccaccgccaucgccggggccugggagaacggcgugugcgggauccgcagcaccacccggauggagaaccuccuguggaagcagaucgcgaacgagcugaacuacauccucugggagaacaacaucaagcugacgguggucgugggcgacaucaucggggugcuggagcagggcaagcgcacccucacgccccagccgauggagcugaaguacuccuggaagaccuggggcaaggccaagaucgucacggccgagacccagaacagcuccuucaucaucgacgggcccaacacccccgagugccccagcgccucccgggcguggaacgugugggagguggaggacuacggcuucggggucuucaccacgaacaucuggcugaagcuccgcgagguguacacccagagcugcgaccaccggcugaugagcgccgccaucaaggacgagcgcgccgugcacgccgacaugggcuacuggaucgagucccagaagaacggcagcuggaagcuggagaaggcguccuucaucgaggucaagaccugcaccuggcccaagagccacacccucugguccaacggggugcuggagagcgacaugaucauccccaagucccuggccggccccaucagccagcacaaccaccggccgggguaccacacgcagaccgccggccccuggcaccucgggaagcuggagcuggacuucaacuacugcgagggcaccaccguggucaucacggagaacugcggcacccgcgggcccucccuccggaccaccacggugagcggcaagcugauccacgaguggugcugccgcuccugcacccugcccccgcuccgguacaugggggaggacggcugcugguacgggauggagauccgccccaucaacgagaaggaggagaacauggucaagagccuggucuccgccggcagcggcaagauggacaacuucaccauggggauccugugccucgccauccuguucgaggaggugaugcggggcaaguucgggaagaagcacaugaucgcgggcgugcuguucaccuucguccuccugcuguccgggcagaucacguggcgcgacauggcccacacccucaucaugaucggcagcaacgccuccgaccggaugggcaugggggugaccuaccuggcccugaucgccaccuucaagauccagcccuuccucgcgcugggcuucuuccugcgcaagcucacgagccgggagaaccugcugcucggggugggccuggccauggccaccacccugcagcuccccgaggacaucgagcagauggccaacggcaucgcgcuggggcugaugacccucaagcugaucacgcaguucgagaccuaccagcuguggaccgcccucgucagccugaccugcuccaacacgaucuucacccugaccguggccuggcgcaccgccacgcucauccuggccggcgugagccugcucccgcugugccaguccagcuccaugcggaagaccgacuggcugcccaugaccgucgcggccaugggggugccgccccugccgcuguucaucuucagccugaaggacacccccaagcgccgcuccuggccccucaacgagggcgucauggccguggggcuggugagcauccuggccuccagccuccugcggaacgacguccccauggccggcccgcugguggcgggcgggcuccugaucgccugcuacgugaucacgggcaccuccgccgaccugaccgucgagaaggccgccgacgugaccugggaggaggaggcggagcagacgggggugagccacaaccucaugaucaccgucgacgacgacggcaccaugcgcaucaaggacgacgagaccgagaacauccugaccgugcugcucaagacggcccugcugaucguguccgggaucuuccccuacagcauccccgccacccuccuggucuggcacaccuggcagaagcagacccagcgguccggcgugcugugggacgugcccagcccgcccgagacgcagaaggccgagcucgaggagggcgucuaccgcaucaagcagcaggggaucuucggcaagacccaggugggggugggcguccagaaggaggggguguuccacaccauguggcacgugacccggggcgccguccugacgcacaacggcaagcgccuggagcccaacugggcguccgugaagaaggaccucaucagcuacgggggcggguggcggcuguccgcccaguggcagaagggcgaggaggugcaggucaucgccguggagcccgggaagaacccgaagaacuuccagaccaugcccggcaucuuccagaccaccacgggcgagaucggggccaucgcgcuggacuucaagcccggcaccagcgggagcccgaucaucaaccgcgagggcaagguggucggccuguacgggaacggcguggugaccaagaacgggggcuacgucuccgggaucgcccagaccaacgccgagcccgacggccccacgcccgagcucgaggaggagauguucaagaagcggaaccugaccaucauggaccugcacccgggcagcgggaagacccgcaaguaccuccccgccaucgugcgggaggccaucaagcgccggcugcgcacccugauccucgcgcccacgcggguggucgccgccgagauggaggaggcccugaagggccugcccauccgcuaccagaccaccgccaucaaguccgagcacaccgggcgggagaucguggaccucaugugccacgcgacguucaccaugcgccugcugagcccggugcggguccccaacuacaaccucaucaucauggacgaggcccacuucaccgaccccgccuccaucgccgcccgcggcuacaucagcacccggguggggaugggcgaggcggccgccaucuucaugacggccacgccgcccggcaccgcggaggccuucccccaguccaacgcccccauccaggacgaggagcgcgacauccccgagcgcagcuggaacuccgggaacgaguggaucaccgacuucgugggcaagacggucugguucgugcccagcaucaaggccgggaacgacaucgccaacugccugcggaagaacggcaagaaggugauccagcugucccgcaagaccuucgacaccgaguaccagaagacccggcucaacgacugggacuucgucgugacgaccgacaucagcgagaugggggcgaacuucaaggccgaccgcgugaucgacccccggcgcugccugaagcccgucauccugaccgacggccccgagcgggugauccucgccggcccgaugcccgugaccgccgccuccgcggcccagcgccgggggcgcgucggccggaacccccagaaggagaacgaccaguacaucuucacggggcagccccugaacaacgacgaggaccacgcccacuggaccgaggccaagaugcugcucgacaacaucaacaccccggagggcaucauccccgcccuguucgagcccgagcgcgagaaguccgcggccaucgacggggaguaccggcugaagggcgagucccgcaagaccuucguggagcucaugcggcgcggcgaccugcccguguggcuggcccacaaggucgccagcgaggggaucaaguacaccgaccggaaguggugcuucgacggcgagcgcaacaaccagauccucgaggagaacauggacguggagaucuggacgaaggagggggagcggaagaagcugcgcccgcgcuggcuggacgcgcggaccuacuccgacccccucgcccugaaggaguucaaggacuucgccgccggccgcaagagcaucgcccuggaccucgucaccgagaucggccgggugcccucccaccuggcgcaccgcacccggaacgcccuggacaaccucgugaugcugcacacgagcgagcacgggggccgcgccuaccggcacgccgucgaggagcugccggagaccauggagacccuccugcugcucgggcugaugauccugcucaccggcggggccaugcuguuccugaucagcggcaagggcaucgggaagacguccaucggccucaucugcgugaucgugagcuccgggaugcuguggauggcggacgucccccugcaguggaucgccagcgccaucgugcucgaguucuucaugauggugcugcugauccccgagcccgagaagcagcgcaccccgcaggacaaccagcucgccuacgucgugaucggcauccugacccuggccgcgaucgugaccgccaacgagauggggcuccuggagacgaccaagcgggaccugggcauguccaaggagcccggcgucgugagccccaccuccuaccucgacguggaccugcaccccgccagcgccuggacccuguacgccgucgcgacgaccgugaucaccccgaugcuccgccacaccaucgagaacuccacggccaacgugagccuggccgccaucgcgaaccaggccgucgugcugauggggcucgacaagggcuggcccaucuccaagauggaccugggggugccccugcucgcccugggcugcuacagccaggucaacccccugacccucaccgccgccgugcugcugcucgugacccacuacgcgaucaucgggccgggccugcaggccaaggccacgcgggaggcccagaagcgcaccgccgcgggcaucaugaagaaccccaccgucgacgggaucaugaccaucgaccuggaccccgugaucuacgacuccaaguucgagaagcagcucggccaggugaugcugcugguccucugcgccgugcagcugcugcucaugcggacgagcugggcccugugcgaggcccugacccucgccaccgggcccaucaccacgcugugggagggcuccccgggcaaguucuggaacaccaccaucgcggugagcauggccaacaucuuccgcggguccuaccuggccggcgccgggcucgcguucagcaucaugcgguccgucggcaccgggaagcgcggcacgggcagccagggggagacccugggcgagaaguggaagaagaagcugaaccagcucagccggaaggaguucgaccuguacaagaaguccgggaucaccgagguggaccgcaccgaggccaaggagggccugaagcgcggggagaccacgcaccacgccgugagccgcggcuccgccaagcuccagugguucgucgagcggaacauggugauccccgagggccgcgugaucgaccuggggugcggccgcgggggcuggagcuacuacugcgccgggcugaagaaggucaccgaggugcggggcuacaccaagggcgggcccggccacgaggagcccgugccgauguccaccuacggguggaacaucgucaagcucaugagcggcaaggacguguucuaccugccgcccgagaagugcgacacgcugcugugcgacaucggggaguccagccccuccccgaccguggaggagagccgcaccauccggguccucaagaugguggagcccuggcugaagaacaaccaguucugcaucaaggugcugaaccccuacaugcccaccgucaucgagcaccucgagcgccugcagcggaagcacggcggcaugcuggugcgcaacccgcucucccggaacagcacgcacgagauguacuggaucuccaacgggaccggcaacaucgugagcuccgucaacauggugagccgccugcugcucaaccgguucaccaugacccaccgccggcccacgaucgagaaggacguggaccugggggcgggcacccgccacgucaacgccgagcccgagaccccgaacauggacgugaucggcgagcggaucaagcgcaucaaggaggagcacuccagcaccuggcacuacgacgacgagaaccccuacaagacgugggccuaccacggguccuacgaggucaaggccaccggcagcgccagcuccaugaucaacgggguggugaagcugcucaccaagcccugggacgucgugcccauggugacccagauggcgaugacggacaccaccccguucggccagcagcgggucuucaaggagaagguggacacccgcacgccccggcccaugcccgggacccgcaaggugauggagaucaccgccgaguggcuguggcggacccugggccgcaacaagcgcccgcggcucugcacgcgcgaggaguucaccaagaagguccggaccaacgccgccaugggcgccguguucaccgaggagaaccagugggacagcgcgcgcgccgccguggaggacgaggaguucuggaagcuggucgaccgggagcgcgagcugcacaagcucgggaagugcggcuccugcguguacaacaugauggggaagcgggagaagaagcugggcgaguucgggaaggccaagggcagccgcgcgaucugguacauguggcugggcgcccgguaccucgaguucgaggcccugggguuccugaacgaggaccacugguucucccgcgagaacagcuacuccggcguggagggggagggccuccacaagcugggguacauccugcgggacaucagcaagauccccggcggcgccauguacgccgacgacacggcggggugggacacccgcaucaccgaggacgaccuccacaacgaggagaagaucacccagcagauggaccccgagcaccggcagcuggccaacgccaucuucaagcugacguaccagaacaaggucgugaaggugcagcgccccaccccgaagggcaccgucauggacaucaucucccggaaggaccagcgcgggagcggccaggugggcaccuacgggcucaacaccuucacgaacauggaggcccagcuggugcggcagauggagggcgaggggguccuguccaagguggaccucgagaacccccaccuccuggagaagaagaucacccaguggcucgagaccaagggcguggagcgccugcggcgcauggccaucagcggggacgacugcgucgugaagcccaucgacgaccgguucgcgaacgcccugcucgcccugaacgacaugggcaaggugcgcaaggacaucccccaguggcagccguccaagggcuggcacgacuggcagcagguccccuucugcagccaccacuuccacgagcugaucaugaaggacgggcgcaagcucguggugcccugccggccccaggacgagcugaucggccgcgcccggaucucccagggggccggcuggagccugaaggagaccgcgugccucgggaaggccuacgcccagauguggucccugauguacuuccaccgccgggaccugcgccucgccagcaacgccaucugcuccgcggucccggugcacugggugcccacgagccggaccaccuggagcauccacgcccaccaccaguggaugaccacggaggacaugcugaccgucuggaaccgcguguggaucgaggacaaccccuggauggaggacaagacccccgugaccacgugggaggacgucccguaccugggcaagcgggaggaccaguggugcggcucccucaucgggcugaccagccgcgccaccugggcccagaacauccugaccgcgauccagcagguccggucccucaucggcgacgaggaguuccuggacuacaugcccagcaugaagcgcuuccggaaggaggaggaguccgagggggccaucugguga

SEQ ID NO: 10117 - RNA, 9873 nt, Artificial Sequence
  derived and/or modified CDS sequence (opt1) from DENV-3__FJ687448__SS-prME
accagccugugccucaugaugaugcugcccgccacccuggccuuccaccucaccagccgggacggcgagccgcggaugaucguggccaagaacgagcggggcaagagccugcuguucaagaccgccuccggcaucaacaugugcacccucaucgccauggaccugggggagaugugcgacgacaccgugaccuacaagugcccccugaucgccgagguggagcccgaggacaucgacugcuggugcaaccucaccagcaccugggugaccuacggcacgugcaaccaggccggggagcaccggcgcgacaagcgguccgucgcgcuggcgccccacgugggcaugggccuggacacccgcacccagaccuggaugagcgccgagggggccuggcgccagguggagaagguggagacgugggcgcuccgccacccgggcuucaccauccuggcccuguuccucgcccacuacaucgggaccucccugacccagaagguggugaucuucauccugcucaugcuggugacgcccagcaugaccaugcggugcgugggcguggggaaccgcgacuucgucgagggccuguccggcgccaccuggguggacgugguccucgagcacgggggcugcgugaccacgauggccaagaacaagcccacccuggacaucgagcugcagaagaccgaggcgacccagcucgccacgcugcggaagcugugcaucgaggggaagaucaccaacaucaccaccgacagccgcugccccacgcagggcgaggccauccucccggaggagcaggaccagaacuacgugugcaagcacaccuacgucgaccggggcugggggaacggcugcgggcuguucggcaaggggucccuggugaccugcgccaaguuccagugccucgagcccaucgagggcaaggugguccagcacgagaaccugaaguacaccgugaucaucacggugcacaccggcgaccagcaccaggucgggaacgacacccagggcgugaccgucgagaucacgccccaggccagcaccguggaggcgauccugcccgaguacgggacccucggccuggagugcuccccgcgcaccgggcuggacuucaacgagaugauccuccugaccaugaagaacaaggccuggauggugcaccggcagugguucuucgaccugccccuccccuggacgagcggcgccaccaccgagacccccacguggaaccgcaaggagcugcuggucaccuucaagaacgcccacgccaagaagcaggagguggugguccucggcucccaggagggggcgaugcacaccgcccugaccggcgccacggagauccagaacagcgggggcaccuccaucuucgccgggcaccugaagugccggcucaagauggacaagcuggagcugaagggcaugagcuacgccaugugccucaacaccuucgugcugaagaaggagguguccgagacccagcacggcacgauccugaucaaggucgaguacaagggggaggacgcgccgugcaagauccccuucagcaccgaggacggccaggggaaggcccacaacggccgccugaucaccgccaaccccguggugaccaagaaggaggagcccgucaacaucgaggccgagccgcccuucggcgagagcaacaucgugaucgggaucggcgacaaggcgcucaagaucaacugguacaagaagggguccagcaucggcaagauguucgaggccacggcccgcggggcccgccggauggccauccugggcgacaccgcgugggacuucggcuccgucggcgggguccugaacagccucgggaagauggugcaccagaucuucggguccgccuacaccgcccuguucagcgggguguccuggaucaugaagaucggcaucggcguccugcucaccuggaucgggcugaacagcaagaacacguccaugagcuucuccugcaucgugaucggcaucaucacccuguaccucggggccgugguccaggccgacaugggcugcgugaucaacuggaaggggaaggagcugaagugcggcagcggcaucuucgugaccaacgagguccacaccuggacggagcaguacaaguuccaggcggacucccccaagcgccuggccaccgccaucgccggggccugggagaacggcgugugcgggauccgcagcaccacccggauggagaaccuccuguggaagcagaucgcgaacgagcugaacuacauccucugggagaacaacaucaagcugacgguggucgugggcgacaucaucggggugcuggagcagggcaagcgcacccucacgccccagccgauggagcugaaguacuccuggaagaccuggggcaaggccaagaucgucacggccgagacccagaacagcuccuucaucaucgacgggcccaacacccccgagugccccagcgccucccgggcguggaacgugugggagguggaggacuacggcuucggggucuucaccacgaacaucuggcugaagcuccgcgagguguacacccagagcugcgaccaccggcugaugagcgccgccaucaaggacgagcgcgccgugcacgccgacaugggcuacuggaucgagucccagaagaacggcagcuggaagcuggagaaggcguccuucaucgaggucaagaccugcaccuggcccaagagccacacccucugguccaacggggugcuggagagcgacaugaucauccccaagucccuggccggccccaucagccagcacaaccaccggccgggguaccacacgcagaccgccggccccuggcaccucgggaagcuggagcuggacuucaacuacugcgagggcaccaccguggucaucacggagaacugcggcacccgcgggcccucccuccggaccaccacggugagcggcaagcugauccacgaguggugcugccgcuccugcacccugcccccgcuccgguacaugggggaggacggcugcugguacgggauggagauccgccccaucaacgagaaggaggagaacauggucaagagccuggucuccgccggcagcggcaagauggacaacuucaccauggggauccugugccucgccauccuguucgaggaggugaugcggggcaaguucgggaagaagcacaugaucgcgggcgugcuguucaccuucguccuccugcuguccgggcagaucacguggcgcgacauggcccacacccucaucaugaucggcagcaacgccuccgaccggaugggcaugggggugaccuaccuggcccugaucgccaccuucaagauccagcccuuccucgcgcugggcuucuuccugcgcaagcucacgagccgggagaaccugcugcucggggugggccuggccauggccaccacccugcagcuccccgaggacaucgagcagauggccaacggcaucgcgcuggggcugaugacccucaagcugaucacgcaguucgagaccuaccagcuguggaccgcccucgucagccugaccugcuccaacacgaucuucacccugaccguggccuggcgcaccgccacgcucauccuggccggcgugagccugcucccgcugugccaguccagcuccaugcggaagaccgacuggcugcccaugaccgucgcggccaugggggugccgccccugccgcuguucaucuucagccugaaggacacccccaagcgccgcuccuggccccucaacgagggcgucauggccguggggcuggugagcauccuggccuccagccuccugcggaacgacguccccauggccggcccgcugguggcgggcgggcuccugaucgccugcuacgugaucacgggcaccuccgccgaccugaccgucgagaaggccgccgacgugaccugggaggaggaggcggagcagacgggggugagccacaaccucaugaucaccgucgacgacgacggcaccaugcgcaucaaggacgacgagaccgagaacauccugaccgugcugcucaagacggcccugcugaucguguccgggaucuuccccuacagcauccccgccacccuccuggucuggcacaccuggcagaagcagacccagcgguccggcgugcugugggacgugcccagcccgcccgagacgcagaaggccgagcucgaggagggcgucuaccgcaucaagcagcaggggaucuucggcaagacccaggugggggugggcguccagaaggaggggguguuccacaccauguggcacgugacccggggcgccguccugacgcacaacggcaagcgccuggagcccaacugggcguccgugaagaaggaccucaucagcuacgggggcggguggcggcuguccgcccaguggcagaagggcgaggaggugcaggucaucgccguggagcccgggaagaacccgaagaacuuccagaccaugcccggcaucuuccagaccaccacgggcgagaucggggccaucgcgcuggacuucaagcccggcaccagcgggagcccgaucaucaaccgcgagggcaagguggucggccuguacgggaacggcguggugaccaagaacgggggcuacgucuccgggaucgcccagaccaacgccgagcccgacggccccacgcccgagcucgaggaggagauguucaagaagcggaaccugaccaucauggaccugcacccgggcagcgggaagacccgcaaguaccuccccgccaucgugcgggaggccaucaagcgccggcugcgcacccugauccucgcgcccacgcggguggucgccgccgagauggaggaggcccugaagggccugcccauccgcuaccagaccaccgccaucaaguccgagcacaccgggcgggagaucguggaccucaugugccacgcgacguucaccaugcgccugcugagcccggugcggguccccaacuacaaccucaucaucauggacgaggcccacuucaccgaccccgccuccaucgccgcccgcggcuacaucagcacccggguggggaugggcgaggcggccgccaucuucaugacggccacgccgcccggcaccgcggaggccuucccccaguccaacgcccccauccaggacgaggagcgcgacauccccgagcgcagcuggaacuccgggaacgaguggaucaccgacuucgugggcaagacggucugguucgugcccagcaucaaggccgggaacgacaucgccaacugccugcggaagaacggcaagaaggugauccagcugucccgcaagaccuucgacaccgaguaccagaagacccggcucaacgacugggacuucgucgugacgaccgacaucagcgagaugggggcgaacuucaaggccgaccgcgugaucgacccccggcgcugccugaagcccgucauccugaccgacggccccgagcgggugauccucgccggcccgaugcccgugaccgccgccuccgcggcccagcgccgggggcgcgucggccggaacccccagaaggagaacgaccaguacaucuucacggggcagccccugaacaacgacgaggaccacgcccacuggaccgaggccaagaugcugcucgacaacaucaacaccccggagggcaucauccccgcccuguucgagcccgagcgcgagaaguccgcggccaucgacggggaguaccggcugaagggcgagucccgcaagaccuucguggagcucaugcggcgcggcgaccugcccguguggcuggcccacaaggucgccagcgaggggaucaaguacaccgaccggaaguggugcuucgacggcgagcgcaacaaccagauccucgaggagaacauggacguggagaucuggacgaaggagggggagcggaagaagcugcgcccgcgcuggcuggacgcgcggaccuacuccgacccccucgcccugaaggaguucaaggacuucgccgccggccgcaagagcaucgcccuggaccucgucaccgagaucggccgggugcccucccaccuggcgcaccgcacccggaacgcccuggacaaccucgugaugcugcacacgagcgagcacgggggccgcgccuaccggcacgccgucgaggagcugccggagaccauggagacccuccugcugcucgggcugaugauccugcucaccggcggggccaugcuguuccugaucagcggcaagggcaucgggaagacguccaucggccucaucugcgugaucgugagcuccgggaugcuguggauggcggacgucccccugcaguggaucgccagcgccaucgugcucgaguucuucaugauggugcugcugauccccgagcccgagaagcagcgcaccccgcaggacaaccagcucgccuacgucgugaucggcauccugacccuggccgcgaucgugaccgccaacgagauggggcuccuggagacgaccaagcgggaccugggcauguccaaggagcccggcgucgugagccccaccuccuaccucgacguggaccugcaccccgccagcgccuggacccuguacgccgucgcgacgaccgugaucaccccgaugcuccgccacaccaucgagaacuccacggccaacgugagccuggccgccaucgcgaaccaggccgucgugcugauggggcucgacaagggcuggcccaucuccaagauggaccugggggugccccugcucgcccugggcugcuacagccaggucaacccccugacccucaccgccgccgugcugcugcucgugacccacuacgcgaucaucgggccgggccugcaggccaaggccacgcgggaggcccagaagcgcaccgccgcgggcaucaugaagaaccccaccgucgacgggaucaugaccaucgaccuggaccccgugaucuacgacuccaaguucgagaagcagcucggccaggugaugcugcugguccucugcgccgugcagcugcugcucaugcggacgagcugggcccugugcgaggcccugacccucgccaccgggcccaucaccacgcugugggagggcuccccgggcaaguucuggaacaccaccaucgcggugagcauggccaacaucuuccgcggguccuaccuggccggcgccgggcucgcguucagcaucaugaaguccgucggcaccgggaagcggggcacgggcagccagggggagacccugggcgagaaguggaagaagaagcugaaccagcucagccgcaaggaguucgaccuguacaagaaguccgggaucaccgagguggaccggaccgaggccaaggagggccugaagcgcggggagaccacgcaccacgccgugagccggggcuccgccaagcuccagugguucgucgagcgcaacauggugauccccgagggccgggugaucgaccuggggugcggccgcgggggcuggagcuacuacugcgccgggcugaagaaggucaccgaggugcgcggcuacaccaagggcgggcccggccacgaggagcccgugccgauguccaccuacggguggaacaucgucaagcucaugagcggcaaggacguguucuaccugccgcccgagaagugcgacacgcugcugugcgacaucggggaguccagccccuccccgaccguggaggagagccggaccauccgcguccucaagaugguggagcccuggcugaagaacaaccaguucugcaucaaggugcugaaccccuacaugcccaccgucaucgagcaccucgagcggcugcagcgcaagcacggcggcaugcuggugcggaacccgcucucccgcaacagcacgcacgagauguacuggaucuccaacgggaccggcaacaucgugagcuccgucaacauggugagccggcugcugcucaaccgcuucaccaugacccaccggcgccccacgaucgagaaggacguggaccugggggcgggcacccggcacgucaacgccgagcccgagaccccgaacauggacgugaucggcgagcgcaucaagcggaucaaggaggagcacuccagcaccuggcacuacgacgacgagaaccccuacaagacgugggccuaccacggguccuacgaggucaaggccaccggcagcgccagcuccaugaucaacgggguggugaagcugcucaccaagcccugggacgucgugcccauggugacccagauggcgaugacggacaccaccccguucggccagcagcgcgucuucaaggagaagguggacacccggacgccccgccccaugcccgggacccggaaggugauggagaucaccgccgaguggcuguggcgcacccugggccggaacaagcgcccgcgccucugcacgcgggaggaguucaccaagaagguccgcaccaacgccgccaugggcgccguguucaccgaggagaaccagugggacagcgcgcgggccgccguggaggacgaggaguucuggaagcuggucgaccgcgagcgggagcugcacaagcucgggaagugcggcuccugcguguacaacaugauggggaagcgcgagaagaagcugggcgaguucgggaaggccaagggcagccgggcgaucugguacauguggcugggcgcccgcuaccucgaguucgaggcccugggguuccugaacgaggaccacugguucucccgggagaacagcuacuccggcguggagggggagggccuccacaagcugggguacauccugcgcgacaucagcaagauccccggcggcgccauguacgccgacgacacggcggggugggacacccggaucaccgaggacgaccuccacaacgaggagaagaucacccagcagauggaccccgagcaccgccagcuggccaacgccaucuucaagcugacguaccagaacaaggucgugaaggugcagcggcccaccccgaagggcaccgucauggacaucaucucccgcaaggaccagcgggggagcggccaggugggcaccuacgggcucaacaccuucacgaacauggaggcccagcuggugcgccagauggagggcgaggggguccuguccaagguggaccucgagaacccccaccuccuggagaagaagaucacccaguggcucgagaccaagggcguggagcggcugcgccggauggccaucagcggggacgacugcgucgugaagcccaucgacgaccgcuucgcgaacgcccugcucgcccugaacgacaugggcaaggugcggaaggacaucccccaguggcagccguccaagggcuggcacgacuggcagcagguccccuucugcagccaccacuuccacgagcugaucaugaaggacgggcgcaagcucguggugcccugccgcccccaggacgagcugaucggccgggcccgcaucucccagggggccggcuggagccugaaggagaccgcgugccucgggaaggccuacgcccagauguggucccugauguacuuccaccggcgcgaccugcggcucgccagcaacgccaucugcuccgcggucccggugcacugggugcccacgagccgcaccaccuggagcauccacgcccaccaccaguggaugaccacggaggacaugcugaccgucuggaaccggguguggaucgaggacaaccccuggauggaggacaagacccccgugaccacgugggaggacgucccguaccugggcaagcgcgaggaccaguggugcggcucccucaucgggcugaccagccgggccaccugggcccagaacauccugaccgcgauccagcagguccgcucccucaucggcgacgaggaguuccuggacuacaugcccagcaugaagcgguuccgcaaggaggaggaguccgagggggccaucugguga

SEQ ID NO: 10118 - RNA, 9873 nt, Artificial Sequence
  derived and/or modified CDS sequence (opt1) from DENV-3__FJ744732__SS-prME
accagccugugccucaugaugaugcugcccgccacccuggccuuccaccucaccagccgggacggcgagccgcggaugaucguggccaagaacgagcggggcaagagccugcuguucaagaccgccuccggcaucaacaugugcacccucaucgccauggaccugggggagaugugcgacgacaccgugaccuacaagugcccccugaucgccgagguggagcccgaggacaucgacugcuggugcaaccucaccagcaccugggugaccuacggcacgugcaaccaggccggggagcaccggcgcgacaagcgguccgucgcgcuggcgccccacgugggcaugggccuggacacccgcacccagaccuggaugagcgccgagggggccuggcgccagguggagaagguggagacgugggcgcuccgccacccgggcuucaccauccuggcccuguuccucgcccacuacaucgggaccucccugacccagaagguggugaucuucauccugcucaugcuggugacgcccagcaugaccaugcggugcgugggcguggggaaccgcgacuucgucgagggccuguccggcgccaccuggguggacgugguccucgagcacgggggcugcgugaccacgauggccaagaacaagcccacccuggacaucgagcugcagaagaccgaggcgacccagcucgccacgcugcggaagcugugcaucgaggggaagaucaccaacaucaccaccgacagccgcugccccacgcagggcgaggccauccucccggaggagcaggaccagaacuacgugugcaagcacaccuacgucgaccggggcugggggaacggcugcgggcuguucggcaaggggucccuggugaccugcgccaaguuccagugccucgagcccaucgagggcaaggugguccagcacgagaaccugaaguacaccgugaucaucacggugcacaccggcgaccagcaccaggucgggaacgacacccagggcgugaccgucgagaucacgccccaggccagcaccguggaggcgauccugcccgaguacgggacccucggccuggagugcuccccgcgcaccgggcuggacuucaacgagaugauccuccugaccaugaagaacaaggccuggauggugcaccggcagugguucuucgaccugccccuccccuggacgagcggcgccaccaccgagacccccacguggaaccgcaaggagcugcuggucaccuucaagaacgcccacgccaagaagcaggagguggugguccucggcucccaggagggggcgaugcacaccgcccugaccggcgccacggagauccagaacagcgggggcaccuccaucuucgccgggcaccugaagugccggcucaagauggacaagcuggagcugaagggcaugagcuacgccaugugccucaacaccuucgugcugaagaaggagguguccgagacccagcacggcacgauccugaucaaggucgaguacaagggggaggacgcgccgugcaagauccccuucagcaccgaggacggccaggggaaggcccacaacggccgccugaucaccgccaaccccguggugaccaagaaggaggagcccgucaacaucgaggccgagccgcccuucggcgagagcaacaucgugaucgggaucggcgacaaggcgcucaagaucaacugguacaagaagggguccagcaucggcaagauguucgaggccacggcccgcggggcccgccggauggccauccugggcgacaccgcgugggacuucggcuccgucggcgggguccugaacagccucgggaagauggugcaccagaucuucggguccgccuacaccgcccuguucagcgggguguccuggaucaugaagaucggcaucggcguccugcucaccuggaucgggcugaacagcaagaacacguccaugagcuucuccugcaucgugaucggcaucaucacccuguaccucggggccgugguccaggccgacaugggcugcgugaucaacuggaaggggaaggagcugaagugcggcagcggcaucuucgugaccaacgagguccacaccuggacggagcaguacaaguuccaggcggacucccccaagcgccuggccaccgccaucgccggggccugggagaacggcgugugcgggauccgcagcaccacccggauggagaaccuccuguggaagcagaucgcgaacgagcugaacuacauccucugggagaacaacaucaagcugacgguggucgugggcgacaucaucggggugcuggagcagggcaagcgcacccucacgccccagccgauggagcugaaguacuccuggaagaccuggggcaaggccaagaucgucacggccgagacccagaacagcuccuucaucaucgacgggcccaacacccccgagugccccagcgccucccgggcguggaacgugugggagguggaggacuacggcuucggggucuucaccacgaacaucuggcugaagcuccgcgagguguacacccagagcugcgaccaccggcugaugagcgccgccaucaaggacgagcgcgccgugcacgccgacaugggcuacuggaucgagucccagaagaacggcagcuggaagcuggagaaggcguccuucaucgaggucaagaccugcaccuggcccaagagccacacccucugguccaacggggugcuggagagcgacaugaucauccccaagucccuggccggccccaucagccagcacaaccaccggccgggguaccacacgcagaccgccggccccuggcaccucgggaagcuggagcuggacuucaacuacugcgagggcaccaccguggucaucacggagaacugcggcacccgcgggcccucccuccggaccaccacggugagcggcaagcugauccacgaguggugcugccgcuccugcacccugcccccgcuccgguacaugggggaggacggcugcugguacgggauggagauccgccccaucaacgagaaggaggagaacauggucaagagccuggucuccgccggcagcggcaagauggacaacuucaccauggggauccugugccucgccauccuguucgaggaggugaugcggggcaaguucgggaagaagcacaugaucgcgggcgugcuguucaccuucguccuccugcuguccgggcagaucacguggcgcgacauggcccacacccucaucaugaucggcagcaacgccuccgaccggaugggcaugggggugaccuaccuggcccugaucgccaccuucaagauccagcccuuccucgcgcugggcuucuuccugcgcaagcucacgagccgggagaaccugcugcucggggugggccuggccauggccaccacccugcagcuccccgaggacaucgagcagauggccaacggcaucgcgcuggggcugaugacccucaagcugaucacgcaguucgagaccuaccagcuguggaccgcccucgucagccugaccugcuccaacacgaucuucacccugaccguggccuggcgcaccgccacgcucauccuggccggcgugagccugcucccgcugugccaguccagcuccaugcggaagaccgacuggcugcccaugaccgucgcggccaugggggugccgccccugccgcuguucaucuucagccugaaggacacccccaagcgccgcuccuggccccucaacgagggcgucauggccguggggcuggugagcauccuggccuccagccuccugcggaacgacguccccauggccggcccgcugguggcgggcgggcuccugaucgccugcuacgugaucacgggcaccuccgccgaccugaccgucgagaaggccgccgacgugaccugggaggaggaggcggagcagacgggggugagccacaaccucaugaucaccgucgacgacgacggcaccaugcgcaucaaggacgacgagaccgagaacauccugaccgugcugcucaagacggcccugcugaucguguccgggaucuuccccuacagcauccccgccacccuccuggucuggcacaccuggcagaagcagacccagcgguccggcgugcugugggacgugcccagcccgcccgagacgcagaaggccgagcucgaggagggcgucuaccgcaucaagcagcaggggaucuucggcaagacccaggugggggugggcguccagaaggaggggguguuccacaccauguggcacgugacccggggcgccguccugacgcacaacggcaagcgccuggagcccaacugggcguccgugaagaaggaccucaucagcuacgggggcggguggcggcuguccgcccaguggcagaagggcgaggaggugcaggucaucgccguggagcccgggaagaacccgaagaacuuccagaccaugcccggcaucuuccagaccaccacgggcgagaucggggccaucgcgcuggacuucaagcccggcaccagcgggagcccgaucaucaaccgcgagggcaagguggucggccuguacgggaacggcguggugaccaagaacgggggcuacgucuccgggaucgcccagaccaacgccgagcccgacggccccacgcccgagcucgaggaggagauguucaagaagcggaaccugaccaucauggaccugcacccgggcagcgggaagacccgcaaguaccuccccgccaucgugcgggaggccaucaagcgccggcugcgcacccugauccucgcgcccacgcggguggucgccgccgagauggaggaggcccugaagggccugcccauccgcuaccagaccaccgccaucaaguccgagcacaccgggcgggagaucguggaccucaugugccacgcgacguucaccaugcgccugcugagcccggugcggguccccaacuacaaccucaucaucauggacgaggcccacuucaccgaccccgccuccaucgccgcccgcggcuacaucagcacccggguggggaugggcgaggcggccgccaucuucaugacggccacgccgcccggcaccgcggaggccuucccccaguccaacgcccccauccaggacgaggagcgcgacauccccgagcgcagcuggaacuccgggaacgaguggaucaccgacuucgccggcaagacggugugguucguccccagcaucaaggccgggaacgacaucgcgaacugccugcggaagaacggcaagaaggugauccagcugucccgcaagaccuucgacaccgaguaccagaagacccggcucaacgacugggacuucguggucacgaccgacaucagcgagaugggggccaacuucaaggccgaccgcgugaucgacccccggcgcugccugaagcccgugauccugaccgacggccccgagcgggucauccucgccggcccgaugcccgugaccgccgcguccgccgcccagcgccgggggcgcgugggccggaacccccagaaggagaacgaccaguacaucuucacggggcagccccugaacaacgacgaggaccacgcccacuggaccgaggccaagaugcugcucgacaacaucaacaccccggagggcaucauccccgcgcuguucgagcccgagcgcgagaaguccgccgccaucgacggggaguaccggcugaagggcgagucccgcaagaccuucgucgagcucaugcggcgcggcgaccugcccguguggcuggcccacaagguggcgagcgaggggaucaaguacaccgaccggaaguggugcuucgacggcgagcgcaacaaccagauccucgaggagaacauggacgucgagaucuggacgaaggagggggagcggaagaagcugcgcccgcgcuggcuggacgcccggaccuacuccgacccccucgcccugaaggaguucaaggacuucgccgccggccgcaagagcaucgcgcuggaccucgugaccgagaucggccggguccccucccaccuggcccaccgcacccggaacgcccuggacaaccucgugaugcugcacacgagcgagcacgggggccgcgccuaccggcacgccguggaggagcugccggagaccauggagacccuccugcugcucgggcugaugauccugcucaccggcggggcgaugcuguuccugaucagcggcaagggcaucgggaagacguccaucggccucaucugcgucaucgugagcuccgggaugcuguggauggccgacgugccccugcaguggaucgccagcgccaucguccucgaguucuucaugauggugcugcugauccccgagcccgagaagcagcgcaccccgcaggacaaccagcucgccuacguggucaucggcauccugacccuggcggccaucgugaccgccaacgagauggggcuccuggagacgaccaagcgggaccugggcauguccaaggagcccggcguggucagccccaccuccuaccucgacguggaccugcaccccgccagcgccuggacccuguacgcgguggccacgaccgucaucaccccgaugcuccgccacaccaucgagaacuccacggccaacgugagccuggccgcgaucgccaaccaggccgugguccugauggggcucgacaagggcuggcccaucuccaagauggaccugggggugccccugcucgcccugggcugcuacagccaggugaacccccugacccucaccgccgcgguccugcugcucgugacccacuacgccaucaucgggccgggccugcaggccaaggccacgcgggaggcccagaagcgcaccgcggccggcaucaugaagaaccccaccguggacgggaucaugaccaucgaccuggaccccgucaucuacgacuccaaguucgagaagcagcucggccaggugaugcugcuggugcucugcgccguccagcugcugcucaugcggacgagcugggcccugugcgaggcccugacccucgcgaccgggcccaucaccacgcugugggagggcuccccgggcaaguucuggaacaccaccaucgccgugagcauggccaacaucuuccgcggguccuaccuggccggcgcggggcucgccuucagcaucaugaaguccgugggcaccgggaagcggggcacgggcagccagggggagacccugggcgagaaguggaagaagaagcugaaccagcucagccgcaaggaguucgaccuguacaagaaguccgggaucaccgaggucgaccggaccgaggccaaggagggccugaagcgcggggagaccacgcaccacgccgugagccggggcuccgccaagcuccagugguucguggagcgcaacauggucauccccgagggccgggugaucgaccuggggugcggccgcgggggcuggagcuacuacugcgcggggcugaagaaggugaccgagguccgcggcuacaccaagggcgggcccggccacgaggagcccgugccgauguccaccuacggguggaacaucgugaagcucaugagcggcaaggacgucuucuaccugccgcccgagaagugcgacacgcugcugugcgacaucggggaguccagccccuccccgaccguggaggagagccggaccauccgcgugcucaagauggucgagcccuggcugaagaacaaccaguucugcaucaaggugcugaaccccuacaugcccaccgugaucgagcaccucgagcggcugcagcgcaagcacggcggcaugcugguccggaacccgcucucccgcaacagcacgcacgagauguacuggaucuccaacgggaccggcaacaucgugagcuccgugaacauggucagccggcugcugcucaaccgcuucaccaugacccaccggcgccccacgaucgagaaggacguggaccugggggccggcacccggcacgugaacgccgagcccgagaccccgaacauggacgucaucggcgagcgcaucaagcggaucaaggaggagcacuccagcaccuggcacuacgacgacgagaaccccuacaagacgugggccuaccacggguccuacgaggugaaggccaccggcagcgcgagcuccaugaucaacggggucgugaagcugcucaccaagcccugggacgugguccccauggugacccagauggccaugacggacaccaccccguucggccagcagcgcguguucaaggagaaggucgacacccggacgccccgccccaugcccgggacccggaaggugauggagaucaccgccgaguggcuguggcgcacccugggccggaacaagcgcccgcgccucugcacgcgggaggaguucaccaagaaggugcgcaccaacgccgccaugggcgcggucuucaccgaggagaaccagugggacagcgcccgggccgccguggaggacgaggaguucuggaagcugguggaccgcgagcgggagcugcacaagcucgggaagugcggcuccugcgucuacaacaugauggggaagcgcgagaagaagcugggcgaguucgggaaggcgaagggcagccgggccaucugguacauguggcugggcgcccgcuaccucgaguucgaggcccugggguuccugaacgaggaccacugguucucccgggagaacagcuacuccggcguggagggggagggccuccacaagcugggguacauccugcgcgacaucagcaagauccccggcggcgccauguacgcggacgacacggccgggugggacacccggaucaccgaggacgaccuccacaacgaggagaagaucacccagcagauggaccccgagcaccgccagcuggccaacgccaucuucaagcugacguaccagaacaagguggucaaggugcagcggcccaccccgaagggcaccgugauggacaucaucucccgcaaggaccagcgggggagcggccaggucggcaccuacgggcucaacaccuucacgaacauggaggcccagcuggugcgccagauggagggcgagggggugcuguccaaggucgaccucgagaacccccaccuccuggagaagaagaucacccaguggcucgagaccaagggcguggagcggcugcgccggauggcgaucagcggggacgacugcguggucaagcccaucgacgaccgcuucgccaacgcccugcucgcccugaacgacaugggcaaggugcggaaggacaucccccaguggcagccguccaagggcuggcacgacuggcagcagguccccuucugcagccaccacuuccacgagcugaucaugaaggacgggcgcaagcucgucgugcccugccgcccccaggacgagcugaucggccgggcccgcaucucccagggggcgggcuggagccugaaggagaccgccugccucgggaaggccuacgcccagauguggucccugauguacuuccaccggcgcgaccugcggcucgccagcaacgcgaucugcuccgccgugccgguccacugggugcccacgagccgcaccaccuggagcauccacgcccaccaccaguggaugaccacggaggacaugcugaccguguggaaccgggucuggaucgaggacaaccccuggauggaggacaagacccccgugaccacgugggaggacgugccguaccugggcaagcgcgaggaccaguggugcggcucccucaucgggcugaccagccgggccaccugggcgcagaacauccugaccgccauccagcagguccgcucccucaucggcgacgaggaguuccuggacuacaugcccagcaugaagcgguuccgcaaggaggaggaguccgagggggccaucugguga

SEQ ID NO: 10119 - RNA, 9873 nt, Artificial Sequence
  derived and/or modified CDS sequence (opt1) from DENV-3__FJ810414__SS-prME
accagccugugccucaugaugaugcugcccgccacccuggccuuccaccucaccagccgggacggcgagccgcggaugaucguggccaagaacgagcgcggcaagagccugcuguucaagaccgccuccggcaucaacaugugcacccucaucgccauggaccugggggagaugugcgacgacaccgugaccuacaagugcccccugaucgccgagguggagcccgaggacaucgacugcuggugcaaccucaccagcaccugggugaccuacggcacgugcaaccaggccggggagcaccggcgcgacaagcgguccgucgcgcuggcgccccacgugggcaugggccuggacacccgcacccagaccuggaugagcgccgagggggccuggcggcaggucgagaagguggagacgugggcgcuccgccacccgggcuucaccauccuggcccuguuccucgcccacuacaucgggaccucccugacccagaagguggugaucuucauccugcucaugcuggugacgcccagcaugaccaugcggugcgugggcguggggaaccgcgacuucgucgagggccuguccggcgccaccuggguggacgugguccucgagcacgggggcugcgugaccacgauggccaagaacaagcccacccuggacaucgagcugcagaagaccgaggcgacccagcucgccacgcugcggaagcugugcaucgaggggaagaucaccaacaucaccaccgacagccgcugccccacgcagggcgaggccauccucccggaggagcaggaccagaacuacgugugcaagcacaccuacgucgaccggggcugggggaacggcugcgggcuguucggcaaggggucccuggugaccugcgccaaguuccagugccucgagcccaucgagggcaaggugguccagcacgagaaccugaaguacaccgugaucaucacggugcacaccggcgaccagcaccaggucgggaacgacacccagggcgugaccgucgagaucacgccccaggccagcaccguggaggcgauccugcccgaguacgggacccucggccuggagugcuccccgcgcaccgggcuggacuucaacgagaugauccuccugaccaugaagaacaaggccuggauggugcaccggcagugguucuucgaccugccccuccccuggacgagcggcgccaccaccgagacccccacguggaaccgcaaggagcugcuggucaccuucaagaacgcccacgccaagaagcaggagguggugguccucggcucccaggagggggcgaugcacaccgcccugaccggcgccacggagauccagaacagcgggggcaccuccaucuucgccgggcaccugaagugccggcucaagauggacaagcuggagcugaagggcaugagcuacgccaugugccucaacaccuucgugcugaagaaggagguguccgagacccagcacggcacgauccugaucaaggucgaguacaagggggaggacgcgccgugcaagauccccuucagcaccgaggacggccaggggaaggcccacaacggccgccugaucaccgccaaccccguggugaccaagaaggaggagcccgucaacaucgaggccgagccgcccuucggcgagagcaacaucgugaucgggaucggcgacaaggcgcucaagaucaacugguacaagaagggguccagcaucggcaagauguucgaggccacggcccgcggggcccgccggauggccauccugggcgacaccgcgugggacuucggcuccgucggcgggguccugaacagccucgggaagauggugcaccagaucuucggguccgccuacaccgcccuguucagcgggguguccuggaucaugaagaucggcaucggcguccugcucaccuggaucgggcugaacagcaagaacacguccaugagcuucuccugcaucgugaucggcaucaucacccuguaccucggggccgugguccaggccgacaugggcugcgugaucaacuggaaggggaaggagcugaagugcggcagcggcaucuucgugaccaacgagguccacaccuggacggagcaguacaaguuccaggcggacucccccaagcgccuggccaccgccaucgccggggccugggagaacggcgugugcgggauccgcagcaccacccggauggagaaccuccuguggaagcagaucgcgaacgagcugaacuacauccucugggagaacaacaucaagcugacgguggucgugggcgacaucaucggggugcuggagcagggcaagcgcacccucacgccccagccgauggagcugaaguacuccuggaagaccuggggcaaggccaagaucgucacggccgagacccagaacagcuccuucaucaucgacgggcccaacacccccgagugccccagcgccucccgggcguggaacgugugggagguggaggacuacggcuucggggucuucaccacgaacaucuggcugaagcuccgcgagguguacacccagagcugcgaccaccggcugaugagcgccgccaucaaggacgagcgcgccgugcacgccgacaugggcuacuggaucgagucccagaagaacggcagcuggaagcuggagaaggcguccuucaucgaggucaagaccugcaccuggcccaagagccacacccucugguccaacggggugcuggagagcgacaugaucauccccaagucccuggccggccccaucagccagcacaaccaccggccgggguaccacacgcagaccgccggccccuggcaccucgggaagcuggagcuggacuucaacuacugcgagggcaccaccguggucaucacggagaacugcggcacccgcgggcccucccuccggaccaccacggugagcggcaagcugauccacgaguggugcugccgcuccugcacccugcccccgcuccgguacaugggggaggacggcugcugguacgggauggagauccgccccaucaacgagaaggaggagaacauggccaagagccugguguccgccggcagcggcaagauggacaacuucaccauggggauccugugccucgcgauccuguucgaggaggucaugcggggcaaguucgggaagaagcacaugaucgccggcgugcuguucaccuucgugcuccugcuguccgggcagaucacguggcgcgacauggcccacacccucaucaugaucggcagcaacgccuccgaccggaugggcaugggggucaccuaccuggcccugaucgcgaccuucaagauccagcccuuccucgcccugggcuucuuccugcgcaagcucacgagccgggagaaccugcugcucggggugggccuggccauggccaccacccugcagcuccccgaggacaucgagcagauggcgaacggcaucgcccuggggcugaugacccucaagcugaucacgcaguucgagaccuaccagcuguggaccgcccucgugagccugaccugcuccaacacgaucuucacccugaccgucgccuggcgcaccgccacgcucauccuggcgggcgugagccugcucccgcugugccaguccagcuccaugcggaagaccgacuggcugcccaugaccguggccgccaugggggugccgccccugccgcuguucaucuucagccugaaggacacccccaagcgccgcuccuggccccucaacgagggcgugauggccgucgggcuggugagcauccuggccuccagccuccugcggaacgacgugcccauggcgggcccgcuggucgccggcgggcuccugaucgccugcuacgugaucacgggcaccuccgccgaccugaccguggagaaggccgcggacgucaccugggaggaggaggccgagcagacgggggugagccacaaccucaugaucaccguggacgacgacggcaccaugcgcaucaaggacgacgagaccgagaacauccugaccguccugcucaagacggcccugcugaucguguccgggaucuuccccuacagcauccccgccacccuccugguguggcacaccuggcagaagcagacccagcgguccggcguccugugggacgugcccagcccgcccgagacgcagaaggccgagcucgaggagggcguguaccgcaucaagcagcaggggaucuucggcaagacccaggucggggugggcgugcagaaggagggggucuuccacaccauguggcacgugacccggggcgcggugcugacgcacaacggcaagcgccuggagcccaacugggccuccgucaagaaggaccucaucagcuacgggggcggguggcggcuguccgcccaguggcagaagggcgaggagguccaggugaucgccgucgagcccgggaagaacccgaagaacuuccagaccaugcccggcaucuuccagaccaccacgggcgagaucggggcgaucgcccuggacuucaagcccggcaccagcgggagcccgaucaucaaccgcgagggcaagguggugggccuguacgggaacggcgucgugaccaagaacgggggcuacguguccgggaucgcccagaccaacgccgagcccgacggccccacgcccgagcucgaggaggagauguucaagaagcggaaccugaccaucauggaccugcacccgggcagcgggaagacccgcaaguaccuccccgccaucguccgggaggcgaucaagcgccggcugcgcacccugauccucgcccccacgcgggugguggccgccgagauggaggaggcccugaagggccugcccauccgcuaccagaccaccgcgaucaaguccgagcacaccgggcgggagaucgucgaccucaugugccacgccacguucaccaugcgccugcugagcccggugcgggugcccaacuacaaccucaucaucauggacgaggcccacuucaccgaccccgccuccaucgccgcgcgcggcuacaucagcacccgggucgggaugggcgaggccgccgccaucuucaugacggcgacgccgcccggcaccgccgaggccuucccccaguccaacgcccccauccaggacgaggagcgcgacauccccgagcgcagcuggaacuccgggaacgaguggaucaccgacuucgugggcaagacggugugguucguccccagcaucaaggccgggaacgacaucgcgaacugccugcggaagaacggcaagaaggugauccagcugucccgcaagaccuucgacaccgaguaccagaagacccggcucaacgacugggacuucguggucacgaccgacaucagcgagaugggggccaacuucaaggccgaccgcgugaucgacccccggcgcugccugaagcccgugauccugaccgacggccccgagcgggucauccucgccggcccgaugcccgugaccgccgcguccgccgcccagcgccgggggcgcgugggccggaacccccagaaggagaacgaccaguacaucuucacggggcagccccugaacaacgacgaggaccacgcccacuggaccgaggccaagaugcugcucgacaacaucaacaccccggagggcaucauccccgcgcuguucgagcccgagcgcgagaaguccgccgccaucgacggggaguaccggcugaagggcgagucccgcaagaccuucgucgagcucaugcggcgcggcgaccugcccguguggcuggcccacaagguggcgagcgaggggaucaaguacaccgaccggaaguggugcuucgacggcgagcgcaacaaccagauccucgaggagaacauggacgucgagaucuggacgaaggagggggagcggaagaagcugcgcccgcgcuggcuggacgcccggaccuacuccgacccccucgcccugaaggaguucaaggacuucgccgccggccgcaagagcaucgcgcuggaccucgugaccgagaucggccggguccccucccaccuggcccaccgcacccggaacgcccuggacaaccucgugaugcugcacacgagcgagcacgggggccgcgccuaccggcacgccguggaggagcugccggagaccauggagacccuccugcugcucgggcugaugauccugcucaccggcggggcgaugcuguuccugaucagcggcaagggcaucgggaagacguccaucggccucaucugcgucaucgugagcuccgggaugcuguggauggccgacgugccccugcaguggaucgccagcgccaucguccucgaguucuucaugauggugcugcugauccccgagcccgagaagcagcgcaccccgcaggacaaccagcucgccuacguggucaucggcauccugacccuggcggccaucgugaccgccaacgagauggggcuccuggagacgaccaagcgggaccugggcauguccaaggagcccggcguggucagccccaccuccuaccucgacguggaccugcaccccgccagcgccuggacccuguacgcgguggccacgaccgucaucaccccgaugcuccgccacaccaucgagaacuccacggccaacgugagccuggccgcgaucgccaaccaggccgugguccugauggggcucgacaagggcuggcccaucuccaagauggaccugggggugccccugcucgcccugggcugcuacagccaggugaacccccugacccucaccgccgcgguccugcugcucgugacccacuacgccaucaucgggccgggccugcaggccaaggccacgcgggaggcccagaagcgcaccgcggccggcaucaugaagaaccccaccguggacgggaucaugaccaucgaccuggaccccgucaucuacgacuccaaguucgagaagcagcucggccaggugaugcugcuggugcucugcgccguccagcugcugcucaugcggacgagcugggcccugugcgaggcccugacccucgcgaccgggcccaucaccacgcugugggagggcuccccgggcaaguucuggaacaccaccaucgccgugagcauggccaacaucuuccgcggguccuaccuggccggcgcggggcucgccuucagcaucaugaaguccgugggcaccgggaagcggggcacgggcagccagggggagacccugggcgagaaguggaagaagaagcugaaccagcucagccgcaaggaguucgaccuguacaagaaguccgggaucaccgaggucgaccggaccgaggccaaggagggccugaagcgcggggagaccacgcaccacgccgugagccggggcuccgccaagcuccagugguucguggagcgcaacauggucauccccgagggccgggugaucgaccuggggugcggccgcgggggcuggagcuacuacugcgcggggcugaagaaggugaccgagguccgcggcuacaccaagggcgggcccggccacgaggagcccgugccgauguccaccuacggguggaacaucgugaagcucaugagcggcaaggacgucuucuaccugccgcccgagaagugcgacacgcugcugugcgacaucggggaguccagccccuccccgaccguggaggagagccggaccauccgcgugcucaagauggucgagcccuggcugaagaacaaccaguucugcaucaaggugcugaaccccuacaugcccaccgugaucgagcaccucgagcggcugcagcgcaagcacggcggcaugcugguccggaacccgcucucccgcaacagcacgcacgagauguacuggaucuccaacgggaccggcaacaucgugagcuccgugaacauggucagccggcugcugcucaaccgcuucaccaugacccaccggcgccccacgaucgagaaggacguggaccugggggccggcacccggcacgugaacgccgagcccgagaccccgaacauggacgucaucggcgagcgcaucaagcggaucaaggaggagcacuccagcaccuggcacuacgacgacgagaaccccuacaagacgugggccuaccacggguccuacgaggugaaggccaccggcagcgcgagcuccaugaucaacggggucgugaagcugcucaccaagcccugggacgugguccccauggugacccagauggccaugacggacaccaccccguucggccagcagcgcguguucaaggagaaggucgacacccggacgccccgccccaugcccgggacccggaaggugauggagaucaccgccgaguggcuguggcgcacccugggccggaacaagcgcccgcgccucugcacgcgggaggaguucaccaagaaggugcgcaccaacgccgccaugggcgcggucuucaccgaggagaaccagugggacagcgcccgggccgccguggaggacgaggaguucuggaagcugguggaccgcgagcgggagcugcacaagcucgggaagugcggcuccugcgucuacaacaugauggggaagcgcgagaagaagcugggcgaguucgggaaggcgaagggcagccgggccaucugguacauguggcugggcgcccgcuaccucgaguucgaggcccugggguuccugaacgaggaccacugguucucccgggagaacagcuacuccggcguggagggggagggccuccacaagcugggguacauccugcgcgacaucagcaagauccccggcggcgccauguacgcggacgacacggccgggugggacacccggaucaccgaggacgaccuccacaacgaggagaagaucacccagcagauggaccccgagcaccgccagcuggccaacgccaucuucaagcugacguaccagaacaagguggucaaggugcagcggcccaccccgaagggcaccgugauggacaucaucucccgcaaggaccagcgggggagcggccaggucggcaccuacgggcucaacaccuucacgaacauggaggcccagcuggugcgccagauggagggcgagggggugcuguccaaggucgaccucgagaacccccaccuccuggagaagaagaucacccaguggcucgagaccaagggcguggagcggcugcgccggauggcgaucagcggggacgacugcguggucaagcccaucgacgaccgcuucgccaacgcccugcucgcccugaacgacaugggcaaggugcggaaggacaucccccaguggcagccguccaagggcuggcacgacuggcagcagguccccuucugcagccaccacuuccacgagcugaucaugaaggacgggcgcaagcucgucgugcccugccgcccccaggacgagcugaucggccgggcccgcaucucccagggggcgggcuggagccugaaggagaccgccugccucgggaaggccuacgcccagauguggucccugauguacuuccaccggcgcgaccugcggcucgccagcaacgcgaucugcuccgccgugccgguccacugggugcccacgagccgcaccaccuggagcauccacgcccaccaccaguggaugaccacggaggacaugcugaccguguggaaccgggucuggaucgaggacaaccccuggauggaggacaagacccccgugaccacgugggaggacgugccguaccugggcaagcgcgaggaccaguggugcggcucccucaucgggcugaccagccgggccaccugggcgcagaacauccugaccgccauccagcagguccgcucccucaucggcgacgaggaguuccuggacuacaugcccagcaugaagcgguuccgcaaggaggaggaguccgagggggccaucugguga

SEQ ID NO: 10120 - RNA, 9873 nt, Artificial Sequence
  derived and/or modified CDS sequence (opt1) from DENV-3__FJ744734__SS-prME
accagccugugccucaugaugaugcugcccgccacccuggccuuccaccucaccagccgggacggcgagccccggaugaucguggccaagaacgagcgcggcaagagccugcuguucaagaccgccuccggcaucaacaugugcacccucaucgccauggaccugggggagaugugcgacgacaccgugaccuacaagugcccccugaucgccgagguggagcccgaggacaucgacugcuggugcaaccucaccagcaccugggugaccuacggcacgugcaaccaggccggggagcaccggcgcgacaagcgguccgucgcgcuggcgccccacgugggcaugggccuggacacccgcacccagaccuggaugagcgccgagggggccuggcgccagguggagaagguggagacgugggcgcuccgccacccgggcuucaccauccuggcccuguuccucgcccacuacaucgggaccucccugacccagaagguggugaucuucauccugcucaugcuggugacgcccagcaugaccaugcggugcgugggcguggggaaccgcgacuucgucgagggccuguccggcgccaccuggguggacgugguccucgagcacgggggcugcgugaccacgauggccaagaacaagcccacccuggacaucgagcugcagaagaccgaggcgacccagcucgccacgcugcggaagcugugcaucgaggggaagaucaccaacaucaccaccgacagccgcugccccacgcagggcgaggccauccucccggaggagcaggaccagaacuacgugugcaagcacaccuacgucgaccggggcugggggaacggcugcgggcuguucggcaaggggucccuggugaccugcgccaaguuccagugccucgagcccaucgagggcaaggugguccagcacgagaaccugaaguacaccgugaucaucacggugcacaccggcgaccagcaccaggucgggaacgacacccagggcgugaccgucgagaucacgccccaggccagcaccguggaggcgauccugcccgaguacgggacccucggccuggagugcuccccgcgcaccgggcuggacuucaacgagaugauccuccugaccaugaagaacaaggccuggauggugcaccggcagugguucuucgaccugccccuccccuggacgagcggcgccaccaccgagacccccacguggaaccgcaaggagcugcuggucaccuucaagaacgcccacgccaagaagcaggagguggugguccucggcucccaggagggggcgaugcacaccgcccugaccggcgccacggagauccagaacagcgggggcaccuccaucuucgccgggcaccugaagugccggcucaagauggacaagcuggagcugaagggcaugagcuacgccaugugccucaacaccuucgugcugaagaaggagguguccgagacccagcacggcacgauccugaucaaggucgaguacaagggggaggacgcgccgugcaagauccccuucagcaccgaggacggccaggggaaggcccacaacggccgccugaucaccgccaaccccguggugaccaagaaggaggagcccgucaacaucgaggccgagccgcccuucggcgagagcaacaucgugaucgggaucggcgacaaggcgcucaagaucaacugguacaagaagggguccagcaucggcaagauguucgaggccacggcccgcggggcccgccggauggccauccugggcgacaccgcgugggacuucggcuccgucggcgggguccugaacagccucgggaagauggugcaccagaucuucggguccgccuacaccgcccuguucagcgggguguccuggaucaugaagaucggcaucggcguccugcucaccuggaucgggcugaacagcaagaacacguccaugagcuucuccugcaucgugaucggcaucaucacccuguaccucggggccgugguccaggccgacaugggcugcgugaucaacuggaaggggaaggagcugaagugcggcagcggcaucuucgugaccaacgagguccacaccuggacggagcaguacaaguuccaggcggacucccccaagcgccuggccaccgccaucgccggggccugggagaacggcgugugcgggauccgcagcaccacccggauggagaaccuccuguggaagcagaucgcgaacgagcugaacuacauccucugggagaacaacaucaagcugacgguggucgugggcgacaucaucggggugcuggagcagggcaagcgcacccucacgccccagccgauggagcugaaguacuccuggaagaccuggggcaaggccaagaucgucacggccgagacccagaacagcuccuucaucaucgacgggcccaacacccccgagugccccagcgccucccgggcguggaacgugugggagguggaggacuacggcuucggggucuucaccacgaacaucuggcugaagcuccgcgagguguacacccagagcugcgaccaccggcugaugagcgccgccaucaaggacgagcgcgccgugcacgccgacaugggcuacuggaucgagucccagaagaacggcagcuggaagcuggagaaggcguccuucaucgaggucaagaccugcaccuggcccaagagccacacccucugguccaacggggugcuggagagcgacaugaucauccccaagucccuggccggccccaucagccagcacaaccaccggccgggguaccacacgcagaccgccggccccuggcaccucgggaagcuggagcuggacuucaacuacugcgagggcaccaccguggucaucacggagaacugcggcacccgcgggcccucccuccggaccaccacggugagcggcaagcugauccacgaguggugcugccgcuccugcacccugcccccgcuccgguacaugggggaggacggcugcugguacgggauggagauccgccccaucaacgagaaggaggagaacauggucaagagccuggucuccgccggcagcggcaagauggacaacuucaccauggggauccugugccucgccauccuguucgaggaggugaugcggggcaaguucgggaagaagcacaugaucgcgggcgugcuguucaccuucguccuccugcuguccgggcagaucacguggcgcgacauggcccacacccucaucaugaucggcagcaacgccuccgaccggaugggcaugggggugaccuaccuggcccugaucgccaccuucaagauccagcccuuccucgcgcugggcuucuuccugcgcaagcucacgagccgggagaaccugcugcucggggugggccuggccauggccaccacccugcagcuccccgaggacaucgagcagauggccaacggcaucgcgcuggggcugaugacccucaagcugaucacgcaguucgagaccuaccagcuguggaccgcccucgucagccugaccugcuccaacacgaucuucacccugaccguggccuggcgcaccgccacgcucauccuggccggcgugagccugcucccgcugugccaguccagcuccaugcggaagaccgacuggcugcccaugaccgucgcggccaugggggugccgccccugccgcuguucaucuucagccugaaggacacccccaagcgccgcuccuggccccucaacgagggcgucauggccguggggcuggugagcauccuggccuccagccuccugcggaacgacguccccauggccggcccgcugguggcgggcgggcuccugaucgccugcuacgugaucacgggcaccuccgccgaccugaccgucgagaaggccgccgacgugaccugggaggaggaggcggagcagacgggggugagccacaaccucaugaucaccgucgacgacgacggcaccaugcgcaucaaggacgacgagaccgagaacauccugaccgugcugcucaagacggcccugcugaucguguccgggaucuuccccuacagcauccccgccacccuccuggucuggcacaccuggcagaagcagacccagcgguccggcgugcugugggacgugcccagcccgcccgagacgcagaaggccgagcucgaggagggcgucuaccgcaucaagcagcaggggaucuucggcaagacccaggugggggugggcguccagaaggaggggguguuccacaccauguggcacgugacccggggcgccguccugacgcacaacggcaagcgccuggagcccaacugggcguccgugaagaaggaccucaucagcuacgggggcggguggcggcuguccgcccaguggcagaagggcgaggaggugcaggucaucgccguggagcccgggaagaacccgaagaacuuccagaccaugcccggcaucuuccagaccaccaugggcgagaucggggccaucgcgcuggacuucaagcccggcacgagcgggagcccgaucaucaaccgcgagggcaagguggucggccuguacgggaacggcguggugaccaagaacgggggcuacgucuccgggaucgcccagaccaacgccgagcccgacggccccacccccgagcucgaggaggagauguucaagaagcggaaccugacgaucauggaccugcacccgggcagcgggaagacccgcaaguaccuccccgccaucgugcgggaggccaucaagcgccggcugcgcacccugauccucgcgcccacccggguggucgccgccgagauggaggaggcccugaagggccugcccauccgcuaccagacgaccgccaucaaguccgagcacaccgggcgggagaucguggaccucaugugccacgcgaccuucacgaugcgccugcugagcccggugcggguccccaacuacaaccucaucaucauggacgaggcccacuucaccgaccccgccuccaucgccgcccgcggcuacaucagcacccggguggggaugggcgaggcggccgccaucuucaugaccgccacgcccccgggcaccgcggaggccuucccccaguccaacgcccccauccaggacgaggagcgcgacauccccgagcgcagcuggaacuccgggaacgaguggaucaccgacuucgugggcaagaccgucugguucgugccgagcaucaaggccgggaacgacaucgccaacugccugcggaagaacggcaagaaggugauccagcugucccgcaagacguucgacaccgaguaccagaagacccggcucaacgacugggacuucgucgugaccacggacaucagcgagaugggggcgaacuucaaggccgaccgcgugaucgacccccggcgcugccugaagcccgucauccugaccgacggccccgagcgggugauccucgccggcccgaugcccgugaccgccgccuccgcggcccagcgccgggggcgcgucggccggaacccccagaaggagaacgaccaguacaucuucaccgggcagccccugaacaacgacgaggaccacgcccacuggacggaggccaagaugcugcucgacaacaucaacaccccggagggcaucauccccgcccuguucgagcccgagcgcgagaaguccgcggccaucgacggggaguaccggcugaagggcgagucccgcaagaccuucguggagcucaugcggcgcggcgaccugcccguguggcuggcccacaaggucgccagcgaggggaucaaguacaccgaccggaaguggugcuucgacggcgagcgcaacaaccagauccucgaggagaacauggacguggagaucuggaccaaggagggggagcggaagaagcugcgcccgcgcuggcuggacgcgcggacguacuccgacccccucgcccugaaggaguucaaggacuucgccgccggccgcaagagcaucgcccuggaccucgucaccgagaucggccgggugcccucccaccuggcgcaccgcacccggaacgcccuggacaaccucgugaugcugcacaccagcgagcacgggggccgcgccuaccggcacgccgucgaggagcugccggagacgauggagacccuccugcugcucgggcugaugauccugcucaccggcggggccaugcuguuccugaucagcggcaagggcaucgggaagaccuccaucggccucaucugcgugaucgugagcuccgggaugcuguggauggcggacgucccccugcaguggaucgccagcgccaucgugcucgaguucuucaugauggugcugcugauccccgagcccgagaagcagcgcacgccgcaggacaaccagcucgccuacgucgugaucggcauccugacccuggccgcgaucgugaccgccaacgagauggggcuccuggagaccacgaagcgggaccugggcauguccaaggagcccggcgucgugagccccaccuccuaccucgacguggaccugcaccccgccagcgccuggacccuguacgccgucgcgaccacggugaucaccccgaugcuccgccacaccaucgagaacuccaccgccaacgugagccuggccgccaucgcgaaccaggccgucgugcugauggggcucgacaagggcuggcccaucuccaagauggaccugggggugccccugcucgcccugggcugcuacagccaggucaacccccugacgcucaccgccgccgugcugcugcucgugacccacuacgcgaucaucgggccgggccugcaggccaaggccacccgggaggcccagaagcgcacggccgcgggcaucaugaagaaccccaccgucgacgggaucaugaccaucgaccuggaccccgugaucuacgacuccaaguucgagaagcagcucggccaggugaugcugcugguccucugcgccgugcagcugcugcucaugcggaccagcugggcccugugcgaggcccugacgcucgccaccgggcccaucaccacccugugggagggcuccccgggcaaguucuggaacacgaccaucgcggugagcauggccaacaucuuccgcggguccuaccuggccggcgccgggcucgcguucagcaucaugaaguccgucggcaccgggaagcggggcaccggcagccagggggagacgcugggcgagaaguggaagaagaagcugaaccagcucagccgcaaggaguucgaccuguacaagaaguccgggaucaccgagguggaccggaccgaggccaaggagggccugaagcgcggggagaccacccaccacgccgugagccggggcuccgccaagcuccagugguucgucgagcgcaacauggugauccccgagggccgggugaucgaccuggggugcggccgcgggggcuggagcuacuacugcgccgggcugaagaaggucacggaggugcgcggcuacaccaagggcgggcccggccacgaggagcccgugccgauguccaccuacggguggaacaucgucaagcucaugagcggcaaggacguguucuaccugccgcccgagaagugcgacacccugcugugcgacaucggggaguccagccccuccccgacgguggaggagagccggaccauccgcguccucaagaugguggagcccuggcugaagaacaaccaguucugcaucaaggugcugaaccccuacaugcccaccgucaucgagcaccucgagcggcugcagcgcaagcacggcggcaugcuggugcggaacccgcucucccgcaacagcacccacgagauguacuggaucuccaacgggacgggcaacaucgugagcuccgucaacauggugagccggcugcugcucaaccgcuucaccaugacccaccggcgccccaccaucgagaaggacguggaccugggggcgggcacgcggcacgucaacgccgagcccgagaccccgaacauggacgugaucggcgagcgcaucaagcggaucaaggaggagcacuccagcaccuggcacuacgacgacgagaaccccuacaagaccugggccuaccacggguccuacgaggucaaggccacgggcagcgccagcuccaugaucaacgggguggugaagcugcucaccaagcccugggacgucgugcccauggugacccagauggcgaugaccgacacgaccccguucggccagcagcgcgucuucaaggagaagguggacacccggacgccccggcccaugcccgggacgcggaaggugauggagaucaccgccgaguggcuguggcgcacccugggccggaacaagcgcccgcgccucugcacccgggaggaguucacgaagaagguccgcaccaacgccgccaugggcgccguguucaccgaggagaaccagugggacagcgcgcgggccgccguggaggacgaggaguucuggaagcuggucgaccgcgagcgggagcugcacaagcucgggaagugcggcuccugcguguacaacaugauggggaagcgcgagaagaagcugggcgaguucgggaaggccaagggcagccgggcgaucugguacauguggcugggcgcccgcuaccucgaguucgaggcccugggguuccugaacgaggaccacugguucucccgggagaacagcuacuccggcguggagggggagggccuccacaagcugggguacauccugcgcgacaucagcaagauccccggcggcgccauguacgccgacgacaccgcggggugggacacgcggaucaccgaggacgaccuccacaacgaggagaagaucacccagcagauggaccccgagcaccgccagcuggccaacgccaucuucaagcugaccuaccagaacaaggucgugaaggugcagcggcccacgccgaagggcaccgucauggacaucaucucccgcaaggaccagcgggggagcggccaggugggcaccuacgggcucaacaccuucaccaacauggaggcccagcuggugcgccagauggagggcgaggggguccuguccaagguggaccucgagaacccccaccuccuggagaagaagaucacgcaguggcucgagaccaagggcguggagcggcugcgccggauggccaucagcggggacgacugcgucgugaagcccaucgacgaccgcuucgcgaacgcccugcucgcccugaacgacaugggcaaggugcggaaggacaucccccaguggcagccguccaagggcuggcacgacuggcagcagguccccuucugcagccaccacuuccacgagcugaucaugaaggacgggcgcaagcucguggugcccugccgcccccaggacgagcugaucggccgggcccgcaucucccagggggccggcuggagccugaaggagaccgcgugccucgggaaggccuacgcccagauguggucccugauguacuuccaccggcgcgaccugcggcucgccagcaacgccaucugcuccgcggucccggugcacugggugcccaccagccgcacgaccuggagcauccacgcccaccaccaguggaugaccaccgaggacaugcugacggucuggaaccggguguggaucgaggacaaccccuggauggaggacaagacccccgugaccaccugggaggacgucccguaccugggcaagcgcgaggaccaguggugcggcucccucaucgggcugacgagccgggccaccugggcccagaacauccugaccgcgauccagcagguccgcucccucaucggcgacgaggaguuccuggacuacaugcccagcaugaagcgguuccgcaaggaggaggaguccgagggggccaucugguga

SEQ ID NO: 10121 - RNA, 9873 nt, Artificial Sequence
  derived and/or modified CDS sequence (opt1) from DENV-3__FJ744737__SS-prME
accagccugugccucaugaugaugcugcccgccacccuggccuuccaccucaccagccgggacggcgagccgcggaugaucguggccaagaacgagcgcggcaagagccugcuguucaagaccgccuccggcaucaacaugugcacccucaucgccauggaccugggggagaugugcgacgacaccgugaccuacaagugcccccugaucgccgagguggagcccgaggacaucgacugcuggugcaaccucaccagcaccugggugaccuacggcacgugcaaccaggccggggagcaccggcgcgacaagcgguccgucgcgcuggcgccccacgugggcaugggccuggacacccgcacccagaccuggaugagcgccgagggggccuggcggcaggucgagaagguggagacgugggcgcuccgccacccgggcuucaccauccuggcccuguuccucgcccacuacaucgggaccucccugacccagaagguggugaucuucauccugcucaugcuggugacgcccagcaugaccaugcggugcgugggcguggggaaccgcgacuucguggagggccuguccggcgccaccuggguggacgugguccucgagcacgggggcugcgugaccacgauggccaagaacaagcccacccuggacaucgagcugcagaagaccgaggcgacccagcucgccacgcugcggaagcugugcaucgaggggaagaucaccaacaucaccaccgacagccgcugccccacgcagggcgaggccauccucccggaggagcaggaccagaacuacgugugcaagcacaccuacgucgaccggggcugggggaacggcugcgggcuguucggcaaggggucccuggugaccugcgccaaguuccagugccucgagcccaucgagggcaaggugguccagcacgagaaccugaaguacaccgugaucaucacggugcacaccggcgaccagcaccaggucgggaacgacacccagggcgugaccgccgagaucacgccccaggcgagcaccgucgaggccauccugcccgaguacgggacccucggccuggagugcuccccgcgcaccgggcuggacuucaacgagaugauccuccugaccaugaagaacaaggccuggauggugcaccggcagugguucuucgaccugccccuccccuggacgagcggcgccaccaccgagacccccacguggaaccgcaaggagcugcuggugaccuucaagaacgcccacgcgaagaagcaggaggucguggugcucggcucccaggagggggccaugcacaccgcccugaccggcgccacggagauccagaacagcgggggcaccuccaucuucgccgggcaccugaagugccggcucaagauggacaagcuggagcugaagggcaugagcuacgcgaugugccucaacaccuucguccugaagaaggagguguccgagacccagcacggcacgauccugaucaagguggaguacaagggggaggacgccccgugcaagauccccuucagcaccgaggacggccaggggaaggcccacaacggccgccugaucaccgccaaccccgucgugaccaagaaggaggagcccgugaacaucgaggcggagccgcccuucggcgagagcaacaucgucaucgggaucggcgacaaggcccucaagaucaacugguacaagaagggguccagcaucggcaagauguucgaggccacggcccgcggggcccgccggauggcgauccugggcgacaccgccugggacuucggcuccgucggcggggugcugaacagccucgggaagaugguccaccagaucuucggguccgccuacaccgcccuguucagcgggguguccuggaucaugaagaucggcaucggcgugcugcucaccuggaucgggcugaacagcaagaacacguccaugagcuucuccugcaucgucaucggcaucaucacccuguaccucggggccguggugcaggcggacaugggcugcgucaucaacuggaaggggaaggagcugaagugcggcagcggcaucuucgugaccaacgaggugcacaccuggacggagcaguacaaguuccaggccgacucccccaagcgccuggccaccgccaucgccggggcgugggagaacggcgucugcgggauccgcagcaccacccggauggagaaccuccuguggaagcagaucgccaacgagcugaacuacauccucugggagaacaacaucaagcugacggugguggucggcgacaucaucggggugcuggagcagggcaagcgcacccucacgccccagccgauggagcugaaguacuccuggaagaccuggggcaaggccaagaucgugacggccgagacccagaacagcuccuucaucaucgacgggcccaacacccccgagugccccagcgcgucccgggccuggaacgucugggagguggaggacuacggcuucgggguguucaccacgaacaucuggcugaagcuccgcgaggucuacacccagagcugcgaccaccggcugaugagcgccgccaucaaggacgagcgcgccgugcacgcggacaugggcuacuggaucgagucccagaagaacggcagcuggaagcuggagaaggccuccuucaucgaggugaagaccugcaccuggcccaagagccacacccucugguccaacgggguccuggagagcgacaugaucauccccaagucccuggccggccccaucagccagcacaaccaccggccgggguaccacacgcagaccgccggccccuggcaccucgggaagcuggagcuggacuucaacuacugcgagggcaccaccguggugaucacggagaacugcggcacccgcgggcccucccuccggaccaccacggucagcggcaagcugauccacgaguggugcugccgcuccugcacccugcccccgcuccgguacaugggggaggacggcugcugguacgggauggagauccgccccaucaacgagaaggaggagaacauggucaagagccugguguccgccggcagcggcaagauggacaacuucaccauggggauccugugccucgcgauccuguucgaggaggucaugcggggcaaguucgggaagaagcacaugaucgccggcgugcuguucaccuucgugcuccugcuguccgggcagaucacguggcgcgacauggcccacacccucaucaugaucggcagcaacgccuccgaccggaugggcaugggggucaccuaccuggcccugaucgcgaccuucaagauccagcccuuccucgcccugggcuucuuccugcgcaagcucacgagccgggagaaccugcugcucggggugggccuggccauggccaccacccugcagcuccccgaggacaucgagcagauggcgaacggcaucgcccuggggcugaugacccucaagcugaucacgcaguucgagaccuaccagcuguggaccgcccucgugagccugaccugcuccaacacgaucuucacccugaccgucgccuggcgcaccgccacgcucauccuggcgggcgugagccugcucccgcugugccaguccagcuccaugcggaagaccgacuggcugcccaugaccguggccgccaugggggugccgccccugccgcuguucaucuucagccugaaggacacccccaagcgccgcuccuggccccucaacgagggcgugauggccgucgggcuggugagcauccuggccuccagccuccugcggaacgacgugcccauggcgggcccgcuggucgccggcgggcuccugaucgccugcuacgugaucacgggcaccuccgccgaccugaccguggagaaggccgcggacgucaccugggaggaggaggccgagcagacgggggugagccacaaccucaugaucaccguggacgacgacggcaccaugcgcaucaaggacgacgagaccgagaacauccugaccguccugcucaagacggcccugcugaucguguccgggaucuuccccuacagcauccccgccacccuccugguguggcacaccuggcagaagcagacccagcgguccggcguccugugggacgugcccagcccgcccgagacgcagaaggccgagcucgaggagggcguguaccgcaucaagcagcaggggaucuucggcaagacccaggucggggugggcgugcagaaggagggggucuuccacaccauguggcacgugacccggggcgcggugcugacgcacaacggcaagcgccuggagcccaacugggccuccgucaagaaggaccucaucagcuacgggggcggguggcggcuguccgcccaguggcagaagggcgaggagguccaggugaucgccgucgagcccgggaagaacccgaagaacuuccagaccaugcccggcaucuuccagaccaccacgggcgagaucggggcgaucgcccuggacuucaagcccggcaccagcgggagcccgaucaucaaccgcgagggcaagguggugggccuguacgggaacggcgucgugaccaagaacgggggcuacguguccgggaucgcccagaccaacgccgagcccgacggccccacgcccgagcucgaggaggagauguucaagaagcggaaccugaccaucauggaccugcacccgggcagcgggaagacccgcaaguaccuccccgccaucguccgggaggcgaucaagcgccggcugcgcacccugauccucgcccccacgcgggugguggccgccgagauggaggaggcccugaagggccugcccauccgcuaccagaccaccgcgaucaaguccgagcacaccgggcgggagaucgucgaccucaugugccacgccacguucaccaugcgccugcugagcccggugcgggugcccaacuacaaccucaucaucauggacgaggcccacuucaccgaccccgccuccaucgccgcgcgcggcuacaucagcacccgggucgggaugggcgaggccgccgccaucuucaugacggcgacgccgcccggcaccgccgaggccuucccccaguccaacgcccccauccaggacgaggagcgcgacauccccgagcgcagcuggaacuccgggaacgaguggaucaccgacuucgugggcaagacggugugguucguccccagcaucaaggccgggaacgacaucgcgaacugccugcggaagaacggcaagaaggugauccagcugucccgcaagaccuucgacaccgaguaccagaagacccggcucaacgacugggacuucguggucacgaccgacaucagcgagaugggggccaacuucaaggccgaccgcgugaucgacccccggcgcugccugaagcccgugauccugaccgacggccccgagcgggucauccucgccggcccgaugcccgugaccgccgcguccgccgcccagcgccgggggcgcgugggccggaacccccagaaggagaacgaccaguacaucuucacggggcagccccugaacaacgacgaggaccacgcccacuggaccgaggccaagaugcugcucgacaacaucaacaccccggagggcaucauccccgcgcuguucgagcccgagcgcgagaaguccgccgccaucgacggggaguaccggcugaagggcgagucccgcaagaccuucgucgagcucaugcggcgcggcgaccugcccguguggcuggcccacaagguggcgagcgaggggaucaaguacaccgaccggaaguggugcuucgacggcgagcgcaacaaccagauccucgaggagaacauggacgucgagaucuggacgaaggagggggagcggaagaagcugcgcccgcgcuggcuggacgcccggaccuacuccgacccccucgcccugaaggaguucaaggacuucgccgccggccgcaagagcaucgcgcuggaccucgugaccgagaucggccggguccccucccaccuggcccaccgcacccggaacgcccuggacaaccucgugaugcugcacacgagcgagcacgggggccgcgccuaccggcacgccguggaggagcugccggagaccauggagacccuccugcugcucgggcugaugauccugcucaccggcggggcgaugcuguuccugaucagcggcaagggcaucgggaagacguccaucggccucaucugcgucaucgugagcuccgggaugcuguggauggccgacgugccccugcaguggaucgccagcgccaucguccucgaguucuucaugauggugcugcugauccccgagcccgagaagcagcgcaccccgcaggacaaccagcucgccuacguggucaucggcauccugacccuggcggccaucgugaccgccaacgagauggggcuccuggagacgaccaagcgggaccugggcauguccaaggagcccggcguggucagccccaccuccuaccucgacguggaccugcaccccgccagcgccuggacccuguacgcgguggccacgaccgucaucaccccgaugcuccgccacaccaucgagaacuccacggccaacgugagccuggccgcgaucgccaaccaggccgugguccugauggggcucgacaagggcuggcccaucuccaagauggaccugggggugccccugcucgcccugggcugcuacagccaggugaacccccugacccucaccgccgcgguccugcugcucgugacccacuacgccaucaucgggccgggccugcaggccaaggccacgcgggaggcccagaagcgcaccgcggccggcaucaugaagaaccccaccguggacgggaucaugaccaucgaccuggaccccgucaucuacgacuccaaguucgagaagcagcucggccaggugaugcugcuggugcucugcgccguccagcugcugcucaugcggacgagcugggcccugugcgaggcccugacccucgcgaccgggcccaucaccacgcugugggagggcuccccgggcaaguucuggaacaccaccaucgccgugagcauggccaacaucuuccgcggguccuaccuggccggcgcggggcucgccuucagcaucaugaaguccgugggcaccgggaagcggggcacgggcagccagggggagacccugggcgagaaguggaagaagaagcugaaccagcucagccgcaaggaguucgaccuguacaagaaguccgggaucaccgaggucgaccggaccgaggccaaggagggccugaagcgcggggagaccacgcaccacgccgugagccggggcuccgccaagcuccagugguucguggagcgcaacauggucauccccgagggccgggugaucgaccuggggugcggccgcgggggcuggagcuacuacugcgcggggcugaagaaggugaccgagguccgcggcuacaccaagggcgggcccggccacgaggagcccgugccgauguccaccuacggguggaacaucgugaagcucaugagcggcaaggacgucuucuaccugccgcccgagaagugcgacacgcugcugugcgacaucggggaguccagccccuccccgaccguggaggagagccggaccauccgcgugcucaagauggucgagcccuggcugaagaacaaccaguucugcaucaaggugcugaaccccuacaugcccaccgugaucgagcaccucgagcggcugcagcgcaagcacggcggcaugcugguccggaacccgcucucccgcaacagcacgcacgagauguacuggaucuccaacgggaccggcaacaucgugagcuccgugaacauggucagccggcugcugcucaaccgcuucaccaugacccaccggcgccccacgaucgagaaggacguggaccugggggccggcacccggcacgugaacgccgagcccgagaccccgaacauggacgucaucggcgagcgcaucaagcggaucaaggaggagcacuccagcaccuggcacuacgacgacgagaaccccuacaagacgugggccuaccacggguccuacgaggugaaggccaccggcagcgcgagcuccaugaucaacggggucgugaagcugcucaccaagcccugggacgugguccccauggugacccagauggccaugacggacaccaccccguucggccagcagcgcguguucaaggagaaggucgacacccggacgccccgccccaugcccgggacccggaaggugauggagaucaccgccgaguggcuguggcgcacccugggccggaacaagcgcccgcgccucugcacgcgggaggaguucaccaagaaggugcgcaccaacgccgccaugggcgcggucuucaccgaggagaaccagugggacagcgcccgggccgccguggaggacgaggaguucuggaagcugguggaccgcgagcgggagcugcacaagcucgggaagugcggcuccugcgucuacaacaugauggggaagcgcgagaagaagcugggcgaguucgggaaggcgaagggcagccgggccaucugguacauguggcugggcgcccgcuaccucgaguucgaggcccugggguuccugaacgaggaccacugguucucccgggagaacagcuacuccggcguggagggggagggccuccacaagcugggguacauccugcgcgacaucagcaagauccccggcggcgccauguacgcggacgacacggccgggugggacacccggaucaccgaggacgaccuccacaacgaggagaagaucacccagcagauggaccccgagcaccgccagcuggccaacgccaucuucaagcugacguaccagaacaagguggucaaggugcagcggcccaccccgaagggcaccgugauggacaucaucucccgcaaggaccagcgggggagcggccaggucggcaccuacgggcucaacaccuucacgaacauggaggcccagcuggugcgccagauggagggcgagggggugcuguccaaggucgaccucgagaacccccaccuccuggagaagaagaucacccaguggcucgagaccaagggcguggagcggcugcgccggauggcgaucagcggggacgacugcguggucaagcccaucgacgaccgcuucgccaacgcccugcucgcccugaacgacaugggcaaggugcggaaggacaucccccaguggcagccguccaagggcuggcacgacuggcagcagguccccuucugcagccaccacuuccacgagcugaucaugaaggacgggcgcaagcucgucgugcccugccgcccccaggacgagcugaucggccgggcccgcaucucccagggggcgggcuggagccugaaggagaccgccugccucgggaaggccuacgcccagauguggucccugauguacuuccaccggcgcgaccugcggcucgccagcaacgcgaucugcuccgccgugccgguccacugggugcccacgagccgcaccaccuggagcauccacgcccaccaccaguggaugaccacggaggacaugcugaccguguggaaccgggucuggaucgaggacaaccccuggauggaggacaagacccccgugaccacgugggaggacgugccguaccugggcaagcgcgaggaccaguggugcggcucccucaucgggcugaccagccgggccaccugggcgcagaacauccugaccgccauccagcagguccgcucccucaucggcgacgaggaguuccuggacuacaugcccagcaugaagcgguuccgcaaggaggaggaguccgagggggccaucugguga

SEQ ID NO: 10122 - RNA, 9873 nt, Artificial Sequence
  derived and/or modified CDS sequence (opt1) from DENV-3__FJ744739__SS-prME
accagccugugccucaugaugaugcugcccgccacccuggccuuccaccucaccagccgggacggggagccgcggaugaucguggcgaagaacgagcgcggcaagagccugcuguucaagaccguguccggcaucaacaugugcacccucaucgccauggaccugggggagaugugcgacgacaccgugaccuacaagugcccccugaucgccgagguggagcccgaggacaucgacugcuggugcaaccucaccagcaccugggucaccuacggcacgugcaaccaggccggggagcaccggcgcgacaagcgguccguggcccuggcgccccacgugggcaugggccuggacacccgcacccagaccuggaugagcgccgagggggccuggcggcaggucgagaagguggagacgugggcccuccgccacccgggcuucaccauccuggcgcuguuccucgcccacuacaucgggaccucccugacccagaagguggucaucuucauccugcucaugcuggugacgcccagcaugaccaugcggugcgugggcgucgggaaccgcgacuucguggagggccuguccggcgccaccuggguggacgucgugcucgagcacgggggcugcgugaccacgauggccaagaacaagcccacccuggacaucgagcugcagaagaccgaggccacccagcucgcgacgcugcggaagcugugcaucgaggggaagaucaccaacaucaccaccgacagccgcugccccacgcagggcgaggccauccucccggaggagcaggaccagaacuacgucugcaagcacaccuacguggaccggggcugggggaacggcugcgggcuguucggcaaggggucccuggugaccugcgccaaguuccagugccucgagcccaucgagggcaaggucgugcagcacgagaaccugaaguacaccgugaucaucacgguccacaccggcgaccagcaccagguggggaacgacacccagggcgucaccguggagaucacgccccaggccagcaccguggaggccauccugcccgaguacgggacccucggccuggagugcuccccgcgcaccgggcuggacuucaacgagaugauccuccugaccaugaagaacaaggcguggaugguccaccggcagugguucuucgaccugccccuccccuggacgagcggcgccaccaccgagacccccacguggaaccgcaaggagcugcuggugaccuucaagaacgcccacgccaagaagcaggagguggucgugcucggcucccaggagggggccaugcacaccgcgcugaccggcgccacggagauccagaacagcgggggcaccuccaucuucgccgggcaccugaagugccggcucaagauggacaagcuggagcugaagggcaugagcuacgccaugugccucaacaccuucgugcugaagaaggaggucuccgagacccagcacggcacgauccugaucaagguggaguacaagggggaggacgccccgugcaagauccccuucagcaccgaggacggccaggggaaggcgcacaacggccgccugaucaccgccaaccccguggucaccaagaaggaggagcccgugaacaucgaggccgagccgcccuucggcgagagcaacaucgugaucgggaucggcgacaaggcccucaagaucaacugguacaagaagggguccagcaucggcaagauguucgaggcgacggcccgcggggcccgccggauggccauccugggcgacaccgccugggacuucggcuccgucgggggcgugcugaacagccucgggaagauggugcaccagaucuucggcuccgcguacaccgcccuguucagcggggucuccuggaucaugaagaucggcaucggcgugcugcucaccuggaucgggcugaacagcaagaacacguccaugagcuucuccugcaucgugaucggcaucaucacccuguaccucggggccgucgugcaggccgacaugggcugcgugaucaacuggaaggggaaggagcugaagugcggcagcggcaucuucgucaccaacgaggugcacaccuggacggagcaguacaaguuccaggccgacucccccaagcgccuggcgaccgccaucgccggggccugggagaacggcgugugcgggauccgcagcaccacccggauggagaaccuccuguggaagcagaucgccaacgagcugaacuacauccucugggagaacaacaucaagcugacggucguggugggcgacaucaucgggguccuggagcagggcaagcgcacccucacgccccagccgauggagcugaaguacuccuggaagaccuggggcaaggcgaagaucgugacggccgagacccagaacagcuccuucaucaucgacgggcccaacacccccgagugccccagcgccucccgggccuggaacgugugggaggucgaggacuacggcuucgggguguucaccacgaacaucuggcugaagcuccgcgagguguacacccagagcugcgaccaccggcugaugagcgcggccaucaaggacgagcgcgccguccacgccgacaugggcuacuggaucgagucccagaagaacggcagcuggaagcuggagaaggccuccuucaucgaggugaagaccugcaccuggcccaagagccacacccucugguccaacggggugcuggagagcgacaugaucauccccaagucccuggcgggccccaucagccagcacaaccaccggccgggguaccacacgcagaccgccggccccuggcaccucgggaagcuggagcuggacuucaacuacugcgagggcaccaccgucgugaucacggagaacugcggcacccgcgggcccucccuccggaccaccacggugagcggcaagcugauccacgaguggugcugccgcuccugcacccugcccccgcuccgguacaugggggaggacggcugcugguacgggauggagauccgccccaucaacgagaaggaggagaacauggucaagagccugguguccgccggcagcggcaagauggacaacuucaccauggggauccugugccucgccauccuguucgaggaggugaugcggggcaaguucgggaagaagcacaugaucgccggcguccuguucaccuucgugcuccugcuguccgggcagaucacguggcgcgacauggcgcacacccucaucaugaucggcagcaacgccuccgaccggaugggcaugggggugaccuaccuggcccugaucgccaccuucaagauccagcccuuccucgcccugggcuucuuccugcgcaagcucacgagccgggagaaccugcugcucggggucggccuggcgauggccaccacccugcagcuccccgaggacaucgagcagauggccaacggcaucgcccuggggcugaugacccucaagcugaucacgcaguucgagaccuaccagcuguggaccgcgcucgugagccugaccugcuccaacacgaucuucacccugaccguggccuggcgcaccgccacgcucauccuggccggcgucagccugcucccgcugugccaguccagcuccaugcggaagaccgacuggcugcccaugaccguggccgcgaugggggugccgccccugccgcuguucaucuucagccugaaggacacccccaagcgccgcuccuggccccucaacgagggcgugauggccguggggcuggucagcauccuggccuccagccuccugcggaacgacgugcccauggccggcccgcugguggccggcgggcuccugaucgcgugcuacgucaucacgggcaccuccgccgaccugaccguggagaaggccgccgacgugaccugggaggaggaggccgagcagacgggggucagccacaaccucaugaucaccguggacgacgacggcaccaugcgcaucaaggacgacgagaccgagaacauccugaccgugcugcucaagacggcgcugcugaucgucuccgggaucuuccccuacagcauccccgccacccuccugguguggcacaccuggcagaagcagacccagcgguccggcgugcugugggacguccccagcccgcccgagacgcagaaggccgagcucgaggagggcguguaccgcaucaagcagcaggggaucuucggcaagacccaggugggggucggcgugcagaaggaggggguguuccacaccauguggcacgucacccggggcgccgugcugacgcacaacggcaagcgccuggagcccaacugggccuccgugaagaaggaccucaucagcuacgggggcggguggcggcuguccgcgcaguggcagaagggcgaggagguccaggugaucgccguggagcccgggaagaacccgaagaacuuccagaccaugcccggcaucuuccagaccaccacgggcgagaucggggccaucgcccuggacuucaagcccggcaccagcgggagcccgaucaucaaccgcgagggcaaggucgugggccuguacgggaacggcguggucaccaagaacgggggcuacguguccgggaucgcgcagaccaacgccgagcccgacggccccacgcccgagcucgaggaggagauguucaagaagcggaaccugaccaucauggaccugcacccgggcagcgggaagacccgcaaguaccuccccgccaucgugcgggaggccaucaagcgccggcugcgcacccugauccucgcccccacgcgggucguggcggccgagauggaggaggcccugaagggccugcccauccgcuaccagaccaccgccaucaaguccgagcacaccgggcgggagaucguggaccucaugugccacgccacguucaccaugcgccugcugagcccgguccgggugcccaacuacaaccucaucaucauggacgaggcgcacuucaccgaccccgccuccaucgccgcccgcggcuacaucagcacccggguggggaugggcgaggccgcggccaucuucaugacggccacgccgcccggcaccgccgaggcguucccccaguccaacgcccccauccaggacgaggagcgcgacauccccgagcgcagcuggaacuccgggaacgaguggaucaccgacuucgucggcaagacggugugguucgugcccagcaucaaggccgggaacgacaucgccaacugccugcggaagaacggcaagaaggucauccagcugucccgcaagaccuucgacaccgaguaccagaagacccggcucaacgacugggacuucguggugacgaccgacaucagcgagaugggggccaacuucaaggcggaccgcgucaucgacccccggcgcugccugaagcccgugauccugaccgacggccccgagcgggugauccucgccggcccgaugcccgucaccgccgccuccgccgcgcagcgccgggggcgcgugggccggaacccccagaaggagaacgaccaguacaucuucacggggcagccccugaacaacgacgaggaccacgcccacuggaccgaggccaagaugcugcucgacaacaucaacaccccggagggcaucauccccgcccuguucgagcccgagcgcgagaaguccgccgcgaucgacggggaguaccggcugaagggcgagucccgcaagaccuucguggagcucaugcggcgcggcgaccugcccgucuggcuggcccacaagguggccagcgaggggaucaaguacaccgaccggaaguggugcuucgacggcgagcgcaacaaccagauccucgaggagaacauggacgucgagaucuggacgaaggagggggagcggaagaagcugcgcccgcgcuggcuggacgcccggaccuacuccgacccccucgcgcugaaggaguucaaggacuucgccgccggccgcaagagcaucgcccuggaccucgugaccgagaucggccgggugcccucccaccuggcccaccgcacccggaacgcgcuggacaaccucgucaugcugcacacgagcgagcacgggggccgcgccuaccggcacgccguggaggagcugccggagaccauggagacccuccugcugcucgggcugaugauccugcucaccggcggggccaugcuguuccugaucagcggcaagggcaucgggaagacguccaucggccucaucugcgugaucgucagcuccgggaugcuguggauggccgacgugccccugcaguggaucgcgagcgccaucgugcucgaguucuucaugaugguccugcugauccccgagcccgagaagcagcgcaccccgcaggacaaccagcucgccuacguggugaucggcauccugacccuggccgccaucgucaccgcgaacgagauggggcuccuggagacgaccaagcgggaccugggcauguccaaggagcccggcguggugagccccaccuccuaccucgacgucgaccugcaccccgccagcgccuggacccuguacgccguggccacgaccgugaucaccccgaugcuccgccacaccaucgagaacuccacggcgaacgucagccuggccgccaucgccaaccaggcgguggugcugauggggcucgacaagggcuggcccaucuccaagauggaccugggggucccccugcucgcccugggcugcuacagccaggugaacccccugacccucaccgccgccgugcugcugcucgucacccacuacgccaucaucgggccgggccugcaggcgaaggccacgcgggaggcccagaagcgcaccgccgccggcaucaugaagaaccccaccguggacgggaucaugaccaucgaccuggaccccgugaucuacgacuccaaguucgagaagcagcucggccaggucaugcugcuggugcucugcgcggugcagcugcugcucaugcggacgagcugggcccugugcgaggcccugacccucgccaccgggcccaucaccacgcugugggagggcuccccgggcaaguucuggaacaccaccaucgccgucagcauggcgaacaucuuccgcggguccuaccuggccggcgccgggcucgccuucagcaucaugaaguccgugggcaccgggaagcggggcacgggcagccagggggagacccugggcgagaaguggaagaagaagcugaaccagcucagccgcaaggaguucgaccuguacaagaaguccgggaucaccgagguggaccggaccgaggcgaaggagggccugaagcgcggggagaccacgcaccacgccgucagccggggcuccgccaagcuccagugguucguggagcgcaacauggugauccccgagggccgggucaucgaccuggggugcggccgcgggggcuggagcuacuacugcgccgggcugaagaaggugaccgaggugcgcggcuacaccaagggcgggcccggccacgaggagcccgucccgauguccaccuacggguggaacaucgugaagcucaugagcggcaaggacguguucuaccugccgcccgagaagugcgacacgcugcugugcgacaucggggaguccagccccuccccgaccgucgaggagagccggaccauccgcgugcucaagaugguggagcccuggcugaagaacaaccaguucugcaucaagguccugaaccccuacaugcccaccgugaucgagcaccucgagcggcugcagcgcaagcacggcggcaugcuggugcggaacccgcucucccgcaacagcacgcacgagauguacuggaucuccaacgggaccggcaacaucgucagcuccgugaacauggugagccggcugcugcucaaccgcuucaccaugacccaccggcgccccacgaucgagaaggacgucgaccugggggccggcacccggcacgugaacgcggagcccgagaccccgaacauggacgucaucggcgagcgcaucaagcggaucaaggaggagcacuccagcaccuggcacuacgacgacgagaaccccuacaagacgugggccuaccacggguccuacgaggugaaggccaccggcagcgccagcuccaugaucaacgggguggucaagcugcucaccaagcccugggacguggugcccauggucacccagauggccaugacggacaccaccccguucggccagcagcgcguguucaaggagaagguggacacccggacgccccgccccaugcccgggacccggaaggucauggagaucaccgcggaguggcuguggcgcacccugggccggaacaagcgcccgcgccucugcacgcgggaggaguucaccaagaaggugcgcaccaacgccgccaugggcgccguguucaccgaggagaaccagugggacagcgcccgggcggccgucgaggacgaggaguucuggaagcugguggaccgcgagcgggagcugcacaagcucgggaagugcggcuccugcguguacaacaugauggggaagcgcgagaagaagcugggcgaguucgggaaggccaagggcagccgggccaucugguacauguggcugggcgcgcgcuaccucgaguucgaggcccugggguuccugaacgaggaccacugguucucccgggagaacagcuacuccggcgucgagggggagggccuccacaagcugggguacauccugcgcgacaucagcaagauccccggcggcgccauguacgccgacgacacggccgggugggacacccggaucaccgaggacgaccuccacaacgaggagaagaucacccagcagauggaccccgagcaccgccagcuggcgaacgccaucuucaagcugacguaccagaacaagguggugaagguccagcggcccaccccgaagggcaccgugauggacaucaucucccgcaaggaccagcgggggagcggccaggugggcaccuacgggcucaacaccuucacgaacauggaggcccagcugguccgccagauggagggcgagggggugcuguccaagguggaccucgagaacccccaccuccuggagaagaagaucacccaguggcucgagaccaagggcgucgagcggcugcgccggauggccaucagcggggacgacugcguggugaagcccaucgacgaccgcuucgccaacgcgcugcucgcccugaacgacaugggcaagguccggaaggacaucccccaguggcagccguccaagggcuggcacgacuggcagcagguccccuucugcagccaccacuuccacgagcugaucaugaaggacgggcgcaagcucgugguccccugccgcccccaggacgagcugaucggccgggcccgcaucucccagggggccggcuggagccugaaggagaccgccugccucgggaaggcguacgcccagauguggucccugauguacuuccaccggcgcgaccugcggcucgccagcaacgccaucugcuccgccgugccggugcacuggguccccacgagccgcaccaccuggagcauccacgcgcaccaccaguggaugaccacggaggacaugcugaccguguggaaccggguguggaucgaggacaaccccuggauggaggacaagacccccgucaccacgugggaggacgugccguaccugggcaagcgcgaggaccaguggugcggcuccuucaucgggcucaccagccgggccaccugggcccagaacauccugaccgccauccagcagguccgcucccugaucggcgacgaggaguuccucgacuacaugcccagcaugaagcgguuccgcaaggaggaggaguccgagggggcgaucugguga

SEQ ID NO: 10123 - RNA, 9873 nt, Artificial Sequence
  derived and/or modified CDS sequence (opt1) from DENV-3__FJ744740__SS-prME
accagccugugccucaugaugaugcugcccgccacccuggccuuccaccucaccagccgggacggggagccgcggaugaucguggccaagaacgagcggggcaagagccugcuguucaagaccgccuccggcaucaacaugugcacccucaucgccauggaccugggggagaugugcgacgacaccgugaccuacaagugcccccugaucgccgagguggagcccgaggacaucgacugcuggugcaaccucaccagcaccugggugaccuacggcacgugcaaccaggccggggagcaccggcgcgacaagcgguccgucgcgcuggcgccccacgugggcaugggccuggacacccgcacccagaccuggaugagcgccgagggggccuggcgccagguggagaagguggagacgugggcgcuccgccacccgggcuucaccauccuggcccuguuccucgcccacuacaucgggaccucccugacccagaagguggugaucuucauccugcucaugcuggucacgcccagcaugaccaugcggugcgugggcguggggaaccgcgacuucgucgagggccuguccggcgccaccuggguggacgugguccucgagcacgggggcugcgugaccacgaucgccaagaacaagcccacccuggacaucgagcugcagaagaccgaggcgacccagcucgccacgcugcggaagcugugcaucgaggggaagaucaccaacaucaccaccgacagccgcugccccacgcagggcgaggccauccucccggaggagcaggaccagaacuacgugugcaagcacaccuacgucgaccggggcugggggaacggcugcgggcuguucggcaaggggucccuggugaccugcgccaaguuccagugccucgagcccaucgagggcaaggugguccagcacgagaaccugaaguacaccgugaucaucacggugcacaccggcgaccagcaccaggucgggaacgacacccagggcgugaccgucgagaucacgccccaggccagcaccguggaggcgauccugcccgaguacgggacccucggccuggagugcuccccgcgcaccgggcuggacuucaacgagaugauccuccugaccaugaagaacaaggccuggauggugcaccggcagugguucuucgaccugccccuccccuggacgagcggcgccaccaccgagacccccacguggaaccgcaaggagcugcuggucaccuucaagaacgcccacgccaagaagcaggagguggugguccucggcucccaggagggggcgaugcacaccgcccugaccggcgccacggagauccagaacagcgggggcaccuccaucuucgccgggcaccugaagugccggcucaagauggacaagcuggagcugaagggcaugagcuacgccaugugccucaacaccuucgugcugaagaaggagguguccgagacccagcacggcacgauccugaucaaggucgaguacaagggggaggacgcgccgugcaagauccccuucagcaccgaggacggccaggggaaggcccacaacggccgccugaucaccgccaaccccguggugaccaagaaggaggagcccgucaacaucgaggccgagccgcccuucggcgagagcaacaucgugaucggggugggcgacaaggcgcucaagaucaacugguacaagaagggguccagcaucggcaagauguucgaggccacggcccgcggggcccgccggauggccauccugggcgacaccgcgugggacuucggcuccgucgggggcgugcugaacagccucgggaagauggugcaccagaucuucggcuccgccuacaccgcccuguucagcggggucuccuggaucaugaagaucggcaucggcgugcugcucaccuggaucgggcugaacagcaagaacacguccaugagcuucuccugcaucgugaucggcaucaucacccuguaccucggggccgucgugcaggccgacaugggcugcgugaucaacuggaaggggaaggagcugaagugcggcagcggcaucuucgucaccaacgaggugcacaccuggacggagcaguacaaguuccaggcggacucccccaagcgccuggccaccgccaucgccggggccugggagaacggcgugugcgggauccgcagcaccacccggauggagaaccuccuguggaagcagaucgcgaacgagcugaacuacauccucugggagaacaacaucaagcugacggucguggugggcgacaucaucgggguccuggagcagggcaagcgcacccucacgccccagccgauggagcugaaguacuccuggaagaccuggggcaaggccaagaucgugacggccgagacccagaacagcuccuucaucaucgacgggcccaacacccccgagugccccagcgccucccgggcguggaacgugugggaggucgaggacuacggcuucgggguguucaccacgaacaucuggcugaagcuccgcgagguguacacccagagcugcgaccaccggcugaugagcgccgccaucaaggacgagcgcgccguccacgccgacaugggcuacuggaucgagucccagaagaacggcagcuggaagcuggagaaggcguccuucaucgaggugaagaccugcaccuggcccaagagccacacccucugguccaacggggugcuggagagcgacaugaucauccccaagucccuggccggccccaucagccagcacaaccaccggccgggguaccacacgcagaccgccggccccuggcaccucgggaagcuggagcuggacuucaacuacugcgagggcaccaccgucgugaucacggagaacugcggcacccgcgggcccucccuccggaccaccacggugagcggcaagcugauccacgaguggugcugccgcuccugcacccugcccccgcuccgguacaugggggaggacggcugcugguacgggauggagauccgccccaucaacgagaaggaggagaacauggucaagagccugguguccgccggcagcggcaagguggacaacuucaccauggggauccugugccucgccauccuguucgaggaggucaugcggggcaaguucgggaagaagcacaugaucgcgggcgugcuguucaccuucgugcuccugcuguccgggcagaucacguggcgcgacauggcccacacccucaucaugaucggcagcaacgccuccgaccggaugggcaugggggucaccuaccuggcccugaucgccaccuucaagauccagcccuuccucgcgcugggcuucuuccugcgcaagcucacgagccgggagaaccugcugcucggggugggccuggccauggccaccacccugcagcuccccgaggacaucgagcagauggccaacggcaucgcgcuggggcugaugacccucaagcugaucacgcaguucgagaccuaccagcuguggaccgcccucgugagccugaccugcuccaacacgaucuucacccugaccgucgccuggcgcaccgccacgcucauccuggccggcgugagccugcucccgcugugccaguccagcuccaugcggaagaccgacuggcugcccaugaccgucgcggccaugggggugccgccccugccgcuguucaucuucagccugaaggacacccccaagcgccgcuccuggccccucaacgagggcgugauggccgucgggcuggugagcauccuggccuccagccuccugcggaacgacgugcccauggccggcccgcuggucgcgggcgggcuccugaucgccugcuacgugaucacgggcaccuccgccgaccugaccguggagaaggccgccgacgucaccugggaggaggaggcggagcagacgggggugagccacaaccucaugaucaccguggacgacgacggcaccaugcgcaucaaggacgacgagaccgagaacauccugaccguccugcucaagacggcccugcugaucguguccgggaucuuccccuacagcauccccgccacccuccugguguggcacaccuggcagaagcagacccagcgguccggcguccugugggacgugcccagcccgcccgagacgcagaaggccgagcucgaggagggcguguaccgcaucaagcagcaggggaucuucggcaagacccaggucggggugggcgugcagaaggagggggucuuccacaccauguggcacgugacccggggcgccgugcugacgcacaacggcaagcgccuggagcccaacugggcguccgucaagaaggaccucaucagcuacgggggcggguggcggcuguccgcccaguggcagaagggcgaggagguccaggugaucgccgucgagcccgggaagaacccgaagaacuuccagaccaugcccggcaucuuccagaccaccacgggcgagaucggggccaucgcgcuggacuucaagcccggcaccagcgggagcccgaucaucaaccgcgagggcaagguggugggccuguacgggaacggcgucgugaccaagaacgggggcuacguguccgggaucgcccagaccaacgccgagcccgacggccccacgcccgagcucgaggaggagauguucaagaagcggaaccugaccaucauggaccugcacccgggcagcgggaagacccgcaaguaccuccccgccaucguccgggaggccaucaagcgccggcugcgcacccugauccucgcgcccacgcgggugguggccgccgagauggaggaggcccugaagggccugcccauccgcuaccagaccaccgccaucaaguccgagcacaccgggcgggagaucgucgaccucaugugccacgcgacguucaccaugcgccugcugagcccggugcgggugcccaacuacaaccucaucaucauggacgaggcccacuucaccgaccccgccuccaucgccgcccgcggcuacaucagcacccgggucgggaugggcgaggcggccgccaucuucaugacggccacgccgcccggcaccgcggaggccuucccccaguccaacgcccccauccaggacgaggagcgcgacauccccgagcgcagcuggaacuccgggaacgaguggaucaccgacuucgugggcaagacggugugguucguccccagcaucaaggccgggaacgacaucgccaacugccugcggaagaacggcaagaaggugauccagcugucccgcaagaccuucgacaccgaguaccagaagacccggcucaacgacugggacuucguggucacgaccgacaucagcgagaugggggcgaacuucaaggccgaccgcgugaucgacccccggcgcugccugaagcccgugauccugaccgacggccccgagcgggucauccucgccggcccgaugcccgugaccgccgccuccgcggcccagcgccgggggcgcgugggccggaacccccagaaggagaacgaccaguacaucuucacggggcagccccugaacaacgacgaggaccacgcccacuggaccgaggccaagaugcugcucgacaacaucaacaccccggagggcaucauccccgcccuguucgagcccgagcgcgagaaguccgcggccaucgacggggaguaccggcugaagggcgagucccgcaagaccuucgucgagcucaugcggcgcggcgaccugcccguguggcuggcccacaaggucgccagcgaggggaucaaguacaccgaccggaaguggugcuucgacggcgagcgcaacaaccagauccucgaggagaacauggacguggagaucuggacgaaggagggggagcggaagaagcugcgcccgcgcuggcuggacgcgcggaccuacuccgacccccucgcccugaaggaguucaaggacuucgccgccggccgcaagagcaucgcccuggaccucgugaccgagaucggccggguccccucccaccuggcgcaccgcacccggaacgcccuggacaaccucgugaugcugcacacgagcgagcacgggggccgcgccuaccggcacgccguggaggagcugccggagaccauggagacccuccugcugcucgggcugaugauccugcucaccggcggggccaugcuguuccugaucagcggcaagggcaucgggaagacguccaucggccucaucugcgucaucgugagcuccgggaugcuguggauggcggacgugccccugcaguggaucgccagcgccaucguccucgaguucuucaugauggugcugcugauccccgagcccgagaagcagcgcaccccgcaggacaaccagcucgccuacguggucaucggcauccugacccuggccgcgaucgugaccgccaacgagauggggcuccuggagacgaccaagcgggaccugggcauguccaaggagcccggcguggucagccccaccuccuaccucgacguggaccugcaccccgccagcgccuggacccuguacgccguggcgacgaccgucaucaccccgaugcuccgccacaccaucgagaacuccacggccaacgugagccuggccgccaucgcgaaccaggccgugguccugauggggcucgacaagggcuggcccaucuccaagauggaccugggggugccccugcucgcccugggcugcuacagccaggugaacccccugacccucaccgccgccguccugcugcucgugacccacuacgcgaucaucgggccgggccugcaggccaaggccacgcgggaggcccagaagcgcaccgccgcgggcaucaugaagaaccccaccguggacgggaucaugaccaucgaccuggaccccgucaucuacgacuccaaguucgagaagcagcucggccaggugaugcugcuggugcucugcgccguccagcugcugcucaugcggacgagcugggcccugugcgaggcccugacccucgccaccgggcccaucaccacgcugugggagggcuccccgggcaaguucuggaacaccaccaucgcggugagcauggccaacaucuuccgcggguccuaccuggccggcgccgggcucgcguucagcaucaugaaguccgugggcaccgggaagcggggcacgggcagccagggggagacccugggcgagaaguggaagaagaagcugaaccagcucagccgcaaggaguucgaccuguacaagaaguccgggaucaccgaggucgaccggaccgaggccaaggagggccugaagcgcggggagaccacgcaccacgccgugagccggggcuccgccaagcuccagugguucguggagcgcaacauggucauccccgagggccgggugaucgaccuggggugcggccgcgggggcuggagcuacuacugcgccgggcugaagaaggugaccgagguccgcggcuacaccaagggcgggcccggccacgaggagcccgugccgauguccaccuacggguggaacaucgugaagcucaugagcggcaaggacgucuucuaccugccgcccgagaagugcgacacgcugcugugcgacaucggggaguccagccccuccccgaccguggaggagagccggaccauccgcgugcucaagauggucgagcccuggcugaagaacaaccaguucugcaucaaggugcugaaccccuacaugcccaccgugaucgagcaccucgagcggcugcagcgcaagcacggcggcaugcugguccggaacccgcucucccgcaacagcacgcacgagauguacuggaucuccaacgggaccggcaacaucgugagcuccgugaacauggucagccggcugcugcucaaccgcuucaccaugacccaccggcgccccacgaucgagaaggacguggaccugggggcgggcacccggcacgucaacgccgagcccgagaccccgaacauggacgugaucggcgagcgcaucaagcggaucaaggaggagcacuccagcaccuggcacuacgacgacgagaaccccuacaagacgugggccuaccacggguccuacgaggugaaggccaccggcagcgccagcuccaugaucaacggggucgugaagcugcucaccaagcccugggacgugguccccauggugacccagauggcgaugacggacaccaccccguucggccagcagcgcguguucaaggagaaggucgacacccggacgccccgccccaugcccgggacccggaaggugauggagaucaccgccgaguggcuguggcgcacccugggccggaacaagcgcccgcgccucugcacgcgggaggaguucaccaagaaggugcgcaccaacgccgccaugggcgccgucuucaccgaggagaaccagugggacagcgcgcgggccgccguggaggacgaggaguucuggaagcugguggaccgcgagcgggagcugcacaagcucgggaagugcggcuccugcgucuacaacaugauggggaagcgcgagaagaagcugggcgaguucgggaaggccaagggcagccgggcgaucugguacauguggcugggcgcccgcuaccucgaguucgaggcccugggguuccugaacgaggaccacugguucucccgggagaacagcuacuccggcguggagggggagggccuccacaagcugggguacauccugcgcgacaucagcaagauccccggcggcgccauguacgccgacgacacggcggggugggacacccggaucaccgaggacgaccuccacaacgaggagaagaucacccagcagauggaccccgagcaccgccagcuggccaacgccaucuucaagcugacguaccagaacaagguggucaaggugcagcggcccaccccgaagggcaccgugauggacaucaucucccgcaaggaccagcgggggagcggccaggucggcaccuacgggcucaacaccuucacgaacauggaggcccagcuggugcgccagauggagggcgagggggugcuguccaaggucgaccucgagaacccccaccuccuggagaagaagaucacccaguggcucgagaccaagggcguggagcggcugcgccggauggccaucagcggggacgacugcguggucaagcccaucgacgaccgcuucgcgaacgcccugcucgcccugaacgacaugggcaaggugcggaaggacaucccccaguggcagccguccaagggcuggcacgacuggcagcagguccccuucugcagccaccacuuccacgagcugaucaugaaggacgggcgcaagcucgucgugcccugccgcccccaggacgagcugaucggccgggcccgcaucucccagggggccggcuggagccugaaggagaccgcgugccucgggaaggccuacgcccagauguggucccugauguacuuccaccggcgcgaccugcggcucgccagcaacgccaucugcuccgcggugccgguccacugggugcccacgagccgcaccaccuggagcauccacgcccaccaccaguggaugaccacggaggacaugcugaccguguggaaccgggucuggaucgaggacaaccccuggauggaggacaagacccccgugaccacgugggaggacgugccguaccugggcaagcgcgaggaccaguggugcggcucccucaucgggcugaccagccgggccaccugggcccagaacauccugaccgcgauccagcagguccgcucccucaucggcgacgaggaguuccuggacuacaugcccagcaugaagcgguuccgcaaggaggaggaguccgagggggccaucugguga

SEQ ID NO: 10124 - RNA, 9873 nt, Artificial Sequence
  derived and/or modified CDS sequence (opt1) from DENV-3__GQ868593__SS-prME
accagccucugccucaugaugaugcugcccgcgacccuggcguuccaccucaccagccgggacggcgagccccggaugaucguggggaagaacgagcgcggcaagagccugcuguucaagaccgcgagcgggaucaacaugugcacccucaucgccauggaccugggcgagaugugcgacgacaccgugaccuacaagugcccccacaucgccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcggcaggucgagaagguggagaccugggcccugcgccaccccggguucaccauccucgcgcuguuccuggcccacuacaucggcaccucccucacccagaagguggugaucuucauccugcugauccucgucacccccagcauggccaugcggugcgugggggugggcaaccgcgacuucgucgagggccuguccggggccaccuggguggacgugguccuggagcacggcgggugcgugaccaccauggccaagaacaagcccacgcucgacaucgagcugcagaagaccgaggcgacccagcuggccacccuccggaagcugugcaucgagggcaagaucacgaacaucaccaccgacagccgcugccccacccagggcgaggccauccugcccgaggagcaggaccagaacuacgugugcaagcacacguacgucgaccggggguggggcaacgggugcggccucuucgggaagggcucccuggugaccugcgccaaguuccagugccuggagagcaucgagggcaaggugguccagcacgagaaccucaaguacaccgugaucaucaccgugcacacgggggaccagcaccaggucggcaacgagacccagggggugaccgccgagaucacgccccaggcguccacggucgaggccauccugcccgaguacggcacccuggggcucgagugcagcccccgcaccggccuggacuucaacgagaugauccugcucaccaugaagaacaaggccuggauggugcaccggcagugguucuucgaccugccgcugcccuggaccuccggcgccacgaccgagacccccaccuggaaccgcaaggagcuccuggugacguucaagaacgcccacgcgaagaagcaggaggucguggugcuggggagccaggagggcgccaugcacaccgcccucaccggggccaccgagauccagaacuccggcgggacgagcaucuucgccggccaccugaagugccggcugaagauggacaagcucgagcugaagggcauguccuacgcgaugugccugaacaccuucguccucaagaaggaggugagcgagacccagcacgggaccauccugaucaagguggaguacaagggcgaggacgcccccugcaagauccccuucagcacggaggacgggcagggcaaggcccacaacggccgccugaucaccgccaaccccgucgugaccaagaaggaggagcccgugaacaucgaggcggagcccccguucggggaguccaacaucgucaucggcaucggggacaaggcccugaagaucaacugguacaagaagggcagcuccaucgggaagauguucgaggccaccgcccggggcgcccgccggauggcgauccucggcgacacggccugggacuucgggagcgugggcggggugcugaacucccugggcaagaugguccaccagaucuucgggagcgccuacaccgcccucuucuccggcgugagcuggaucaugaagaucggcaucggggugcugcugaccuggaucggccucaacuccaagaacaccagcauguccuucagcugcaucgccaucgggaucaucacgcuguaccugggcgcggucgugcaggccgacauggggugcgugaucaacuggaagggcaaggagcucaagugcggcuccgggaucuucgucaccaacgaggugcacaccuggaccgagcaguacaaguuccaggccgacagccccaagcgccuggccacggccaucgcgggcgccugggagaacggggugugcggcauccgcuccaccacccggauggagaaccugcucuggaagcagaucgccaacgagcugaacuacauccugugggagaacaacaucaagcucaccgucguggugggggacaucaucggcguccuggagcagggcaagcgcacgcugacgccccagcccauggagcucaaguacagcuggaagaccugggggaaggccaagaucgugaccgcggagacgcagaacuccagcuucaucaucgacggcccgaacacccccgagugccccuccgccagccgggccuggaacgugugggaggucgaggacuacggguucggcguguucaccaccaacaucuggcugaagcugcgcgagguguacacgcagcucugcgaccaccggcugaugagcgccgccgucaaggacgagcgcgcggugcacgccgacaugggcuacuggaucgagucccagaagaacgggagcuggaagcuggagaaggccucccucaucgaggugaagaccugcaccuggcccaagagccacacccugugguccaacggcguccuggagagcgacaugaucaucccgaagucccucgccgggcccaucagccagcacaaccaccggcccggcuaccacacccagacggccgggccguggcaccugggcaagcuggagcucgacuucaacuacugcgagggcaccaccguggugaucaccgagaacugcgggacgcgcggccccucccugcggaccaccaccgucagcgggaagcugauccacgaguggugcugccgcuccugcacgcugccgccccuccgguacaugggcgaggacgggugcugguacggcauggagauccgcccgaucaacgagaaggaggagaacauggucaagagccuggcguccgccggcagcgggaagguggacaacuucaccaugggcguccucugccuggccauccuguucgaggaggugaugcgggggaaguucggcaagaagcacaugaucgccggggugcuccugaccuucguccugcuccuguccggccagaucaccuggcgcgacauggcccacacgcugaucaugaucggcagcaacgcguccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcccugaagcucaucacccaguucgagaccuaccagcuguggacggcgcuggucagccugaccugcuccaacaccaucuucacccugacgguggccuggcgcaccgccacccugauccucgccggggugagccugcugcccgucugccaguccagcuccaugcggaagaccgacuggcucccgauggccguggcggccaugggcgugccgccccucccccuguucaucuucagccucaaggacacgcugaagcgccgcuccuggccgcugaacgagggggugauggccgugggccucgucagcauccuggccuccagccugcuccggaacgacgugcccauggccggcccccugguggccggcgggcugcucaucgccugcuacgucaucaccgggaccuccgccgaccugaccguggagaaggccgccgacgugacgugggaggaggaggcggagcagaccggggucagccacaaccugaugaucaccguggacgacgacgggaccaugcgcaucaaggacgacgagacggagaacauccucaccgugcugcugaagaccgcccuccugaucgucuccggcaucuuccccuacagcaucccggccacccugcucguguggcacaccuggcagaagcagacgcagcgguccggcgugcugugggacguccccuccccgcccgagacccagaaggccgagcuggaggaggggguguaccgcaucaagcagcagggcaucuucgggaagacccaggugggcgucggggugcagaaggagggcguguuccacaccauguggcacgucacgcggggcgcggugcucacccacaacgggaagcgccuggagccgaacugggccuccgugaagaaggaccugaucagcuacggcgggggcuggcggcuguccgcccaguggcagaagggggaggagguccaggugaucgccguggagcccggcaagaaccccaagaacuuccagaccaugcccggcaucuuccagaccacgaccggggagaucggcgccaucgcgcucgacuucaagccggggaccagcggcagccccaucaucaaccgcgagggcaaggucguggggcuguacggcaacgggguggucaccaagaacggcggguacguguccggcaucgcccagacgaacgccgagcccgacggcccgacccccgagcuggaggaggagauguucaagaagcggaaccucaccaucauggaccugcaccccgggagcggcaagacccgcaaguaccugcccgccaucgugcgggaggccaucaagcgccggcuccgcacgcugauccuggcgccgacccgggucguggccgccgagauggaggaggcccucaaggggcugcccauccgcuaccagaccaccgccacgaaguccgagcacaccggccgggagaucguggaccugaugugccacgcgaccuucaccaugcgccuccugagccccguccgggugcccaacuacaaccugaucaucauggacgaggcccacuucacggacccggccuccaucgccgcgcgcggguacaucagcacccgggugggcaugggcgaggccgccgccaucuucaugaccgccacgccgcccgggacggcggacgccuucccccaguccaacgccccgauccaggacgaggagcgcgacauccccgagcgcagcuggaacuccggcaacgaguggaucaccgacuucgucgggaagaccgugugguucgugcccagcaucaaggccggcaacgacaucgccaacugccuccggaagaacgggaagaaggucauccagcugucccgcaagaccuucgacacggaguaccagaagaccaagcugaacgacugggacuucguggugaccaccgacaucagcgagaugggcgcgaacuucaaggccgaccgggucaucgacccccgccggugccucaagccggugauccugacggacggccccgagcgcgugauccuggccgggcccaugcccgucaccgccgccuccgcggcccagcggcgcggccggguggggcgcaacccgcagaaggagaacgaccaguacaucuucaccggccagccccucaacaacgacgaggaccacgcccacuggaccgaggccaagaugcugcuggacaacaucaacacgcccgaggggaucauccccgcccucuucgagccggagcgggagaaguccgccgccaucgacggcgaguaccgccugaagggcgagucccggaagaccuucguggagcugaugcgccgcggggaccuccccgucuggcuggcccacaagguggccagcgagggcaucaaguacaccgaccgcaaguggugcuucgacggggagcggaacaaccagauccuggaggagaacauggacgucgagaucuggaccaaggagggcgagaagaagaagcuccgcccccgguggcuggacgcgcgcaccuacuccgacccccuggcccucaaggaguucaaggacuucgccgccggccgcaagagcaucgcccuggaccuggugacggagaucgggcgggugccgucccaccucgcgcaccgcacccggaacgcccuggacaaccuggucaugcuccacaccagcgagcacggcgggcgcgccuaccggcacgccguggaggagcugcccgagaccauggagacgcugcuccugcugggccucaugauccugcugaccgggggcgccaugcuguuccugaucagcggcaaggggaucggcaagaccuccaucgggcugaucugcgugaucgcgagcuccggcaugcucuggauggccgacgucccccugcaguggaucgccagcgccaucgugcuggaguucuucaugauggugcuccugaucccggagcccgagaagcagcgcacgccccaggacaaccagcuggccuacgucgugaucgggauccucacgcuggcggccaucguggccgccaacgagaugggccugcucgagaccaccaagcgggaccugggcauguccaaggagcccggggucgugagcccgaccuccuaccuggacguggaccuccaccccgcgagcgccuggacgcuguacgccgucgccaccaccgugaucacccccaugcugcgccacacgaucgagaacuccaccgccaacgugagccucgcggccaucgccaaccaggccgucgugcugaugggccuggacaagggguggcccaucuccaagauggaccucggcgugccgcugcuggcccucgggugcuacagccaggucaacccccugacccugaccgcggccgugcuccugcuggccacgcacuacgccaucaucggccccggccuccaggccaaggcgacccgggaggcccagaagcgcaccgccgccgggaucaugaagaaccccaccguggacggcaucaugacgaucgaccuggacccggucaucuacgacuccaaguucgagaagcagcugggccaggugaugcuccuggugcugugcgcgguccagcuccugcugaugcggaccagcugggcccucugcgaggcccugacccuggccaccggccccaucacgacccucugggagggcucccccgggaaguucuggaacaccaccaucgccgugagcauggcgaacaucuuccgcggcuccuaccuggccggggccggccuggccuucagcaucaugaaguccguggggacgggcaagcggggcaccgggagccagggcgagacccucggggagaaguggaagaagaagcugaaccagcugagccgcaaggaguucgaccucuacaagaaguccggcaucaccgaggucgaccggacggaggccaaggaggggcugaagcgcggcgagaucacccggcacgcggugagccgcggcuccgccaagcugcagugguucguggagcggaacauggucauccccgaggggcgcgugaucgaccucggcugcgggcggggcggguggagcuacuacugcgccggccugaagaaggugaccgagguccgcggcuacaccaagggcgggccggggcacgaggagcccgugcccauguccaccuacggcuggaacaucgugaagcugaugagcgggaaggacgucuucuaccugcccccggagaagugcgacacgcuccugugcgacaucggcgaguccagccccucccccaccguggaggagagccgcaccauccgggugcugaagauggucgagcccuggcucaagaacaaccaguucugcaucaaggugcugaacccguacaugcccaccgugaucgagcaccuggagcgccuccagcggaagcacggcgggaugcugguccgcaacccccugucccggaacagcacgcacgagauguacuggaucuccaacggcaccgggaacaucgugagcuccgugaacauggucagccgccuccugcugaaccgguucaccaugacccaccgccggcccacgaucgagaaggacguggaccucggcgccggcacccgccacgugaacgccgagccggagacccccaacauggacgucaucggggagcggaucaagcgcaucaaggaggagcacaacuccaccuggcacuacgacgacgagaaccccuacaagacgugggcguaccacggcagcuacgaggugaaggccaccggguccgccagcagcaugaucaacggcgucgugaagcugcugaccaagccgugggacgugguccccauggugauccagauggccaugaccgacacgacccccuucgggcagcagcggguguucaaggagaaggucgacacccgcacgccccggccgaugcccggcacgcgcaaggugauggagaucaccgcggaguggcucuggcggacccugggccgcaacaagcggccccgccugugcacccgcgaggaguucacgaagaaggugcggaccaacgccgccaugggggccgucuucaccgaggagaaccagugggacuccgcccgcgcggccguggaggacgaggaguucuggaagcucguggaccgggagcgcgagcugcacaagcugggcaagugcgggagcugcgucuacaacaugaugggcaagcgggagaagaagcucggggaguucggcaaggccaagggcucccgcgccaucugguacauguggcugggggcccgguaccuggaguucgaggcgcucggcuuccugaacgaggaccacugguucagccgcgagaacuccuacagcgggguggagggcgaggggcugcacaagcucggcuacauccugcgggacaucuccaagauccccggcggggccauguacgccgacgacaccgccggcugggacacgcgcaucaccgaggacgaccugcacaacgaggagaagaucacccagcagauggacccggagcaccggcagcucgccaacgcgaucuucaagcugaccuaccagaacaagguggucaaggugcagcgccccacgcccaaggggaccgugauggacaucaucagccggaaggaccagcgcggcuccggccaggucgggaccuacggccugaacaccuucacgaacauggaggcccagcucgugcggcagauggagggggagggcgugcugagcaaggccgaccuggagaacccccaccuccuggagaagaagaucacccaguggcuggagaccaagggggucgagcgccucaagcggauggccaucuccggcgacgacugcguggugaagccgaucgacgaccgcuucgccaacgcgcugcuggcccucaacgacaugggcaagguccggaaggacaucccccaguggcagcccagcaagggguggcacgacuggcagcagguccccuucugcucccaccacuuccacgagcugaucaugaaggacggccgcaagcugguggucccgugccggccccaggacgagcucaucgggcgcgcccgcaucagccagggcgccggguggucccugaaggagaccgcgugccugggcaaggccuacgcccagauguggagccucauguacuuccaccggcgcgaccugcggcuggccuccaacgccaucugcagcgcggugcccgugcacuggguccccaccucccgcacgaccuggagcauccacgcccaccaccaguggaugaccaccgaggacaugcucacgguguggaaccggguguggaucgaggacaacccguggauggaggacaagacccccgucaccaccugggaggacgugcccuaccugggcaagcgcgaggaccaguggugcgggagccugaucggccucacgucccgggccaccugggcccagaacauccugaccgccauccagcagguccgcagccugaucgggaacgaggaguuccucgacuacaugcccuccaugaagcgguucaagaaggaggaggagagcgagggcgcgaucugguga

SEQ ID NO: 10125 - RNA, 9873 nt, Artificial Sequence
  derived and/or modified CDS sequence (opt1) from DENV-3__FJ898459__SS-prME
accagccugugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgcgucccgggccuggaacgucugggagguggaggacuacggguucggcguguucaccaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccguggucaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcgggaagguggacaacuucacgaugggcgugcugugccucgcgauccuguucgaggaggucaugcgggggaaguucggcaagaagcacaugaucgccgggguguucuucaccuucgugcugcuccuguccggccagaucaccuggcgcgacauggcccacacccugaucaugaucggcagcaacgccuccgaccggauggggaugggcgucacguaccucgcccugaucgcgaccuucaaggugcagcccuuccuggcccucggguucuuccugcgcaagcugaccagccgggagaaccuccugcugggcgugggccucgccauggccaccacgcugcagcugcccgaggacaucgagcagauggcgaacgggaucgcccucggccugauggcccugaagcucaucacccaguucgagaccuaccagcuguggaccgcccugaucagccucacgugcuccaacaccauguucacccugaccgucgccuggcgcacggcgacccugauccucgccggggugagccugcugccggucugccaguccagcuccaugcggaagaccgacuggcuccccauggccguggccgccaugggcgugccgccccucccgcuguucaucuucagccucaaggacacccugaagcgccgcuccuggccccugaacgagggggucauggcggugggccucgugagcauccuggccuccagccugcuccggaacgacguccccauggccggcccccugguggccgggggccugcucaucgccugcuacgugaucacggggaccuccgcggaccugaccgucgagaaggccgccgacaucaccugggaggaggaggccgagcagacgggcgugagccacaaccugaugaucaccguggacgacgacgggaccaugcgcaucaaggacgacgagaccgagaacauccucaccguccugcugaagacggcccuccugaucguguccggcguguucccguacagcauccccgcgacccugcucgucuggcacaccuggcagaagcagacccagcgguccggcgugcugugggacgugcccagcccgcccgagacgcagaaggccgagcuggaggagggggucuaccgcaucaagcagcagggcaucuucgggaagacccaggugggcguggggguccagaaggagggcguguuccacaccauguggcacgugacccggggcgccguccucacguacaacgggaagcgccuggagcccaacugggccuccgugaagaaggaccugaucagcuacggcgggggcuggcggcucuccgcgcaguggcagaagggggaggaggugcaggucaucgccguggagcccggcaagaaccccaagaacuuccagaccaugcccggcaccuuccagaccacgaccggggagaucggcgccaucgcccuggacuucaagcccgggaccagcggcagccccaucaucaaccgcgagggcaagguggucgggcuguacggcaacgggguggugaccaagaacggcggguacgucuccggcaucgcccagacgaacgcggagccggacggccccacccccgagcuggaggaggagauguucaagaagcggaaccucaccaucauggaccugcaccccgggagcggcaagacccgcaaguaccugccggccaucgugcgggaggccaucaagcgccggcuccgcacgcugauccuggcccccacccggguggucgccgcggagauggaggaggcccucaaggggcugcccauccgcuaccagaccaccgccacgaaguccgagcacaccggccgggagaucguggaccugaugugccacgccaccuucaccaugcgccuccugagccccgugcgggucccgaacuacaaccugaucaucauggacgaggcccacuucacggaccccgcguccaucgccgcccgcggguacaucagcacccgggugggcaugggcgaggccgcggccaucuucaugaccgccacgccgcccgggacggccgacgccuucccgcaguccaacgcgcccauccaggacgaggagcgcgacauccccgagcgcagcuggaacuccggcaacgaguggaucaccgacuucgccgggaagaccgugugguucguccccagcaucaaggccggcaacgacaucgccaacugccuccggaagaacgggaagaaggugauccagcugucccgcaagaccuucgacacggaguaccagaagaccaagcugaacgacugggacuucguggucaccaccgacaucagcgagaugggcgccaacuucaaggcggaccgggugaucgacccgcgccggugccucaagcccgugauccugacggacggccccgagcgcgucauccuggccgggcccaugccggugaccgccgccuccgccgcgcagcggcgcggccggguggggcgcaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgggagaaguccgcggccaucgacggcgaguaccgccugaagggcgagucccggaagacguucgucgagcugaugcgccgcggggaccuccccguguggcuggcccacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcaccuacuccgacccgcuggcgcucaaggaguucaaggacuucgccgccggccgcaagagcaucgcccuggaccuggugacggagaucgggcggguccccucccaccucgcccaccgcacccggaacgcgcuggacaaccuggugaugcuccacaccagcgagcacggcgggcgcgccuaccggcacgccguggaggagcugcccgagaccauggagacgcugcuccugcugggccucaugauccugcugaccgggggcgccaugcuguuccugaucagcggcaaggggaucggcaagaccuccaucgggcugaucugcgucaucgccagcuccggcaugcucuggauggcggagaucccgcugcaguggaucgccagcgccaucgugcuggaguucuucaugauggugcuccugauccccgagcccgagaagcagcgcacgccccaggacaaccagcuggccuacgucgugaucgggauccucacgcuggccgcgaucaucgccgccaacgagaugggccugcucgagaccaccaagcgggaccugggcauguccaaggagccggggguggucagccccaccuccuaccuggacguggaccuccaccccgccagcgcguggacgcuguacgccguggccaccaccgucaucacccccaugcugcgccacacgaucgagaacuccaccgccaacgugagccucgccgcgaucgccaaccaggccgugguccugaugggccuggacaagggguggccgaucuccaagauggaccucggcgugccccugcuggcccucgggugcuacagccaggugaacccccugacccugaccgccgcgguccuccugcugaucacgcacuacgccaucaucggccccggccuccaggccaaggccacccgggaggcccagaagcgcaccgcggccgggaucaugaagaacccgaccguggacggcaucaugacgaucgaccuggaccccgugaucuacgacuccaaguucgagaagcagcuggggcaggucaugcuccuggugcugugcgccgugcagcuccugcugaugcggaccagcugggcccucugcgaggcgcugacccuggccaccggccccaucacgacccucugggagggcucccccgggaaguucuggaacaccaccaucgccgucagcauggccaacaucuuccgcggcuccuaccuggccggggcgggccuggccuucagcaucaugaaguccguggggacgggcaagcggggcaccgggagccagggcgagacccucggggagaaguggaagaagaagcugaaccagcugagccgcaaggaguucgaccucuacaagaaguccggcaucaccgagguggaccggaccgaggccaaggaggggcugaagcgcggcgagacgacccaccacgccgucagccggggcuccgccaagcugcagugguucguggagcgcaacauggugaucccggaggggcgggucaucgaccucggcugcgggcgcggcggguggagcuacuacugcgcgggccugaagaaggugaccgaggugcggggcuacaccaagggcgggcccgggcacgaggagcccguccccauguccacguacggcuggaacaucgugaagcugaugagcgggaaggacguguucuaccucccgcccgagaagugcgacacccugcugugcgacaucggcgaguccagccccucccccaccgucgaggagagccgcaccauccgcgugcugaagaugguggagccguggcucaagaacaaccaguucugcaucaagguccugaaccccuacaugcccacggugaucgagcaccuggagcggcuccagcgcaagcacggcgggaugcuggugcggaacccccugucccgcaacagcacccacgagauguacuggaucuccaacggcaccgggaacaucgucgccagcgugaacauggugucccggcuccugcugaaccgcuucaccaugacgcaccggcgcccgaccaucgagaaggacgucgaccucggcgccggcacccggcacgugaacgccgagcccgagacccccaacauggacgugaucggggagcgcaucaagcggaucaaggaggagcacaacagcacguggcacuacgacgacgagaacccguacaagaccugggccuaccacggcuccuacgaggucaaggcgaccgggagcgccuccagcaugaucaacggcguggucaagcugcugaccaagcccugggacguggugcccauggucacgcagauggccaugaccgacaccacccccuucgggcagcagcgcguguucaaggagaagguggacacgcggaccccgcgcagcaugcccggcacccggcgcgucaugggcaucaccgccgaguggcucuggcggacgcuggggcgcaacaagaagccccggcugugcacccgcgaggaguucaccaagaaggugcgcaccaacgcggccaugggcgccguguucacggaggagaaccagugggacuccgccaaggccgcggucgaggacgaggacuucuggaagcucguggaccgggagcgcgagcugcacaagcuggggaagugcggcagcugcguguacaacaugauggggaagcgggagaagaagcucggcgaguucggcaaggccaaggggucccgcgccaucugguacauguggcugggcgcccgguaccuggaguucgaggcccucggguuccugaacgaggaccacugguucagccgcgagaacuccuacagcggcgucgagggggagggccugcacaagcucggcuacauccugcgggacaucuccaagauccccgggggcgcgauguacgccgacgacaccgccgggugggacacccgcaucaccgaggacgaccugcacaacgaggagaagaucacgcagcagauggacccggagcaccggcagcucgccaacgccaucuucaagcugaccuaccagaacaagguggugaagguccagcgccccacccccaccggcaccgugauggacaucaucagccggaaggaccagcgcggcuccggccaggugggcacguacgggcugaacaccuucaccaacauggaggcgcagcucauccggcagauggagggcgaggggguccugagcaaggccgaccuggagaacccccaccucccggagaagaagaucacccaguggcuggagacgaagggcguggagcgccugaagcggauggccaucuccggcgacgacugcguggucaagcccaucgacgaccgcuucgccaacgcccuccuggcgcugaacgacauggggaaggugcggaaggacaucccccaguggcagcccagcaagggcuggcacgacuggcagcaggucccguucugcucccaccacuuccacgagcucaucaugaaggacgggcgcaagcuggucgugcccugccggccccaggacgagcugaucggccgcgcccggaucagccagggggccggcuggucccuccgcgagaccgccugccugggcaaggcguacgcccagauguggagccugauguacuuccaccgccgggaccuccgccuggccuccaacgccaucugcagcgccgugcccguccacugggugccgaccucccggaccacguggagcauccacgcgcaccaccaguggaugaccaccgaggacaugcugaccguguggaaccgcgucuggaucgaggacaaccccuggauggaggacaagacgcccgugaccaccugggagaacgugcccuaccucgggaagcgggaggaccaguggugcggcagccugaucgggcugaccucccgcgccacgugggcccagaacaucccgaccgccauccagcagguccggagccucaucggcaacgaggaguuccuggacuacaugcccuccaugaagcgcuuccggaaggaggaggagagcgagggggccaucugguga

SEQ ID NO: 10126 - RNA, 9873 nt, Artificial Sequence
  derived and/or modified CDS sequence (opt1) from DENV-3__EU482555__SS-prME
accagccucugccucaugaugauccugcccgccgcccuggcguuccaccucaccagccgggacggcgagccccggaugaucguggggaagaacgagcgcggcaagagccugcuguucaagacggccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucggggugaucacccucuaccugggcgccgugguccaggcggacauggggugcgugaucaacuggaagggcaaggagcugaagugcggcagcgggaucuucgugacgaacgagguccacaccuggaccgagcaguacaaguuccaggccgacucccccaagcgccucgccaccgccaucgccggcgcgugggagaacggggugugcggcauccgcagcacgacccggauggagaaccugcuguggaagcagaucgccaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagauccagaacagcuccuucaucaucgacggccccaacacccccgagugccccagcgcgucccgggccuggaacgugugggagguggaggacuacggguucggcgucuucacgaccaacaucuggcucaagcugcgcgagguguacacccagcugugcgaccaccggcucaugagcgccgccgugaaggacgagcgcgccguccacgcggacaugggcuacuggaucgagagccagaagaacggguccuggaagcuggagaaggccagccugaucgaggugaagaccugcaccuggccgaagucccacacgcucuggagcaacggcgugcuggaguccgacaugaucauccccaagagccuggccgggcccaucucccagcacaacuaccggccgggcuaccacacccagaccgccgggcccuggcaccucggcaagcuggaccuggacuucaacuacugcgagggcaccacggucgugaucaccgagaacugcgggacccgcggccccagccuccggaccacgaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgcgauccuguucgaggaggugaugcgggggaaguucggcaagaagcacaugaucgccgggguguucuucacguucguccugcuccuguccggccagaucaccuggcgcgacauggcccacacccugaucaugaucggcagcaacgccuccgacaagauggggaugggcgugaccuaccucgcccugaucgcgacguucaagauccagcccuuccuggcccucggguucuuccugcggaagcugaccagccgcgagaaccuccugcugggcgugggccucgccauggccaccacccugcagcugcccgaggacaucgagcagauggcgaacgggaucgcccucggccugauggcccugaagcucaucacgcaguucgagaccuaccagcuguggaccgcccugaucagccugaccugcuccaacacgauguucacccugaccgucgccuggcggaccgcgacgcugauccucgccggggugagccugcugccggucugccaguccagcuccaugcgcaagaccgacuggcuccccauggccguggccgccaugggcgugccgccccucccgcuguucaucuucagccucaaggacacccugaagcggcgcuccuggccccugaacgagggggucauggcggugggccucgugagcauccuggccuccagccugcuccgcaacgacguccccauggccggcccccugguggccgggggccugcucaucgccugcuacgugaucaccgggacguccgcggaccugaccgucgagaaggccgccgacaucaccugggaggaggaggccgagcagaccggcgugagccacaaccugaugaucacgguggacgacgacgggaccaugcggaucaaggacgacgagaccgagaacauccucaccguccugcugaagaccgcccuccugaucguguccggcguguucccguacagcauccccgcgacgcugcucgucuggcacaccuggcagaagcagacccagcgcuccggcgugcugugggacgugcccagcccgcccgagacccagaaggccgagcuggaggagggggucuaccggaucaagcagcagggcaucuucgggaagacccaggugggcguggggguccagaaggagggcguguuccacaccauguggcacgugacccgcggcgccguccucaccuacaacgggaagcggcuggagcccaacugggccuccgugaagaaggaccugaucagcuacggcgggggcuggcgccucuccgcgcaguggcagaagggggaggaggugcaggucaucgccguggagcccggcaagaaccccaagaacuuccagacgaugcccggcaccuuccagaccaccacgggggagaucggcgccaucgcccuggacuucaagcccgggaccagcggcagccccaucaucaaccgggagggcaagguggucgggcuguacggcaacgggguggugaccaagaacggcggguacgucuccggcaucgcccagaccaacgcggagccggacggccccacgcccgagcuggaggaggagauguucaagaagcgcaaccucaccaucauggaccugcaccccgggagcggcaagacccggaaguaccugccggccaucgugcgcgaggccaucaagcggcgccuccggacccugauccuggcccccacgcgcguggucgccgcggagauggaggaggcccucaaggggcugcccauccgguaccagaccaccgccaccaaguccgagcacacgggccgcgagaucguggaccugaugugccacgccaccuucaccaugcggcuccugagccccgugcgcgucccgaacuacaaccugaucaucauggacgaggcccacuucaccgaccccgcguccaucgccgcccggggguacaucagcacgcgcgugggcaugggcgaggccgcggccaucuucaugaccgccacgccgcccgggaccgccgacgccuucccgcaguccaacgcgcccauccaggacgaggagcgggacauccccgagcgcagcuggaacuccggcaacgaguggaucacggacuucgccgggaagaccgugugguucguccccagcaucaaggccggcaacgacaucgccaacugccuccgcaagaacgggaagaaggugauccagcugucccggaagaccuucgacaccgaguaccagaagacgaagcugaacgacugggacuucguggucaccaccgacaucagcgagaugggcgccaacuucaaggcggaccgcgugaucgacccgcggcgcugccucaagcccgugauccugaccgacggccccgagcgggucauccuggccgggcccaugccggugacggccgccuccgccgcgcagcgccggggccgcguggggcggaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgcgagaaguccgcggccaucgacggcgaguaccggcugaagggcgagucccgcaagaccuucgucgagcugaugcggcgcggggaccuccccguguggcuggcccacaaggucgccagcgagggcaucaaguacacggaccggaaguggugcuucgacgggcagcgcaacaaccagauccuggaggagaacauggacguggagaucuggaccaaggagggcgagaagaagaagcuccggccccgcuggcuggacgcccggaccuacuccgacccgcuggcgcucaaggaguucaaggacuucgccgccggccgcaagagcaucgcccuggaccuggugaccgagaucgggcgcguccccucccaccucgcccaccggacgcgcaacgcgcuggacaaccuggugaugcuccacaccagcgagcacggcgggcgggccuaccgccacgccguggaggagcugcccgagaccauggagacccugcuccugcugggccucaugauccugcugaccggcggggccaugcuguuccugaucagcgggaaggggaucggcaagaccuccaucgggcugaucugcgucaucgccagcuccggcaugcucuggauggcggagaucccgcugcaguggaucgccagcgccaucgugcuggaguucuucaugauggugcuccugauccccgagcccgagaagcagcggacgccccaggacaaccagcuggccuacgucgugaucgggauccucacccuggccgcgaucaucgccgccaacgagaugggccugcucgagacgaccaagcgcgaccugggcauguccaaggagccggggguggucagccccaccuccuaccuggacguggaccuccaccccgccagcgcguggacccuguacgccguggccacgaccgucaucacccccaugcugcggcacaccaucgagaacuccacggccaacgugagccucgccgcgaucgccaaccaggccgugguccugaugggccuggacaagggguggccgaucuccaagauggaccucggcgugccccugcuggcccucgggugcuacagccaggugaacccccugacccugaccgccgcgguccuccugcugaucacccacuacgccaucaucggccccggccuccaggccaaggccacgcgcgaggcccagaagcggaccgcggccgggaucaugaagaacccgaccguggacggcaucaugaccaucgaccuggaccccgugaucuacgacuccaaguucgagaagcagcuggggcaggucaugcuccuggugcugugcgccgugcagcuccugcugaugcgcacgagcugggcccucugcgaggcgcugacccuggccaccggccccaucaccacgcucugggagggcucccccgggaaguucuggaacaccaccaucgccgucagcauggccaacaucuuccggggcuccuaccuggccggggcgggccuggccuucagcaucaugaaguccguggggaccggcaagcgcggcacggggagccagggcgagacccucggggagaaguggaagaagaagcugaaccagcugagccggaaggaguucgaccucuacaagaaguccggcaucaccgagguggaccgcaccgaggccaaggaggggcugaagcggggcgagaccacgcaccacgccgucagccgcggcaccgccaagcugcagugguucguggagcggaacauggugaucccggaggggcgcgucaucgaccucggcugcgggcggggcgggugguccuacuacugcgcgggccugaagaaggugaccgaggugcgcggcuacaccaagggcgggcccgggcacgaggagcccguccccaugagcacguacggcuggaacaucgugaagcugauguccgggaaggacguguucuaccucccgcccgagaagugcgacacccugcugugcgacaucggcgagagcucccccagccccaccgucgaggagucccggaccauccgcgugcugaagaugguggagccguggcucaagaacaaccaguucugcaucaagguccugaaccccuacaugcccacggugaucgagcaccuggagcgccuccagcggaagcacggcgggaugcuggugcgcaacccccugagccggaacuccacccacgagauguacuggaucagcaacggcaccgggaacaucgucgccuccgugaacauggugagccgccuccugcugaaccgguucaccaugacgcaccgccggccgaccaucgagaaggacgucgaccucggcgccggcacccgccacgugaacgccgagcccgagacccccaacauggacgugaucggggagcggaucaagcgcaucaaggaggagcacaacuccacguggcacuacgacgacgagaacccguacaagaccugggccuaccacggcagcuacgaggucaaggcgaccggguccgccagcuccaugaucaacggcguggucaagcugcugaccaagcccugggacguggugcccauggucacgcagauggccaugaccgacaccacccccuucgggcagcagcggguguucaaggagaagguggacacgcgcaccccgcggagcaugcccggcacccgccgggucaugggcaucaccgccgaguggcucuggcgcacgcuggggcggaacaagaagccccgccugugcacccgggaggaguucaccaagaaggugcgcaccaacgcggccaugggcgccguguucacggaggagaaccagugggacagcgccaaggccgcggucgaggacgaggacuucuggaagcucguggaccgcgagcgggagcugcacaagcuggggaagugcggcuccugcguguacaacaugauggggaagcgcgagaagaagcucggcgaguucggcaaggccaaggggagccgggccaucugguacauguggcugggcgcccgcuaccuggaguucgaggcccucggguuccugaacgaggaccacugguucucccgggagaacagcuacuccggcgucgagggggagggccugcacaagcucggcuacauccugcgcgacaucagcaagauccccgggggcgcgauguacgccgacgacaccgccgggugggacacccggaucaccgaggacgaccugcacaacgaggagaagaucacgcagcagauggacccggagcaccgccagcucgccaacgccaucuucaagcugaccuaccagaacaagguggugaagguccagcggcccacccccaccggcaccgugauggacaucaucucccgcaaggaccagcggggcagcggccaggugggcacguacgggcugaacaccuucaccaacauggaggcgcagcucauccgccagauggagggcgaggggguccuguccaaggccgaccuggagaacccccaccucccggagaagaagaucacccaguggcuggagacgaagggcguggagcggcugcgccggauggccaucagcggcgacgacugcguggucaagcccaucgacgaccgcuucgccaacgcccuccuggcgcugaacgacauggggaaggugcggaaggacaucccccaguggcagcccuccaagggcuggcacgacuggcagcaggucccguucugcagccaccacuuccacgagcucaucaugaaggacgggcgcaagcuggucgugcccugccggccccaggacgagcugaucggccgcgcccggaucucccagggggccggcuggagccuccgcgagaccgccugccugggcaaggcguacgcccagauguggucccugauguacuuccaccgccgggaccuccgccuggccagcaacgccaucugcuccgccgugcccguccacugggugccgaccagccggaccacgugguccauccacgcgcaccaccaguggaugaccaccgaggacaugcugaccguguggaaccgcgucuggaucgaggacaaccccuggauggaggacaagacgcccgugaccaccugggagaacgugcccuaccucgggaagcgggaggaccaguggugcggcagccugaucgggcugaccagccgcgccacgugggcccagaacaucccgaccgccauccagcagguccggucccucaucggcaacgaggaguuccuggacuacaugcccagcaugaagcgcuuccggaaggaggaggaguccgagggggccaucugguga

SEQ ID NO: 10127 - RNA, 9873 nt, Artificial Sequence
  derived and/or modified CDS sequence (opt1) from DENV-3__EU529692__SS-prME
accagccucugccucaugaugauccugcccgccgcccuggcguuccaccucaccagccgggacggcgagccccggaugaucguggggaagaacgagcgcggcaagagccugcuguucaagacggccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucggggugaucacccucuaccugggcgccgugguccaggcggacauggggugcgugaucaacuggaagggcaaggagcugaagugcggcagcgggaucuucgugacgaacgagguccacaccuggaccgagcaguacaaguuccaggccgacucccccaagcgccucgccaccgccaucgccggcgcgugggagaacggggugugcggcauccgcagcacgacccggauggagaaccugcuguggaagcagaucgccaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagauccagaacagcuccuucaucaucgacggccccaacacccccgagugccccagcgcgucccgggccuggaacgugugggagguggaggacuacggguucggcgucuucacgaccaacaucuggcucaagcugcgcgagguguacacccagcugugcgaccaccggcucaugagcgccgccgugaaggacgagcgcgccguccacgcggacaugggcuacuggaucgagagccagaagaacggguccuggaagcuggagaaggccagccugaucgaggugaagaccugcaccuggccgaagucccacacgcucuggagcaacggcgugcuggaguccgacaugaucauccccaagagccuggccgggcccaucucccagcacaacuaccggccgggcuaccacacccagaccgccgggcccuggcaccucggcaagcuggaccuggacuucaacuacugcgagggcaccacggucgugaucaccgagaacugcgggacccgcggccccagccuccggaccacgaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgcgauccuguucgaggaggugaugcgggggaaguucggcaagaagcacaugaucgccgggguguucuucacguucguccugcuccuguccggccagaucaccuggcgcgacauggcccacacccugaucaugaucggcagcaacgccuccgacaagauggggaugggcgugaccuaccucgcccugaucgcgacguucaagauccagcccuuccuggcccucggguucuuccugcggaagcugaccagccgcgagaaccuccugcugggcgugggccucgccauggccaccacccugcagcugcccgaggacaucgagcagauggcgaacgggaucgcccucggccugauggcccugaagcucaucacgcaguucgagaccuaccagcuguggaccgcccugaucagccugaccugcuccaacacgauguucacccugaccgucgccuggcggaccgcgacgcugauccucgccggggugagccugcugccggucugccaguccagcuccaugcgcaagaccgacuggcuccccauggccguggccgccaugggcgugccgccccucccgcuguucaucuucagccucaaggacacccugaagcggcgcuccuggccccugaacgagggggucauggcggugggccucgugagcauccuggccuccagccugcuccgcaacgacguccccauggccggcccccugguggccgggggccugcucaucgccugcuacgugaucaccgggacguccgcggaccugaccgucgagaaggccgccgacaucaccugggaggaggaggccgagcagaccggcgugagccacaaccugaugaucacgguggacgacgacgggaccaugcggaucaaggacgacgagaccgagaacauccucaccguccugcugaagaccgcccuccugaucguguccggcguguucccguacagcauccccgcgacgcugcucgucuggcacaccuggcagaagcagacccagcgcuccggcgugcugugggacgugcccagcccgcccgagacccagaaggccgagcuggaggagggggucuaccggaucaagcagcagggcaucuucgggaagacccaggugggcguggggguccagaaggagggcguguuccacaccauguggcacgugacccgcggcgccguccucaccuacaacgggaagcggcuggagcccaacugggccuccgugaagaaggaccugaucagcuacggcgggggcuggcgccucuccgcgcaguggcagaagggggaggaggugcaggucaucgccguggagcccggcaagaaccccaagaacuuccagacgaugcccggcaccuuccagaccaccacgggggagaucggcgccaucgcccuggacuucaagcccgggaccagcggcagccccaucaucaaccgggagggcaagguggucgggcuguacggcaacgggguggugaccaagaacggcggguacgucuccggcaucgcccagaccaacgcggagccggacggccccacgcccgagcuggaggaggagauguucaagaagcgcaaccucaccaucauggaccugcaccccgggagcggcaagacccggaaguaccugccggccguggugcgcgaggccaucaagcggcgccuccggacccugauccuggcccccacgcgcgucguggccgcggagauggaggaggcccucaaggggcugcccauccgguaccagaccaccgccaccaaguccgagcacacgggccgcgagaucguggaccugaugugccacgccaccuucaccaugcggcuccugagccccguccgcgugccgaacuacaaccugaucaucauggacgaggcccacuucaccgaccccgcguccaucgccgcccggggguacaucagcacgcgcgugggcaugggcgaggccgcggccaucuucaugaccgccacgccgcccgggaccgccgacgccuucccgcaguccaacgcgcccauccaggacgaggagcgggacauccccgagcgcagcuggaacuccggcaacgaguggaucacggacuucgccgggaagaccgucugguucgugcccagcaucaaggccggcaacgacaucgccaacugccuccgcaagaacgggaagaaggugauccagcugucccggaagaccuucgacaccgaguaccagaagacgaagcugaacgacugggacuucgucgugaccaccgacaucagcgagaugggcgccaacuucaaggcggaccgcgugaucgacccgcggcgcugccucaagcccgucauccugaccgacggccccgagcgggugauccuggccgggcccaugccggugacggccgccuccgccgcgcagcgccggggccgcgucgggcggaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgcgagaaguccgcggccaucgacggcgaguaccggcugaagggcgagucccgcaagaccuucguggagcugaugcggcgcggggaccuccccgucuggcuggcccacaagguggccagcgagggcaucaaguacacggaccggaaguggugcuucgacgggcagcgcaacaaccagauccuggaggagaacauggacguggagaucuggaccaaggagggcgagaagaagaagcuccggccccgcuggcuggacgcccggaccuacuccgacccgcuggcgcucaaggaguucaaggacuucgccgccggccgcaagagcaucgcccuggaccuggucaccgagaucgggcgcgugcccucccaccucgcccaccggacgcgcaacgcgcuggacaaccuggugaugcuccacaccagcgagcacggcgggcgggccuaccgccacgccgucgaggagcugcccgagaccauggagacccugcuccugcugggccucaugauccugcugaccggcggggccaugcuguuccugaucagcgggaaggggaucggcaagaccuccaucgggcugaucugcgugaucgccagcuccggcaugcucuggauggcggagaucccgcugcaguggaucgccagcgccaucgugcuggaguucuucaugaugguccuccugauccccgagcccgagaagcagcggacgccccaggacaaccagcuggccuacguggugaucgggauccucacccuggccgcgaucaucgccgccaacgagaugggccugcucgagacgaccaagcgcgaccugggcauguccaaggagccgggggucgugagccccaccuccuaccuggacguggaccuccaccccgccagcgcguggacccuguacgccgucgccacgaccgugaucacccccaugcugcggcacaccaucgagaacuccacggccaacgugagccucgccgcgaucgccaaccaggccgucgugcugaugggccuggacaagggguggccgaucuccaagauggaccucggcgugccccugcuggcccucgggugcuacagccaggucaacccccugacccugaccgccgcggugcuccugcugaucacccacuacgccaucaucggccccggccuccaggccaaggccacgcgcgaggcccagaagcggaccgcggccgggaucaugaagaacccgaccguggacggcaucaugaccaucgaccuggaccccgucaucuacgacuccaaguucgagaagcagcugggccaggugaugcuccuggugcugugcgccguccagcuccugcugaugcgcacgagcugggcccucugcgaggcgcugacccuggccaccggccccaucaccacgcucugggagggcucccccgggaaguucuggaacaccaccaucgccgugagcauggccaacaucuuccggggcuccuaccuggccggggcgggccuggccuucagcaucaugaaguccguggggaccggcaagcgcggcacggggagccagggcgagacccucggggagaaguggaagaagaagcugaaccagcugagccggaaggaguucgaccucuacaagaaguccggcaucaccgaggucgaccgcaccgaggccaaggaggggcugaagcggggcgagaccacgcaccacgccgugagccgcggcaccgccaagcugcagugguucguggagcggaacauggucaucccggaggggcgcgugaucgaccucggcugcgggcggggcgggugguccuacuacugcgcgggccugaagaaggugaccgagguccgcggcuacaccaagggcgggcccgggcacgaggagcccgugcccaugagcacguacggcuggaacaucgugaagcugauguccgggaaggacgucuucuaccucccgcccgagaagugcgacacccugcugugcgacaucggcgagagcucccccagccccaccguggaggagucccggaccauccgcgugcugaagauggucgagccguggcucaagaacaaccaguucugcaucaaggugcugaaccccuacaugcccacggugaucgagcaccuggagcgccuccagcggaagcacggcgggaugcugguccgcaacccccugagccggaacuccacccacgagauguacuggaucagcaacggcaccgggaacaucguggccuccgugaacauggucagccgccuccugcugaaccgguucaccaugacgcaccgccggccgaccaucgagaaggacguggaccucggcgccggcacccgccacgugaacgccgagcccgagacccccaacauggacgucaucggggagcggaucaagcgcaucaaggaggagcacaacuccacguggcacuacgacgacgagaacccguacaagaccugggccuaccacggcagcuacgaggugaaggcgaccggguccgccagcuccaugaucaacggcgucgugaagcugcugaccaagcccugggacgugguccccauggugacgcagauggccaugaccgacaccacccccuucgggcagcagcggguguucaaggagaaggucgacacgcgcaccccgcggagcaugcccggcacccgccgggugaugggcaucaccgccgaguggcucuggcgcacgcuggggcggaacaagaagccccgccugugcacccgggaggaguucaccaagaaggugcgcaccaacgcggccaugggcgccgucuucacggaggagaaccagugggacagcgccaaggccgcgguggaggacgaggacuucuggaagcucguggaccgcgagcgggagcugcacaagcuggggaagugcggcuccugcgucuacaacaugauggggaagcgcgagaagaagcucggcgaguucggcaaggccaaggggagccgggccaucugguacauguggcugggcgcccgcuaccuggaguucgaggcccucggguuccugaacgaggaccacugguucucccgggagaacagcuacuccggcguggagggggagggccugcacaagcucggcuacauccugcgcgacaucagcaagauccccgggggcgcgauguacgccgacgacaccgccgggugggacacccggaucaccgaggacgaccugcacaacgaggagaagaucacgcagcagauggacccggagcaccgccagcucgccaacgccaucuucaagcugaccuaccagaacaagguggucaaggugcagcggcccacccccaccggcaccgugauggacaucaucucccgcaaggaccagcggggcagcgggcaggucggcacguacgggcugaacaccuucaccaacauggaggugcagcucauccgccagauggagggcgagggggugcuguccaaggcggaccuggagaacccccaccucccggagaagaagaucacccaguggcuggagacgaagggcgucgagcggcugcgccggauggccaucagcggcgacgacugcguggugaagcccaucgacgaccgcuucgccaacgcccuccuggcccugaacgacauggggaagguccggaaggacaucccccaguggcagcccuccaagggcuggcacgacuggcagcaggucccguucugcagccaccacuuccacgagcucaucaugaaggacgggcgcaagcuggugguccccugccggccccaggacgagcugaucggccgcgcgcggaucucccagggggccggcuggagccuccgcgagaccgccugccugggcaaggccuacgcgcagauguggucccugauguacuuccaccgccgggaccuccgccuggccagcaacgccaucugcuccgccgugcccgugcacugggucccgaccagccggaccacgugguccauccacgcccaccaccaguggaugaccaccgaggacaugcugaccguguggaaccgcguguggaucgaggacaaccccuggauggaggacaagacgcccgucaccaccugggagaacgugcccuaccucgggaagcgggaggaccaguggugcggcagccugaucgggcugaccagccgcgcgacgugggcccagaacaucccgaccgccauccagcagguccggucccucaucggcaacgaggaguuccuggacuacaugcccagcaugaagcgcuuccggaaggaggaggaguccgagggggccaucugguga

SEQ ID NO: 10128 - RNA, 9873 nt, Artificial Sequence
  derived and/or modified CDS sequence (opt1) from DENV-3__EU482558__SS-prME
accagccucugccucaugaugauccugcccgcggcgcuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacacguccgaccggauggggaugggcgugaccuaccucgcccugaucgccaccuucaagauccagcccuuccuggcccucggguucuuccugcgcaagcugaccagccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcuccaacaccaucuucacccugacggucgccuggcgcaccgccacccugauccucgccggggugagccugcugccggucugccaguccagcuccaugcggaagaccgacuggcuccccaugacgguggcggccaugggcgugccgccccucccgcuguucaucuucagccucaaggacacccugaagcgccgcuccuggccccugaacgagggggucauggccgugggccucgugagcauccuggccuccagccugcuccggaacgacguccccauggccggcccccugguggccggcgggcugcucaucgccugcuacgugaucaccgggaccuccgccgaccugacggucgagaaggccgccgacgugaccugggaggaggaggcggagcagaccggggugagccacaaccugaugaucaccgucgacgacgacgggaccaugcgcaucaaggacgacgagacggagaacauccucaccgugcugcugaagaccgcccuccugaucguguccggcaucuucccguacagcauccccgccacccugcucgucuggcacacguggcagaagcagacccagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacacgauguggcacgugacccggggcgccguccucaccuacaacgggaagcgccuggagcccaacugggcguccgugaagaaggaccugaucagcuacggcgggggcuggcggcucuccgcccaguggcagaagggggaggaggugcaggucaucgccguggagcccggcaagaaccccaagaacuuccagaccaugcccggcacguuccagaccaccaccggggagaucggcgccaucgcgcuggacuucaagcccgggacgagcggcagccccaucaucaaccgcgagggcaagguggucgggcuguacggcaacgggguggugaccaagaacggcggguacgucuccggcaucgcccagaccaacgccgagccggacggccccacccccgagcuggaggaggagauguucaagaagcggaaccucacgaucauggaccugcaccccgggagcggcaagacccgcaaguaccugccggccaucgugcgggaggccaucaagcgccggcuccgcacccugauccuggcgcccacccggguggucgccgccgagauggaggaggcccucaaggggcugcccauccgcuaccagacgaccgccaccaaguccgagcacaccggccgggagaucguggaccugaugugccacgcgacguucaccaugcgccuccugagccccgugcgggucccgaacuacaaccugaucaucauggacgaggcccacuucaccgaccccgccuccaucgccgcccgcggguacaucagcacccgggugggcaugggcgaggcggccgccaucuucaugacggccacgccgcccgggaccgcggacgccuucccgcaguccaacgcccccauccaggacgaggagcgcgacauccccgagcgcagcuggaacuccggcaacgaguggaucaccgacuucgccgggaagacggugugguucguccccagcaucaaggccggcaacgacaucgcgaacugccuccggaagaacgggaagaaggugauccagcugucccgcaagaccuucgacaccgaguaccagaagaccaagcugaacgacugggacuucguggucacgaccgacaucagcgagaugggcgccaacuucaaggccgaccgggugaucgacccgcgccggugccucaagcccgugauccugaccgacggccccgagcgcgucauccuggccgggcccaugccggugaccgccgcguccgccgcccagcggcgcggccggguggggcgcaacccccagaaggagaacgaccaguacaucuucaccggccagccccucaacaacgacgaggaccacgcccacuggacggaggccaagaugcugcuggacaacaucaacacccccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcccacaaggucgcgagcgagggcaucaaguacaccgaccgcaaguggugcuucgacgggcagcggaacaaccagauccuggaggagaacauggacguggagaucuggacgaaggagggcgagaagaagaagcuccgcccccgguggcuggacgcccgcaccuacuccgacccgcuggcccucaaggaguucaaggacuucgccgccggccgcaagagcaucgcgcuggaccuggugaccgagaucgggcggguccccucccaccucgcccaccgcacccggaacgcccuggacaaccuggugaugcuccacacgagcgagcacggcgggaaggccuaccgccacgccguggaggagcugcccgagaccauggagacccugcuccugcugggccucaugauccugcugaccgggggcgcgaugcuguuccugaucagcggcaaggggaucggcaagacguccaucgggcugaucugcgucaucgccagcuccggcaugcucuggauggccgagaucccgcugcaguggaucgccagcgccaucgugcuggaguucuucaugauggugcuccugauccccgagcccgagaagcagcggacgccccaggacaaccagcuggcguacgucgugaucgggauccucacccuggccgccaucaucgccgccaacgagaugggccugcucgagaccacgaagcgcgaccugggcauguccaaggagccggggguggucagccccaccuccuaccuggacguggaccuccaccccgcgagcgccuggacccuguacgccguggccaccacggucaucacccccaugcugcggcacaccaucgagaacuccaccgcgaacgugagccucgccgccaucgccaaccaggccgugguccugaugggccuggacaagggguggccgaucuccaagauggaccucggcgugccccugcuggcgcucgggugcuacagccaggugaacccccugacgcugaccgccgccguccuccugcugaucacccacuacgccaucaucggccccggccuccaggccaaggcgacccgcgaggcccagaagcggacggccgccgggaucaugaagaacccgaccguggacggcaucaugaccaucgaccuggaccccgugaucuacgacuccaaguucgagaagcagcuggggcaggucaugcuccuggugcugugcgccgugcagcuccugcugaugcgcaccagcugggcgcucugcgaggcccugacgcuggccaccggccccaucaccacccucugggagggcucccccgggaaguucuggaacacgaccaucgccgucagcauggcgaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggaguucgaccucuacaagaaguccggcaucacggagguggaccgcaccgaggccaaggaggggcugaagcggggcgagaucacccaccacgcggucagccgcggcuccgccaagcugcagugguucguggagcggaacauggugaucccggaggggcgcgucaucgaccucggcugcgggcggggcggguggagcuacuacugcgccggccugaagaaggugaccgaggugcgcggcuacacgaagggcgggcccgggcacgaggagcccguccccauguccaccuacggcuggaacaucgugaagcugaugagcgggaaggacguguucuaccucccgcccgagaagugcgacacccugcugugcgacaucggcgaguccagccccucccccaccgucgaggagagccggacgauccgcgugcugaagaugguggagccguggcucaagaacaaccaguucugcaucaagguccugaaccccuacaugcccaccgugaucgagcaccuggagcgccuccagcggaagcacggcgggaugcuggugcgcaacccccugucccggaacagcacccacgagauguacuggaucuccaacggcaccgggaacaucgucgccagcgugaacauggugucccgccuccugcugaaccgguucacgaugacccaccgccggccgaccaucgagaaggacgucgaccucggcgccggcacccgccacgugaacgcggagcccgagacgcccaacauggacgugaucggggagcggaucaagcgcaucaaggaggagcacaacagcaccuggcacuacgacgacgagaacccguacaagaccugggccuaccacggcuccuacgaggucaaggccaccgggagcgccuccagcaugaucaacggcguggucaagcugcugacgaagcccugggacguggugcccauggucacccagauggccaugaccgacaccacgcccuucgggcagcagcggguguucaaggagaagguggacacccgcaccccgcggagcaugcccggcacccgccgggucaugggcaucacggcggaguggcucuggcgcacccuggggcggaacaagaagccccgccugugcacccgggaggaguucaccaagaaggugcgcacgaacgccgccaugggcgccguguucaccgaggagaaccagugggacuccgcgaaggccgccgucgaggacgaggacuucuggaagcucguggaccgcgagcgggagcugcacaagcuggggaagugcggcagcugcguguacaacaugauggggaagcgcgagaagaagcucggcgaguucggcaaggccaaggggucccgggccaucugguacauguggcugggcgcgcgcuaccuggaguucgaggcccucggguuccugaacgaggaccacugguucagccgggagaacuccuacagcggcgucgagggggagggccugcacaagcucggcuacauccugcgcgacaucuccaagauccccgggggcgccauguacgccgacgacaccgccgggugggacacccggaucacggaggacgaccugcacaacgaggagaagaucacccagcagauggacccggagcaccgccagcucgcgaacgccaucuucaagcugaccuaccagaacaagguggugaagguccagcggcccacccccaccggcacggugauggacaucaucagccgcaaggaccagcggggcuccggccaggugggcaccuacgggcugaacaccuucaccaacauggaggcccagcucauccgccagauggagggcgaggggguccugagcaaggccgaccuggagaacccccaccucccggagaagaagaucacgcaguggcuggagaccaagggcguggagcggcugaagcgcauggccaucuccggcgacgacugcguggucaagcccaucgacgaccgguucgcgaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcuggucgugcccugccgcccccaggacgagcugaucggccgggcccgcaucagccagggggccggcuggucccuccgggagaccgcgugccugggcaaggccuacgcccagauguggagccugauguacuuccaccgccgcgaccuccggcuggccuccaacgcgaucugcagcgccgugcccguccacugggugccgaccucccgcacgaccuggagcauccacgcccaccaccaguggaugaccaccgaggacaugcugacgguguggaaccgggucuggaucgaggacaaccccuggauggaggacaagacccccgugaccaccugggagaacgugcccuaccucgggaagcgcgaggaccaguggugcggcagccugaucgggcugacgucccgggccaccugggcccagaacaucccgaccgcgauccagcagguccgcagccucaucggcaacgaggaguuccuggacuacaugcccuccaugaagcgguuccgcaaggaggaggagagcgagggggccaucugguga

SEQ ID NO: 10129 - RNA, 9873 nt, Artificial Sequence
  derived and/or modified CDS sequence (opt1) from DENV-3__EU482563__SS-prME
accagccugugccucaugaugauccugcccgccgcccuggccuuccaccucaccagccgcgacggggagccccggaugaucguggggaagaacgagcgcggcaagagccugcuguucaagaccgccagcgggaucaacaugugcacccucaucgccauggaccugggcgagaugugcgacgacaccgugaccuacaagugcccccacaucgccgagguggagcccgaggacaucgacugcuggugcaaccugaccagcaccugggugaccuacgggaccugcaaccaggccggcgagcaccggcgcgacaagcgguccguggcgcucgcgccccacgugggcauggggcuggacacgcgcacccagaccuggaugagcgccgagggcgccuggcggcaggucgagaaggucgagaccugggcgcugcgccacccgggguucacgauccucgcccuguuccuggcccacuacaucggcaccucccucacccagaagguggugaucuucguccugcugaugcucgugacccccagcaugacgaugcggugcgugggggucggcaaccgcgacuucguggagggccuguccggggccaccuggguggacgucgugcuggagcacggcgggugcgugaccaccauggccaagaacaagcccacgcucgacaucgagcugcagaagaccgaggcgacccagcuggccacccuccggaagcugugcaucgagggcaagaucacgaacaucaccaccgacagccgcugccccacccagggcgaggccguccugccggaggagcaggaccagaacuacgugugcaagcacacguacguggaccggggguggggcaacgggugcggccucuucgggaagggcucccuggugaccugcgccaaguuccagugccuggagcccaucgagggcaagguggugcaguacgagaaccucaaguacaccgucaucaucaccgugcacacgggggaccagcaccaggucggcaacgagacccagggggugaccgccgagaucacgccccaggcgagcacgaccgaggccauccugcccgaguacggcacccuggggcucgagugcuccccgcgcaccggccuggacuucaacgagaugauccugcucaccaugaagaacaaggccuggauggugcaccggcagugguucuucgaccugccccugcccuggacgagcggcgccaccaccgagacccccacguggaaccgcaaggagcuccuggucaccuucaagaacgcccacgcgaagaagcaggagguggugguccuggggucccaggagggcgccaugcacaccgcccucaccggggccacggagauccagaacagcggcgggaccuccaucuucgccggccaccugaagugccggcugaagauggacaagcucgagcugaagggcaugagcuacgcgaugugcaccaacaccuucgugcugaagaaggagguguccgagacgcagcacgggaccauccucaucaaggucgaguacaagggcgaggacgccccgugcaagauccccuucagcaccgaggacgggcagggcaaggcccacaacggccgccugaucaccgccaaccccguggugacgaagaaggaggagcccgucaacaucgaggcggagccgcccuucggggagagcaacaucgugaucggcaucggggacaacgcccugaagaucaacugguacaagaagggcuccagcaucgggaagauguucgaggccaccgcccggggcgcccgccggauggcgauccugggcgacaccgccugggacuucggguccgugggcgggguccucaacagccugggcaagauggugcaccagaucuucggguccgccuacaccgcccuguucagcggcguguccugggucaugaagaucggcaucggggugcuccugacguggaucggccugaacagcaagaacaccuccaugagcuucuccugcaucgccaucgggaucaucacccucuaccugggcgcggugguccaggccgacaccgggugcgugaucaacuggaagggcaaggagcugaagugcggcagcgggaucuucgugacgaacgagguccacaccuggaccgagcaguacaaguuccaggccgacucccccaagcgccucgccaccgccaucgcgggcgccugggagaacggggugugcggcauccgcagcacgacccggauggagaaccugcuguggaagcaggucgccaacgagcucaacuacauccugugggagaacaacaucaagcugaccgucguggugggggacaucaucggcguccucgagcagggcaagcgcacccugacgccccagccgauggagcugaaguacuccuggaagaccugggggaaggccaagaucgugaccgcggagacccagaacagcuccuucaucaucgacggccccaacacgcccgagugccccagcgccucccgggccuggaacgugugggaggucgaggacuacggguucggcguguucaccaccaacaucuggcucaagcugcgcgagguguacacccagcugugcgaccaccggcucaugagcgccgccgucaaggacgagcgcgcggugcacgccgacaugggcuacuggaucgagagccagaagaacggguccuggaagcuggagaaggccagccugaucgaggugaagaccugcacguggccgaagucccacacccucuggagcaacggcguccuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgcgggcagcgggaaggucgacaacuucacgaugggcgugcugugccucgccauccuguucgaggaggugaugcgggggaaguucggcaagaagcacaugaucgccggggucuucuucaccuucgugcugcuccuguccggccagaucaccuggcgcgacauggcccacacccugaucaugaucggcagcaacgccuccgaccggauggggaugggcgugacguaccucgcgcugaucgccaccuucaagauccagcccuuccuggcccucggguucuuccugcgcaagcugaccagccgggagaaccuccugcugggcgucggccucgccauggcgaccacgcugcagcugcccgaggacaucgagcagauggccaacgggaucgcccucggccugauggcccugaagcucaucacccaguucgagaccuaccagcuguggaccgcccugaucagccucacgugcuccaacaccaucuucacccugaccguggcguggcgcacggccacccugauccucgccggggucagccugcugccggugugccaguccagcuccaugcggaaguccgacuggcuccccaugaccguggccgccaugggcgugccgccccucccgcuguucaucuucucccucaaggacacccugaagcgccgcagcuggccccugaacgagggggugauggcggugggccucgucuccauccuggccagcucccugcuccggaacgacgugcccauggccggcccccugguggccgggggccugcucaucgccugcuacgucaucacggggaccagcgcggaccugaccguggagaaggccgccgacgugaccugggaggaggaggccgagcagacgggcgucucccacaaccugaugaucaccguggacgacgacgggaccaugcgcaucaaggacgacgagaccgagaacauccucaccgugcugcugaagacggcccuccugaucgucagcggcaucuucccguacuccauccccgcgacccugcucguguggcacaccuggcagaagcagacccggcgcagcggcgugcugugggacguccccagcccgcccgagacgcagaaggccgagcuggaggaggggguguaccggaucaagcagcagggcaucuucgggaagacccaggugggcgucggggugcagaaggagggcguguuccacaccauguggcacgucacccgcggcgccgugcucacguacaacgggaagcggcuggagcccaacugggccagcgugaagaaggaccugaucuccuacggcgggggcuggcgccucagcgcgcaguggcagaagggggaggagguccaggugaucgccguggagcccggcaagaaccccaagaacuuccagaccaugcccggcaccuuccagaccacgaccggggagaucggcgccaucgcccuggacuucaagcccgggaccagcggcucccccaucaucaaccgggagggcaaggucguggggcuguacggcaacgggguggucaccaagaacggcggguacgugagcggcaucgcccagacgaacgcggagccggacggccccacccccgagcuggaggaggagauguucaagaagcgcaaccucaccaucauggaccugcaccccggguccggcaagacccggaaguaccugccggccaucgugcgcgaggccaucaagcggcgccuccggacgcugauccuggcccccacccgcgucguggccgcggagauggaggaggcccucaaggggcugcccauccgguaccagaccaccgccaccaagagcgagcacaccggccgcgagaucguggaccugaugugccacgccaccuucaccaugcggcuccugucccccguccgcgugccgaacuacaaccugaucaucauggacgaggcccacuucacggaccccgcgagcaucgccgcccggggguacaucuccacccgcgugggcaugggcgaggccgcggccaucuucaugaccgccacgccgcccgggacggccgacgccuucccgcagagcaacgcgcccauccaggacgaggagcgcgacauccccgagcgguccuggaacagcggcaacgaguggaucaccgacuucgccgggaagaccgucugguucgugcccuccaucaaggccggcaacgacaucgccaacugccuccgcaagaacgggaagaaggugauccagcugagccggaagaccuucgacacggaguaccagaagaccaagcugaacgacugggacuucgucgugaccaccgacaucuccgagaugggcgccaacuucaaggcggaccgcgugaucgacccgcggcgcugccucaagcccgucauccugacggacggccccgagcgggugauccuggccgggcccaugccggugaccgccgccagcgccgcgcagcgccggggccgcgucgggcggaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgcgagaaguccgcggccaucgacggcgaguaccggcugaagggcgagagccgcaagacguucguggagcugaugcggcgcggggaccuccccgucuggcuggcccacaagguggccuccgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcccgcaccuacagcgacccgcuggcgcucaaggaguucaaggacuucgccgccggccggaaguccaucgcccuggaccuggucacggagaucgggcgcgugcccagccaccucgcccaccggacccgcaacgcgcuggacaaccuggugaugcuccacaccagcgagcacggcgggaaggccuaccggcacgccgucgaggagcugcccgagaccauggagacgcugcuccugcugggccucaugauccugcugaccgggggcgccaugcuguuccugaucuccggcaaggggaucggcaagaccagcaucgggcugaucugcgugaucgccuccagcggcaugcucuggauggcggagaucccgcugcaguggaucgccuccgccaucgugcuggaguucuucaugaugguccuccugauccccgagcccgagaagcagcgcacgccccaggacaaccagcuggccuacguggugaucgggauccucacgcuggccgcgaucaucgccgccaacgagaugggccugcucgagaccaccaagcgggaccugggcaugagcaaggagccgggggucgugucccccaccagcuaccuggacguggaccuccaccccgccuccgcguggacgcuguacgccgucgccaccaccgugaucacccccaugcugcgccacacgaucgagaacagcaccgccaacgugucccucgccgcgaucgccaaccaggccgucgugcugaugggccuggacaagggguggccgaucagcaagauggaccucggcgugccccugcuggcccucgggugcuacucccaggucaacccccugacccugaccgccgcggugcuccugcugaucacgcacuacgccaucaucggccccggccuccaggccaaggccacccgggaggcccagaagcgcaccgcggccgggaucaugaagaacccgaccguggacggcaucaugacgaucgaccuggaccccgucaucuacgacagcaaguucgagaagcagcugggccaggugaugcuccuggugcugugcgccguccagcuccugcugaugcggaccuccugggcccucugcgaggcgcugacccuggccaccggccccaucacgacccucugggagggcagccccgggaaguucuggaacaccaccaucgccguguccauggccaacaucuuccgcggcagcuaccuggccggggcgggccuggccuucuccaucaugaaguccguggggacgggcaagcggggcaccgggagccagggcgagacccucggggagaaguggaagaagaagcugaaccagcugucccgcaaggaguucgaccucuacaagaaguccggcaucaccgaggucgaccggaccgaggccaaggaggggcugaagcgcggcgagaucacgcaccacgccgugucccggggcagcgccaagcugcagugguucguggagcgcaacauggucaucccggaggggcgggugaucgaccucggcugcgggcgcggcgggugguccuacuacugcgcgggccugaagaaggugaccgagguccggggcuacaccaagggcgggcccgggcacgaggagcccgugcccaugagcaccuacggcuggaacaucgugaagcugauguccgggaaggacgucuucuaccucccgcccgagaagugcgacacgcugcugugcgacaucggcgagagcucccccagccccaccguggaggagucccgcaccauccgcgugcugaagauggucgagccguggcucaagaacaaccaguucugcaucaaggugcugaaccccuacaugcccaccgugaucgagcaccuggagcggcuccagcgcaagcacggcgggaugcugguccggaacccccugagccgcaacuccacgcacgagauguacuggaucagcaacggcaccgggaacaucguggccuccgugaacauggucagccggcuccugcugaaccgcuucaccaugacccaccggcgcccgacgaucgagaaggacguggaccucggcgccggcacccggcacgugaacgccgagcccgagacccccaacauggacgucaucggggagcgcaucaagcggaucaaggaggagcacaacuccaccuggcacuacgacgacgagaacccguacaagacgugggccuaccacggcagcuacgaggugaaggcgaccggguccgccagcagcaugaucaacggcgucgugaagcugcugaccaagcccugggacgugguccccauggugacccagauggccaugacggacaccacccccuucgggcagcagcgcguguucaaggagaaggucgacacccggacgccgcgcuccaugcccggcacccggcgcgugaugggcaucaccgccgaguggcucuggcggacccuggggcgcaacaagaagccccggcugugcacgcgcgaggaguucaccaagaaggugcgcaccaacgcggccaugggcgccgucuucaccgaggagaaccagugggacagcgccaaggccgcgguggaggacgaggacuucuggaagcucguggaccgggagcgcgagcugcacaagcuggggaagugcggcuccugcgucuacaacaugauggggaagcgggagaagaagcucggcgaguucggcaaggccaaggggagccgcgccaucugguacauguggcugggcgcccgguaccuggaguucgaggcccucggguuccugaacgaggaccacugguucucccgcgagaacagcuacuccggcguggagggggagggccugcacaagcucggcuacauccugcgggacaucagcaagauccccgggggcgcgauguacgccgacgacacggccgggugggacacccgcaucaccgaggacgaccugcacaacgaggagaagaucacccagcagauggacccggagcaccggcagcucgccaacgccaucuucaagcugacguaccagaacaagguggucaaggugcagcgccccacccccaccggcaccgugauggacaucaucucccggaaggaccagcgcggcagcgggcaggucggcaccuacgggcugaacacguucaccaacauggaggcgcagcucauccggcagauggagggcgagggggugcugaccaaggccgaccuggagaacccccaccucuccgagaagaagaucacccaguggcuggagacgaagggcguggagcgccugaagcggauggccaucagcggcgacgacugcgucgugaagccgaucgacgaccgcuucgccaacgcccuccuggcgcugaacgacauggggaaggugcggaaggacaucccccaguggcagcccuccaagggcuggcacgacuggcagcagguccccuucugcagccaccacuuccacgagcucaucaugaaggacgggcgcaagcugguggugccgugccggccccaggacgagcugaucggccgcgcccggaucucccagggggccggcuggagccuccgcgagaccgccugccugggcaaggcguacgcccagauguggucccugauguacuuccaccgccgggaccuccgccuggccagcaacgccaucugcuccgccguccccgugcacugggugcccaccagccggaccacguggagcauccacgcgcaccaccaguggaugaccaccgaggacaugcugaccgucuggaaccgcguguggaucgaggacaacccguggauggaggacaagacgcccgugaccaccugggagaacguccccuaccucgggaagcgggaggaccaguggugcggcucccugaucgggcugaccagccgcgccacgugggcccagaacauccccaccgccauccagcagguccggucccucaucggcaacgaggaguuccuggacuacaugccgagcaugaagcgcuuccggaaggaggaggaguccgagggggccaucugguga

SEQ ID NO: 10130 - RNA, 9873 nt, Artificial Sequence
  derived and/or modified CDS sequence (opt1) from DENV-3__EU529696__SS-prME
accagccucugccucaugaugauccugcccgccgcccuggcguuccaccucaccagccgggacggcgagccccggaugaucguggggaagaacgagcgcggcaagagccugcuguucaagacggccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucggggugaucacccucuaccugggcgccgugguccaggcggacauggggugcgugaucaacuggaagggcaaggagcugaagugcggcagcgggaucuucgugacgaacgagguccacaccuggaccgagcaguacaaguuccaggccgacucccccaagcgccucgccaccgccaucgccggcgcgugggagaacggggugugcggcauccgcagcacgacccggauggagaaccugcuguggaagcagaucgccaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagauccagaacagcuccuucaucaucgacggccccaacacccccgagugccccagcgcgucccgggccuggaacgugugggagguggaggacuacggguucggcgucuucacgaccaacaucuggcucaagcugcgcgagguguacacccagcugugcgaccaccggcucaugagcgccgccgugaaggacgagcgcgccguccacgcggacaugggcuacuggaucgagagccagaagaacggguccuggaagcuggagaaggccagccugaucgaggugaagaccugcaccuggccgaagucccacacgcucuggagcaacggcgugcuggaguccgacaugaucauccccaagagccuggccgggcccaucucccagcacaacuaccggccgggcuaccacacccagaccgccgggcccuggcaccucggcaagcuggaccuggacuucaacuacugcgagggcaccacggucgugaucaccgagaacugcgggacccgcggccccagccuccggaccacgaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgcgauccuguucgaggaggugaugcgggggaaguucggcaagaagcacaugaucgccgggguguucuucacguucguccugcuccuguccggccagaucaccuggcgcgacauggcccacacccugaucaugaucggcagcaacgccuccgacaagauggggaugggcgugaccuaccucgcccugaucgcgacguucaagauccagcccuuccuggcccucggguucuuccugcggaagcugaccagccgcgagaaccuccugcugggcgugggccucgccauggccaccacccugcagcugcccgaggacaucgagcagauggcgaacgggaucgcccucggccugauggcccugaagcucaucacgcaguucgagaccuaccagcuguggaccgcccugaucagccugaccugcuccaacacgauguucacccugaccgucgccuggcggaccgcgacgcugauccucgccggggugagccugcugccggucugccaguccagcuccaugcgcaagaccgacuggcuccccauggccguggccgccaugggcgugccgccccucccgcuguucaucuucagccucaaggacacccugaagcggcgcuccuggccccugaacgagggggucauggcggugggccucgugagcauccuggccuccagccugcuccgcaacgacguccccauggccggcccccugguggccgggggccugcucaucgccugcuacgugaucaccgggacguccgcggaccugaccgucgagaaggccgccgacaucaccugggaggaggaggccgagcagaccggcgugagccacaaccugaugaucacgguggacgacgacgggaccaugcggaucaaggacgacgagaccgagaacauccucaccguccugcugaagaccgcccuccugaucguguccggcguguucccguacagcauccccgcgacgcugcucgucuggcacaccuggcagaagcagacccagcgcuccggcgugcugugggacgugcccagcccgcccgagacccagaaggccgagcuggaggagggggucuaccggaucaagcagcagggcaucuucgggaagacccaggugggcguggggguccagaaggagggcguguuccacaccauguggcacgugacccgcggcgccguccucaccuacaacgggaagcggcuggagcccaacugggccuccgugaagaaggaccugaucagcuacggcgggggcuggcgccucuccgcgcaguggcagaagggggaggaggugcaggucaucgccguggagcccggcaagaaccccaagaacuuccagacgaugcccggcaccuuccagaccaccacgggggagaucggcgccaucgcccuggacuucaagcccgggaccagcggcagccccaucaucaaccgggagggcaagguggucgggcuguacggcaacgggguggugaccaagaacggcggguacgucuccggcaucgcccagaccaacgcggagccggacggccccacgcccgagcuggaggaggagauguucaagaagcgcaaccucaccaucauggaccugcaccccgggagcggcaagacccggaaguaccugccggccguggugcgcgaggccaucaagcggcgccuccggacccugauccuggcccccacgcgcgucguggccgcggagauggaggaggcccucaaggggcugcccauccgguaccagaccaccgccaccaaguccgagcacacgggccgcgagaucguggaccugaugugccacgccaccuucaccaugcggcuccugagccccguccgcgugccgaacuacaaccugaucaucauggacgaggcccacuucaccgaccccgcguccaucgccgcccggggguacaucagcacgcgcgugggcaugggcgaggccgcggccaucuucaugaccgccacgccgcccgggaccgccgacgccuucccgcaguccaacgcgcccauccaggacgaggagcgggacauccccgagcgcagcuggaacuccggcaacgaguggaucacggacuucgccgggaagaccgucugguucgugcccagcaucaaggccggcaacgacaucgccaacugccuccgcaagaacgggaagaaggugauccagcugucccggaagaccuucgacaccgaguaccagaagacgaagcugaacgacugggacuucgucgugaccaccgacaucagcgagaugggcgccaacuucaaggcggaccgcgugaucgacccgcggcgcugccucaagcccgucauccugaccgacggccccgagcgggugauccuggccgggcccaugccggugacggccgccuccgccgcgcagcgccggggccgcgucgggcggaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgcgagaaguccgcggccaucgacggcgaguaccggcugaagggcgagucccgcaagaccuucguggagcugaugcggcgcggggaccuccccgucuggcuggcccacaagguggccagcgagggcaucaaguacacggaccggaaguggugcuucgacgggcagcgcaacaaccagauccuggaggagaacauggacguggagaucuggaccaaggagggcgagaagaagaagcuccggccccgcuggcuggacgcccggaccuacuccgacccgcuggcgcucaaggaguucaaggacuucgccgccggccgcaagagcaucgcccuggaccuggucaccgagaucgggcgcgugcccucccaccucgcccaccggacgcgcaacgcgcuggacaaccuggugaugcuccacaccagcgagcacggcgggcgggccuaccgccacgccgucgaggagcugcccgagaccauggagacccugcuccugcugggccucaugauccugcugaccggcggggccaugcuguuccugaucagcgggaaggggaucggcaagaccuccaucgggcugaucugcgugaucgccagcuccggcaugcucuggauggcggagaucccgcugcaguggaucgccagcgccaucgugcuggaguucuucaugaugguccuccugauccccgagcccgagaagcagcggacgccccaggacaaccagcuggccuacguggugaucgggauccucacccuggccgcgaucaucgccgccaacgagaugggccugcucgagacgaccaagcgcgaccugggcauguccaaggagccgggggucgugagccccaccuccuaccuggacguggaccuccaccccgccagcgcguggacccuguacgccgucgccacgaccgugaucacccccaugcugcggcacaccaucgagaacuccacggccaacgugagccucgccgcgaucgccaaccaggccgucgugcugaugggccuggacaagggguggccgaucuccaagauggaccucggcgugccccugcuggcccucgggugcuacagccaggucaacccccugacccugaccgccgcggugcuccugcugaucacccacuacgccaucaucggccccggccuccaggccaaggccacgcgcgaggcccagaagcggaccgcggccgggaucaugaagaacccgaccguggacggcaucaugaccaucgaccuggaccccgucaucuacgacuccaaguucgagaagcagcugggccaggugaugcuccuggugcugugcgccguccagcuccugcugaugcgcacgagcugggcccucugcgaggcgcugacccuggccaccggccccaucaccacgcucugggagggcucccccgggaaguucuggaacaccaccaucgccgugagcauggccaacaucuuccggggcuccuaccuggccggggcgggccuggccuucagcaucaugaaguccguggggaccggcaagcgcggcacggggagccagggcgagacccucggggagaaguggaagaagaagcugaaccagcugagccggaaggaguucgaccucuacaagaaguccggcaucaccgaggucgaccgcaccgaggccaaggaggggcugaagcggggcgagaccacgcaccacgccgugagccgcggcaccgccaagcugcagugguucguggagcggaacauggucaucccggaggggcgcgugaucgaccucggcugcgggcggggcgggugguccuacuacugcgcgggccugaagaaggugaccgagguccgcggcuacaccaagggcgggcccgggcacgaggagcccgugcccaugagcacguacggcuggaacaucgugaagcugauguccgggaaggacgucuucuaccucccgcccgagaagugcgacacccugcugugcgacaucggcgagagcucccccagccccaccguggaggagucccggaccauccgcgugcugaagauggucgagccguggcucaagaacaaccaguucugcaucaaggugcugaaccccuacaugcccacggugaucgagcaccuggagcgccuccagcggaagcacggcgggaugcugguccgcaacccccugagccggaacuccacccacgagauguacuggaucagcaacggcaccgggaacaucguggccuccgugaacauggucagccgccuccugcugaaccgguucaccaugacgcaccgccggccgaccaucgagaaggacguggaccucggcgccggcacccgccacgugaacgccgagcccgagacccccaacauggacgucaucggggagcggaucaagcgcaucaaggaggagcacaacuccacguggcacuacgacgacgagaacccguacaagaccugggccuaccacggcagcuacgaggugaaggcgaccggguccgccagcuccaugaucaacggcgucgugaagcugcugaccaagcccugggacgugguccccauggugacgcagauggccaugaccgacaccacccccuucgggcagcagcggguguucaaggagaaggucgacacgcgcaccccgcggagcaugcccggcacccgccgggugaugggcaucaccgccgaguggcucuggcgcacgcuggggcggaacaagaagccccgccugugcacccgggaggaguucaccaagaaggugcgcaccaacgcggccaugggcgccgucuucacggaggagaaccagugggacagcgccaaggccgcgguggaggacgaggacuucuggaagcucguggaccgcgagcgggagcugcacaagcuggggaagugcggcuccugcgucuacaacaugauggggaagcgcgagaagaagcucggcgaguucggcaaggccaaggggagccgggccaucugguacauguggcugggcgcccgcuaccuggaguucgaggcccucggguuccugaacgaggaccacugguucucccgggagaacagcuacuccggcguggagggggagggccugcacaagcucggcuacauccugcgcgacaucagcaagauccccgggggcgcgauguacgccgacgacaccgccgggugggacacccggaucaccgaggacgaccugcacaacgaggagaagaucacgcagcagauggacccggagcaccgccagcucgccaacgccaucuucaagcugaccuaccagaacaagguggucaaggugcagcggcccacccccaccggcaccgugauggacaucaucucccgcaaggaccagcggggcagcgggcaggucggcacguacgggcugaacaccuucaccaacauggaggcgcagcucauccgccagauggagggcgagggggugcuguccaaggccgaccuggagaacccccaccucccggagaagaagaucacccaguggcuggagacgaagggcguggagcggcugcgccggauggccaucagcggcgacgacugcgucgugaagcccaucgacgaccgcuucgccaacgcccuccuggcgcugaacgacauggggaaggugcggaaggacaucccccaguggcagcccuccaagggcuggcacgacuggcagcaggucccguucugcagccaccacuuccacgagcucaucaugaaggacgggcgcaagcugguggugcccugccggccccaggacgagcugaucggccgcgcccggaucucccagggggccggcuggagccuccgcgagaccgccugccugggcaaggcguacgcccagauguggucccugauguacuuccaccgccgggaccuccgccuggccagcaacgccaucugcuccgccguccccgugcacugggugccgaccagccggaccacgugguccauccacgcgcaccaccaguggaugaccaccgaggacaugcugaccgucuggaaccgcguguggaucgaggacaaccccuggauggaggacaagacgcccgugaccaccugggagaacguccccuaccucgggaagcgggaggaccaguggugcggcagccugaucgggcugaccagccgcgccacgugggcccagaacaucccgaccgccauccagcagguccggucccucaucggcaacgaggaguuccuggacuacaugcccagcaugaagcgcuuccggaaggaggaggaguccgagggggccaucugguga

SEQ ID NO: 10131 - RNA, 9873 nt, Artificial Sequence
  derived and/or modified CDS sequence (opt1) from DENV-3__EU529697__SS-prME
accagccugugccucaugaugauccugcccgccgcccuggcguuccaccucaccagccgggacggggagccccggaugaucguggggaagaacgagcgcggcaagagccugcuguucaagaccgccagcgggaucaacaugugcacccucaucgccauggaccugggcgagaugugcgacgacaccgugaccuacaagugcccccacaucgccgagguggagcccgaggacaucgacugcuggugcaaccugaccagcaccugggugaccuacgggaccugcaaccaggccggcgagcaccggcgcgacaagcgguccguggcgcucgcgccccacgugggcauggggcuggacacgcgcacccagaccuggaugagcgccgagggcgccuggcgccagguggagaaggucgagaccugggcgcugcgccacccgggguucacgauccucgcccuguuccuggcccacuacaucggcaccucccucacccagaagguggugaucuucguccugcugaugcucgugacccccagcaugacgaugcggugcgugggggucggcaaccgcgacuucguggagggccuguccggggccaccuggguggacgucgugcuggagcacggcgggugcgugaccaccauggccaagaacaagcccacgcucgacaucgagcugcagaagaccgaggcgacccagcuggccacccuccggaagcugugcaucgagggcaagaucacgaacaucaccaccgacagccgcugccccacccagggcgaggccgcccugccggaggagcaggaccagaacuacgucugcaagcacacguacguggaccggggguggggcaacgggugcggccucuucgggaagggcucccuggugaccugcgccaaguuccagugccuggagcccaucgagggcaaggucgugcaguacgagaaccucaaguacaccgugaucaucaccguccacacgggggaccagcaccaggugggcaacgagacccagggggucaccgcggagaucacgccccaggccagcacgaccgaggccauccugcccgaguacggcacccuggggcucgagugcuccccgcgcaccggccuggacuucaacgagaugauccugcucaccaugaagaacaaggccuggauggugcaccggcagugguucuucgaccugccccugcccuggacgagcggcgccaccaccgagacccccacguggaaccgcaaggagcuccuggugaccuucaagaacgcgcacgccaagaagcaggaggucguggugcuggggucccaggagggcgccaugcacaccgcccucaccggggccacggagauccagaacagcggcgggaccuccaucuucgcgggccaccugaagugccggcugaagauggacaagcucgagcugaagggcaugagcuacgccaugugcaccaacaccuucguccugaagaaggagguguccgagacgcagcacgggaccauccucaucaagguggaguacaagggcgaggacgccccgugcaagauccccuucagcaccgaggacgggcagggcaaggcccacaacggccgccugaucaccgcgaaccccgucgugacgaagaaggaggagcccgugaacaucgaggccgagccgcccuucggggagagcaacaucgucaucggcaucggggacaacgcccugaagaucaacugguacaagaagggcuccagcaucgggaagauguucgaggccaccgcccggggcgcgcgccggauggccauccugggcgacaccgccugggacuucggguccgugggcggggugcucaacagccugggcaagaugguccaccagaucuucggguccgccuacaccgcccuguucagcggcguguccugggugaugaagaucggcaucgggguccuccugacguggaucggccugaacagcaagaacaccuccaugagcuucuccugcaucgcgaucgggaucaucacccucuaccugggcgccguggugcaggccgacaccgggugcgucaucaacuggaagggcaaggagcugaagugcggcagcgggaucuucgugacgaacgaggugcacaccuggaccgagcaguacaaguuccaggccgacucccccaagcgccucgccaccgcgaucgccggcgccugggagaacggggucugcggcauccgcagcacgacccggauggagaaccugcuguggaagcaggucgccaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggcgaagaucgucaccgccgagacccagaacagcuccuucaucaucgacggccccaacacgcccgagugccccagcgccucccgggccuggaacgugugggagguggaggacuacggguucggcgucuucaccaccaacaucuggcucaagcugcgcgagguguacacccagcugugcgaccaccggcucaugagcgccgcggugaaggacgagcgcgccguccacgccgacaugggcuacuggaucgagagccagaagaacggguccuggaagcuggagaaggccagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgcggggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgccauccuguucgaggaggugaugcgggggaaguucggcaagaagcacaugaucgccgggguguucuucaccuucguccugcuccuguccggccagaucaccuggcgcgacauggcccacacccugaucaugaucggcagcaacgcguccgaccggauggggaugggcgugacgcaccucgcccugaucgccaccuucaagauccagcccuuccuggcccucggguucuuccugcgcaagcugaccagccgggagaaccuccugcugggcgugggccucgcgauggccaccacgcugcagcugcccgaggacaucgagcagauggccaacgggaucgcccucggccugauggcccugaagcucaucacccaguucgagaccuaccagcuguggaccgcgcugaucagccucacgugcuccaacaccaucuucacccugaccgucgccuggcgcacggccacccugauccucgccggggugagccugcugccggucugccaguccagcuccaugcggaaguccgacuggcuccccaugaccguggccgcgaugggcgugccgccccucccgcuguucaucuucucccucaaggacacccugaagcgccgcagcuggccccugaacgagggggucauggccgugggccucguguccauccuggccagcucccugcuccggaacgacguccccauggccggcccccugguggccgggggccugcucaucgcgugcuacgugaucacggggaccagcgccgaccugaccgucgagaaggccgccgacgugaccugggaggaggaggccgagcagacgggcgugucccacaaccugaugaucaccgucgacgacgacgggaccaugcgcaucaaggacgacgagaccgagaacauccucaccgugcugcugaagacggcgcuccugaucgugagcggcaucuucccguacuccauccccgccacccugcucgucuggcacaccuggcagaagcagacccggcgcagcggcgugcugugggacgugcccagcccgcccgagacgcagaaggccgagcuggaggagggggucuaccggaucaagcagcagggcaucuucgggaagacccaggugggcguggggguccagaaggagggcguguuccacaccauguggcacgugacccgcggcgccguccucacguacaacgggaagcggcuggagcccaacugggcgagcgugaagaaggaccugaucuccuacggcgggggcuggcgccucagcgcccaguggcagaagggggaggaggugcaggucaucgccguggagcccggcaagaaccccaagaacuuccagaccaugcccggcaccuuccagaccacgaccggggagaucggcgccaucgcccuggacuucaagcccgggaccagcggcucccccaucaucaaccgggagggcaagguggucgggcuguacggcaacgggguggugaccaagaacggcggguacgucagcggcaucgcgcagacgaacgccgagccggacggccccacccccgagcuggaggaggagauguucaagaagcgcaaccucaccaucauggaccugcaccccggguccggcaagacccggaaguaccugccggccaucgugcgcgaggccaucaagcggcgccuccggacgcugauccuggcccccacccgcguggucgcggccgagauggaggaggcccucaaggggcugcccauccgguaccagaccaccgccaccaagagcgagcacaccggccgcgagaucguggaccugaugugccacgccaccuucaccaugcggcuccugucccccgugcgcgucccgaacuacaaccugaucaucauggacgaggcgcacuucacggaccccgccagcaucgccgcccggggguacaucuccacccgcgugggcaugggcgaggcggccgccaucuucaugaccgccacgccgcccgggacggccgacgcguucccgcagagcaacgcccccauccaggacgaggagcgcgacauccccgagcgguccuggaacagcggcaacgaguggaucaccgacuucgccgggaagaccgugugguucguccccuccaucaaggccggcaacgacaucgccaacugccuccgcaagaacgggaagaaggugauccagcugagccggaagaccuucgacacggaguaccagaagaccaagcugaacgacugggacuucguggucaccaccgacaucuccgagaugggcgcgaacuucaaggccgaccgcgugaucgacccgcggcgcugccucaagcccgugauccugacggacggccccgagcgggucauccuggccgggcccaugccggugaccgccgccagcgcggcccagcgccggggccgcguggggcggaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgcgagaaguccgccgccaucgacggcgaguaccggcugaagggcgagagccgcaagacguucgucgagcugaugcggcgcggggaccuccccguguggcuggcccacaaggucgccuccgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcgcgcaccuacagcgacccgcuggcccucaaggaguucaaggacuucgccgccggccggaaguccaucgcccuggaccuggugacggagaucgggcgcguccccagccaccucgcgcaccggacccgcaacgcccuggacaaccuggugaugcuccacaccagcgagcacggcgggaaggccuaccggcacgccguggaggagcugcccgagaccauggagacgcugcuccugcugggccucaugauccugcugaccgggggcgccaugcuguuccugaucuccggcaaggggaucggcaagaccagcaucgggcugaucugcgucaucgcguccagcggcaugcucuggauggccgagaucccgcugcaguggaucgccuccgccaucgugcuggaguucuucaugauggugcuccugauccccgagcccgagaagcagcgcacgccccaggacaaccagcuggccuacgucgugaucgggauccucacgcuggcggccaucaucgccgccaacgagaugggccugcucgagaccaccaagcgggaccugggcaugagcaaggagccggggguggucucccccaccagcuaccuggacguggaccuccaccccgcguccgccuggacgcuguacgccguggccaccaccgucaucacccccaugcugcgccacacgaucgagaacagcaccgccaacgugucccucgcggccaucgccaaccaggccgugguccugaugggccugaacaagggguggccgaucagcaagauggaccucggcgugccccugcuggcccucgggugcuacucccaggugaacccccugacccugaccgcggccguccuccugcugaucacgcacuacgccaucaucggccccggccuccaggccaaggccacccgggaggcgcagaagcgcaccgccgccgggaucaugaagaacccgaccguggacggcaucaugacgaucgaccuggaccccgugaucuacgacagcaaguucgagaagcagcuggggcaggucaugcuccuggugcugugcgccgugcagcuccugcugaugcggaccuccugggcgcucugcgaggcccugacccuggccaccggccccaucacgacccucugggagggcagccccgggaaguucuggaacaccaccaucgccgucuccauggccaacaucuuccgcggcagcuaccuggcgggggccggccuggccuucuccaucaugaaguccguggggacgggcaagcggggcaccgggagccagggcgagacccucggggagaaguggaagaagaagcugaaccagcugucccgcaaggaguucgaccucuacaagaaguccggcaucaccgagguggaccggaccgaggccaaggaggggcugaagcgcggcgagaucacgcaccacgccgucucccggggcagcgcgaagcugcagugguucguggagcgcaacauggugaucccggaggggcgggucaucgaccucggcugcgggcgcggcgggugguccuacuacugcgccggccugaagaaggugaccgaggugcggggcuacaccaagggcgggcccgggcacgaggagcccguccccaugagcaccuacggcuggaacaucgugaagcugauguccgggaaggacguguucuaccucccgcccgagaagugcgacacgcugcugugcgacaucggcgagagcucccccagccccaccgucgaggagucccgcaccauccgcgugcugaagaugguggagccguggcucaagaacaaccaguucugcaucaagguccugaaccccuacaugcccaccgugaucgagcaccuggagcggcuccagcgcaagcacggcgggaugcuggugcggaacccccugagccgcaacuccacgcacgagauguacuggaucagcaacggcaccgggaacaucgucgccuccgugaacauggugagccggcuccugcugaaccgcuucaccaugacccaccggcgcccgacgaucgagaaggacgucgaccucggcgccggcacccggcacgugaacgccgagcccgagacccccaacauggacgugaucggggagcgcaucaagcggaucaaggaggagcacaacuccaccuggcacuacgacgacgagaacccguacaagacgugggcguaccacggcagcuacgaggucaaggccaccggguccgccagcagcaugaucaacggcguggucaagcugcugaccaagcccugggacguggugcccauggucacccagauggccaugacggacaccacccccuucgggcagcagcgcguguucaaggagaagguggacacccggacgccgcgcuccaugcccggcacccggcgcgucaugggcaucaccgcggaguggcucuggcggacccuggggcgcaacaagaagccccggcugugcacgcgcgaggaguucaccaagaaggugcgcaccaacgccgccaugggcgccguguucaccgaggagaaccagugggacagcgccaaggcggccgucgaggacgaggacuucuggaagcucguggaccgggagcgcgagcugcacaagcuggggaagugcggcuccugcguguacaacaugauggggaagcgggagaagaagcucggcgaguucggcaaggccaaggggagccgcgccaucugguacauguggcugggcgcccgguaccuggaguucgaggcgcucggguuccugaacgaggaccacugguucucccgcgagaacagcuacuccggcgucgagggggagggccugcacaagcucggcuacauccugcgggacaucagcaagauccccgggggcgccauguacgccgacgacacggccgggugggacacccgcaucaccgaggacgaccugcacaacgaggagaagaucacccagcagauggacccggagcaccggcagcucgccaacgcgaucuucaagcugacguaccagaacaagguggugaagguccagcgccccacccccaccggcaccgugauggacaucaucucccggaaggaccagcgcggcagcggccaggugggcaccuacgggcugaacacguucaccaacauggaggcccagcucauccggcagauggagggcgaggggguccugaccaaggccgaccuggagaacccccaccucuccgagaagaagaucacccaguggcuggagacgaagggcguggagcgccugaagcggauggccaucagcggcgacgacugcguggucaagccgaucgacgaccgcuucgccaacgcgcuccuggcccugaacgacauggggaaggugcggaaggacaucccccaguggcagcccuccaagggcuggcacgacuggcagcagguccccuucugcagccaccacuuccacgagcucaucaugaaggacgggcgcaagcuggucgugccgugccggccccaggacgagcugaucggccgcgcccggaucucccagggggccggcuggagccuccgcgagaccgcgugccugggcaaggccuacgcccagauguggucccugauguacuuccaccgccgggaccuccgccuggccagcaacgccaucugcuccgcggugcccguccacugggugcccaccagccggaccacguggagcauccacgcccaccaccaguggaugaccaccgaggacaugcugaccguguggaaccgcgucuggaucgaggacaacccguggauggaggacaagacgcccgugaccaccugggagaacgugcccuaccucgggaagcgggaggaccaguggugcggcucccugaucgggcugaccagccgcgccacgugggcccagaacauccccaccgccauccagcagguccggucccucaucggcaacgaggaguuccuggacuacaugccgagcaugaagcgcuuccggaaggaggaggaguccgagggggcgaucugguga

SEQ ID NO: 10132 - RNA, 9873 nt, Artificial Sequence
  derived and/or modified CDS sequence (opt1) from DENV-3__EU482564__SS-prME
accagccucugccucaugaugauccugcccgccgcccuggcguuccaccucaccagccgggacggcgagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucggggugaucacccucuaccugggcgccgugguccaggcggacauggggugcgugaucaacuggaagggcaaggagcugaagugcggcagcgggaucuucgugacgaacgagguccacaccuggaccgagcaguacaaguuccaggccgacucccccaagcgccucgccaccgccaucgccggcgcgugggagaacggggugugcggcauccgcagcacgacccggauggagaaccugcuguggaagcagaucgccaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagauccagaacagcuccuucaucaucgacggccccaacacccccgagugccccagcgcgucccgggccuggaacgugugggagguggaggacuacggguucggcgucuucacgaccaacaucuggcucaagcugcgcgagguguacacccagcugugcgaccaccggcucaugagcgccgccgugaaggacgagcgcgccguccacgcggacaugggcuacuggaucgagagccagaagaacggguccuggaagcuggagaaggccagccugaucgaggugaagaccugcaccuggccgaagucccacacgcucuggagcaacggcgugcuggaguccgacaugaucauccccaagagccuggccgggcccaucucccagcacaacuaccggccgggcuaccacacccagaccgccgggcccuggcaccucggcaagcuggaccuggacuucaacuacugcgagggcaccacggucgugaucaccgagaacugcgggacccgccggcccagccuccgcaccacgaccguguccggcaagcugauccacgaguggugcugccggagcugcacccugcccccgcuccgcuacaugggggaggacggcugcugguacgggauggagauccggcccaucuccgagaaggaggagaacauggucaagagccugguguccgccggcagcggcaagguggacaacuucaccauggggguccugugccucgcgauccuguucgaggaggugaugcgcggcaaguucgggaagaagcacaugaucgccggcguguucuucacguucguccugcuccuguccgggcagaucaccuggcgggacauggcccacacccugaucaugaucggcagcaacgccuccgacaagaugggcaugggggugaccuaccucgcccugaucgcgacguucaagauccagcccuuccuggcccucggcuucuuccugcgcaagcugaccagccgggagaaccuccugcugggggugggccucgccauggccaccacccugcagcugcccgaggacaucgagcagauggcgaacggcaucgcccucgggcugauggcccugaagcucaucacgcaguucgagaccuaccagcuguggaccgcccugaucagccugaccugcuccaacacgauguucacccugaccgucgccuggcgcaccgcgacgcugauccucgccggcgugagccugcugccggucugccaguccagcuccaugcggaagaccgacuggcuccccauggccguggccgccaugggggugccgccccucccgcuguucaucuucagccucaaggacacccugaagcgccgcuccuggccccugaacgagggcgucauggcgguggggcucgugagcauccuggccuccagccugcuccggaacgacguccccauggccggcccccugguggccggcgggcugcucaucgccugcuacgugaucaccggcacguccgcggaccugaccgucgagaaggccgccgacaucaccugggaggaggaggccgagcagaccggggugagccacaaccugaugaucacgguggacgacgacggcaccaugcgcaucaaggacgacgagaccgagaacauccucaccguccugcugaagaccgcccuccugaucguguccgggguguucccguacagcauccccgcgacgcugcucgucuggcacaccuggcagaagcagacccagcgguccggcgugcugugggacgugcccagcccgcccgagacccagaaggccgagcuggaggagggcgucuaccgcaucaagcagcaggggaucuucggcaagacccaggugggggugggcguccagaaggaggggguguuccacaccauguggcacgugacccggggcgccguccucaccuacaacggcaagcgccuggagcccaacugggccuccgugaagaaggaccugaucagcuacgggggcggguggcggcucuccgcgcaguggcagaagggcgaggaggugcaggucaucgccguggagcccgggaagaaccccaagaacuuccagacgaugcccggcaccuuccagaccaccacgggcgagaucggggccaucgcccuggacuucaagcccggcaccagcgggagccccaucaucaaccgcgagggcaagguggucggccuguacgggaacggcguggugaccaagaacgggggcuacgucuccgggaucgcccagaccaacgcggagccggacggccccacgcccgagcuggaggaggagauguucaagaagcggaaccucaccaucauggaccugcaccccggcagcgggaagacccgcaaguaccugccggccguggugcgggaggccaucaagcgccggcuccgcacccugauccuggcccccacgcgggucguggccgcggagauggaggaggcccucaagggccugcccauccgcuaccagaccaccgccaccaaguccgagcacacggggcgggagaucguggaccugaugugccacgccaccuucaccaugcgccuccugagccccguccgggugccgaacuacaaccugaucaucauggacgaggcccacuucaccgaccccgcguccaucgccgcccgcggcuacaucagcacgcggguggggaugggcgaggccgcggccaucuucaugaccgccacgccgcccggcaccgccgacgccuucccgcaguccaacgcgcccauccaggacgaggagcgcgacauccccgagcgcagcuggaacuccgggaacgaguggaucacggacuucgccggcaagaccgucugguucgugcccagcaucaaggccgggaacgacaucgccaacugccuccggaagaacggcaagaaggugauccagcugucccgcaagaccuucgacaccgaguaccagaagacgaagcugaacgacugggacuucgucgugaccaccgacaucagcgagaugggggccaacuucaaggcggaccgggugaucgacccgcgccggugccucaagcccgucauccugaccgacggccccgagcgcgugauccuggccggccccaugccggugacggccgccuccgccgcgcagcggcgcgggcgggucggccgcaacccccagaaggagaacgaccaguacaucuucaccgggcagccccucaacaacgacgaggaccacgcccacuggaccgaggccaagaugcugcuggacaacaucaacacccccgagggcaucaucccggcccucuucgagcccgagcgggagaaguccgcggccaucgacggggaguaccgccugaagggcgagucccggaagaccuucguggagcugaugcgccggggcgaccuccccgucuggcuggcccacaagguggccagcgaggggaucaaguacacggaccgcaaguggugcuucgacggccagcggaacaaccagauccuggaggagaacauggacguggagaucuggaccaaggagggggagaagaagaagcuccgcccccgguggcuggacgcccgcaccuacuccgacccgcuggcgcucaaggaguucaaggacuucgccgccggccgcaagagcaucgcccuggaccuggucaccgagaucggccgggugcccucccaccucgcccaccgcacgcggaacgcgcuggacaaccuggugaugcuccacaccagcgagcacgggggccgcgccuaccggcacgccgucgaggagcugcccgagaccauggagacccugcuccugcuggggcucaugauccugcugacgggcggggccaugcuguuccugaucagcggcaagggcaucgggaagaccuccaucggccugaucugcgugaucgccagcuccgggaugcucuggauggcggagaucccgcugcaguggaucgccagcgccaucgugcuggaguucuucaugaugguccuccugauccccgagcccgagaagcagcgcacgccccaggacaaccagcuggccuacguggugaucggcauccucacccuggccgcgaucaucgccgccaacgagauggggcugcucgagacgaccaagcgggaccugggcauguccaaggagccgggcgucgugagccccaccuccuaccuggacguggaccuccaccccgccagcgcguggacccuguacgccgucgccacgaccgugaucacccccaugcugcgccacaccaucgagaacuccacggccaacgugagccucgccgcgaucgccaaccaggccgucgugcugauggggcuggacaagggcuggccgaucuccaagauggaccucggggugccccugcuggcccucggcugcuacagccaggucaacccccugacccugaccgccgcggugcuccugcugaucacccacuacgccaucaucgggcccggccuccaggccaaggccacgcgggaggcccagaagcgcaccgcggccggcaucaugaagaacccgaccguggacgggaucaugaccaucgaccuggaccccgucaucuacgacuccaaguucgagaagcagcugggccaggugaugcuccuggugcugugcgccguccagcuccugcugaugcggacgagcugggcccucugcgaggcgcugacccuggccaccgggcccaucaccacgcucugggagggcucccccggcaaguucuggaacaccaccaucgccgugagcauggccaacaucuuccgcggguccuaccuggccggcgcggggcuggccuucagcaucaugaaguccgugggcaccgggaagcggggcacgggcagccagggggagacccucggcgagaaguggaagaagaagcugaaccagcugagccgcaaggaguucgaccucuacaagaaguccgggaucaccgaggucgaccggaccgaggccaaggagggccugaagcgcggggagaccacgcaccacgccgugagccggggcaccgccaagcugcagugguucguggagcgcaacauggucaucccggagggccgggugaucgaccucgggugcggccgcgggggcugguccuacuacugcgcggggcugaagaaggugaccgagguccggggcuacaccaagggcgggcccggccacgaggagcccgugcccaugagcacguacggguggaacaucgugaagcugauguccggcaaggacgucuucuaccucccgcccgagaagugcgacacccugcugugcgacaucggggagagcucccccagccccaccguggaggagucccgcaccauccgcgugcugaagauggucgagccguggcucaagaacaaccaguucugcaucaaggugcugaaccccuacaugcccacggugaucgagcaccuggagcggcuccagcgcaagcacggcggcaugcugguccggaacccccugagccgcaacuccacccacgagauguacuggaucagcaacgggaccggcaacaucguggccuccgugaacauggucagccggcuccugcugaaccgcuucaccaugacgcaccggcgcccgaccaucgagaaggacguggaccucggggccggcacccggcacgugaacgccgagcccgagacccccaacauggacgucaucggcgagcgcaucaagcggaucaaggaggagcacaacuccacguggcacuacgacgacgagaacccguacaagaccugggccuaccacgggagcuacgaggugaaggcgaccggcuccgccagcuccaugaucaacggggucgugaagcugcugaccaagcccugggacgugguccccauggugacgcagauggccaugaccgacaccacccccuucggccagcagcgcguguucaaggagaaggucgacacgcggaccccgcgcagcaugcccgggacccggcgcgugaugggcaucaccgccgaguggcucuggcggacgcugggccgcaacaagaagccccggcugugcacccgcgaggaguucaccaagaaggugcgcaccaacgcggccaugggggccgucuucacggaggagaaccagugggacagcgccaaggccgcgguggaggacgaggacuucuggaagcucguggaccgggagcgcgagcugcacaagcugggcaagugcggguccugcgucuacaacaugaugggcaagcgggagaagaagcucggggaguucggcaaggccaagggcagccgcgccaucugguacauguggcugggggcccgguaccuggaguucgaggcccucggcuuccugaacgaggaccacugguucucccgcgagaacagcuacuccgggguggagggcgaggggcugcacaagcucggcuacauccugcgggacaucagcaagauccccggcggggcgauguacgccgacgacaccgccggcugggacacccgcaucaccgaggacgaccugcacaacgaggagaagaucacgcagcagauggacccggagcaccggcagcucgccaacgccaucuucaagcugaccuaccagaacaagguggucaaggugcagcgccccacccccaccgggaccgugauggacaucaucucccggaaggaccagcgcggcagcggccaggucgggacguacggccugaacaccuucaccaacauggaggcgcagcucauccggcagauggagggggagggcgugcuguccaaggccgaccuggagaacccccaccucccggagaagaagaucacccaguggcuggagacgaaggggguggagcgccugcggcgcauggccaucagcggcgacgacugcgucgugaagcccaucgacgaccgguucgccaacgcccuccuggcgcugaacgacaugggcaaggugcgcaaggacaucccccaguggcagcccuccaagggguggcacgacuggcagcaggucccguucugcagccaccacuuccacgagcucaucaugaaggacggccggaagcugguggugcccugccgcccccaggacgagcugaucgggcgggcccgcaucucccagggcgccggguggagccuccgcgagaccgccugccugggcaaggcguacgcccagauguggucccugauguacuuccaccggcgcgaccuccggcuggccagcaacgccaucugcuccgccguccccgugcacugggugccgaccagccgcaccacgugguccauccacgcgcaccaccaguggaugaccaccgaggacaugcugaccgucuggaaccggguguggaucgaggacaaccccuggauggaggacaagacgcccgugaccaccugggagaacguccccuaccucggcaagcgcgaggaccaguggugcgggagccugaucggccugaccagccgggccacgugggcccagaacaucccgaccgccauccagcagguccgcucccucaucgggaacgaggaguuccuggacuacaugcccagcaugaagcgguuccgcaaggaggaggaguccgagggcgccaucugguga

SEQ ID NO: 10133 - RNA, 9873 nt, Artificial Sequence
  derived and/or modified CDS sequence (opt1) from DENV-3__EU529699__SS-prME
accagccucugccucaugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaccaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagacgugcaccuggccgaagucccacacccucuggagcaacggcgugcuggaguccgacaugaucauccccaagagccuggccgggcccaucucccagcacaacuaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccgucuccgagaaggaggagaacauggucaagagccugguguccgccggcagcgggaaggucgacaacuucaccaugggcgugcugugccucgccauccuguucgaggaggugaugcgggggaaguucggcaagaagcacaugaucgcgggggucuucuucaccuucgugcugcuccuguccggccagaucaccuggcgcgacauggcccacacgcugaucaugaucggcagcaacgccuccgaccggauggggaugggcgugaccuaccucgcccugaucgccaccuucaagauccagcccuuccuggcgcucggguucuuccugcgcaagcugaccagccgggagaaccuccugcugggcgucggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccaucuucacccugacgguggccuggcgcaccgccacccugauccucgcgggggucagccugcugccggugugccaguccagcuccaugcggaagaccgacuggcuccccaugacgguggccgccaugggcgugccgccccucccgcuguucaucuucagccucaaggacacccugaagcgccgcuccuggccccugaacgagggggugauggccgugggccucgucagcauccuggccuccagccugcuccggaacgacgugcccauggcgggcccccugguggccgggggccugcucaucgccugcuacgucaucaccgggaccuccgccgaccugacgguggagaaggccgcggacgugaccugggaggaggaggccgagcagaccggcgucagccacaaccugaugaucaccguggacgacgacgggaccaugcgcaucaaggacgacgagacggagaacauccucaccgugcugcugaagaccgcccuccugaucgucuccggcaucuucccguacagcauccccgccacccugcucguguggcacacguggcagaagcagacccagcgguccggcgugcugugggacguccccagcccgcccgagacccagaaggccgagcuggaggaggggguguaccgcaucaagcagcagggcaucuucgggaagacccaggugggcgucggggugcagaaggagggcguguuccacacgauguggcacgucacccggggcgcggugcucaccuacaacgggaagcgccuggagcccaacugggccuccgugaagaaggaccugaucagcuacggcgggggcuggcggcucuccgcccaguggcagaagggggaggagguccaggugaucgccguggagcccggcaagaaccccaagaacuuccagaccaugcccggcacguuccagaccaccaccggggagaucggcgcgaucgcccuggacuucaagcccgggacgagcggcagccccaucaucaaccgcgagggcaaggucguggggcuguacggcaacgggguggucaccaagaacggcggguacguguccggcaucgcccagaccaacgccgagccggacggccccacccccgagcuggaggaggagauguucaagaagcggaaccucacgaucauggaccugcaccccgggagcggcaagacccgcaaguaccugccggccaucgugcgggaggcgaucaagcgccggcuccgcacccugauccuggcccccacccgggucguggccgccgagauggaggaggcccucaaggggcugcccauccgcuaccagacgaccgcgaccaaguccgagcacaccggccgggagaucguggaccugaugugccacgccacguucaccaugcgccuccugagccccguccgggugccgaacuacaaccugaucaucauggacgaggcccacuucaccgaccccgccuccaucgccgcgcgcggguacaucagcacccgggugggcaugggcgaggccgccgccaucuucaugacggcgacgccgcccgggaccgccgacgccuucccgcaguccaacgcccccauccaggacgaggagcgcgacauccccgagcgcagcuggaacuccggcaacgaguggaucaccgacuucgccgggaagacggucugguucgugcccagcaucaaggcgggcaacgacaucgccaacugccuccggaagaacgggaagaaggugauccagcugucccgcaagaccuucgacaccgaguaccagaagaccaagcugaacgacugggacuucgucgugacgaccgacaucagcgagaugggcgccaacuucaaggccgaccgggugaucgacccgcgccggugccucaagcccgucauccugaccgacggccccgagcgcgugauccuggccgggcccaugccggugaccgcggccuccgccgcccagcggcgcggccgggucgggcgcaacccccagaaggagaacgaccaguacaucuucaccggccagccccucaacaacgacgaggaccacgcccacuggacggaggcgaagaugcugcuggacaacaucaacacccccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcgcacaagguggccagcgagggcaucaaguacaccgaccgcaaguggugcuucgacgggcagcggaacaaccagauccuggaggagaacauggacguggagaucuggacgaaggagggcgagaagaagaagcuccgcccccgguggcuggacgcccgcaccuacuccgacccgcuggcccucaaggaguucaaggacuucgccgcgggccgcaagagcaucgcccuggaccuggucaccgagaucgggcgggugcccucccaccucgcccaccgcacccggaacgcccuggacaaccuggugaugcuccacacgagcgagcacggcgggaaggccuaccgccacgcggucgaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggccgagaucccgcugcaguggaucgccagcgcgaucgugcuggaguucuucaugaugguccuccugauccccgagcccgagaagcagcggacgccccaggacaaccagcuggccuacguggugaucgggauccucacccuggccgccaucaucgccgcgaacgagaugggccugcucgagaccacgaagcgcgaccugggcauguccaaggagccgggggucgugagccccaccuccuaccuggacguggaccuccaccccgccagcgccuggacccuguacgccgucgcgaccacggugaucacccccaugcugcggcacaccaucgagaacuccaccgccaacgugagccucgccgccaucgccaaccaggcggucgugcugaugggccuggacaagggguggccgaucuccaagauggaccucggcgugccccugcuggcccucgggugcuacagccaggucaacccccugacgcugaccgccgccgugcuccugcugaucacccacuacgccaucaucggccccggccuccaggcgaaggccacccgcgaggcccagaagcggacggccgccgggaucaugaagaacccgaccguggacggcaucaugaccaucgaccuggaccccgucaucuacgacuccaaguucgagaagcagcugggccaggugaugcuccuggugcugugcgcgguccagcuccugcugaugcgcaccagcugggcccucugcgaggcccugacgcuggccaccggccccaucaccacccucugggagggcucccccgggaaguucuggaacacgaccaucgcggugagcauggccaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggaguucgaccucuacaagaaguccggcaucacggaggucgaccgcaccgaggcgaaggaggggcugaagcggggcgagaucacccaccacgccgugagccgcggcuccgccaagcugcagugguucguggagcggaacauggucaucccggaggggcgcgugaucgaccucggcugcgggcggggcggguggagcuacuacugcgccggccugaagaaggugaccgagguccgcggcuacacgaagggcgggcccgggcacgaggagcccgugcccauguccaccuacggcuggaacaucgugaagcugaugagcgggaaggacgucuucuaccucccgcccgagaagugcgacacccugcugugcgacaucggcgaguccagccccucccccaccguggaggagagccggacgauccgcgugcugaagauggucgagccguggcucaagaacaaccaguucugcaucaaggugcugaaccccuacaugcccaccgugaucgagcaccuggagcgccuccagcggaagcacggcgggaugcugguccgcaacccccugucccggaacagcacccacgagauguacuggaucuccaacggcaccgggaacaucguggccagcgugaacauggucucccgccuccugcugaaccgguucacgaugacccaccgccggccgaccaucgagaaggacguggaccucggcgcgggcacccgccacgugaacgccgagcccgagacgcccaacauggacgucaucggggagcggaucaagcgcaucaaggaggagcacaacagcaccuggcacuacgacgacgagaacccguacaagaccugggccuaccacggcuccuacgaggugaaggccaccgggagcgccuccagcaugaucaacggcgucgugaagcugcugacgaagcccugggacgugguccccauggugacccagauggcgaugaccgacaccacgcccuucgggcagcagcggguguucaaggagaaggucgacacccgcaccccgcggagcaugcccggcacccgccgggugaugggcaucacggccgaguggcucuggcgcacccuggggcggaacaagaagccccgccugugcacccgggaggaguucaccaagaaggugcgcacgaacgccgccaugggcgcggucuucaccgaggagaaccagugggacuccgccaaggccgccguggaggacgaggacuucuggaagcucguggaccgcgagcgggagcugcacaagcuggggaagugcggcagcugcgucuacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgccgacgacaccgcggggugggacacccggaucacggaggacgaccugcacaacgaggagaagaucacccagcagauggacccggagcaccgccagcucgccaacgccaucuucaagcugaccuaccagaacaagguggucaaggugcagcggcccacccccaccggcacggugauggacaucaucagccgcaaggaccagcggggcuccgggcaggucggcaccuacgggcugaacaccuucaccaacauggaggcccagcucauccgccagauggagggcgagggggugcugagcaaggccgaccuggagaacccccaccucccggagaagaagaucacgcaguggcuggagaccaagggcguggagcggcugaagcgcauggcgaucuccggcgacgacugcgucgugaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcugguggugcccugccgcccccaggacgagcugaucggccgggcccgcaucagccagggggcgggcuggucccuccgggagaccgccugccugggcaaggccuacgcccagauguggagccugauguacuuccaccgccgcgaccuccggcuggcguccaacgccaucugcagcgccguccccgugcacugggugccgaccucccgcacgaccuggagcauccacgcccaccaccaguggaugaccaccgaggacaugcugacggucuggaaccggguguggaucgaggacaaccccuggauggaggacaagacccccgugaccaccugggagaacguccccuaccucgggaagcgcgaggaccaguggugcggcagccugaucgggcugacgucccgggccaccugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10134 - RNA, 9873 nt, Artificial Sequence
  derived and/or modified CDS sequence (opt1) from DENV-3__EU482566__SS-prME
accagccucugccucaugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccgucgcccucgcgccccacgugggcauggggcuggacacccgcacccagaccuggaugagcgccgagggcgccuggcgccagguggagaaggucgagaccugggcccugcgccacccgggguucaccauccucgcgcuguuccuggcccacuacaucggcaccucccucacccagaagguggugaucuucacgcugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggcgacccuccggaagcugugcaucgagggcaagaucaccaacaucaccacggacagccgcugccccacccagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacacggugaucaucaccguccacaccggggaccagcaccaggugggcaacgagacccagggggucacggccgagaucacgccccaggccagcaccaccgaggcgauccugcccgaguacggcacccuggggcucgagugcuccccgcgcacgggccuggacuucaacgagaugauccugcucaccaugaagaacaaggccuggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgucccgugcaagauccccuucagcacggaggacgggcagggcaaggcgcacaacggccgccugaucaccgccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacacggccugggacuucggguccgugggcgggguccucaacagccugggcaagauggugcaccagaucuucggguccgcguacaccgcccuguucagcggcguguccugggucaugaagaucggcaucggggugcuccugaccuggaucggccugaacagcaagaacaccuccaugagcuucuccugcaucgccaucgggaucaucacgcucuaccugggcgccgugguccaggccgacauggggugcgugaucaacuggaagggcaaggagcugaagugcggcagcgggaucuucgugaccaacgagguccacaccuggaccgagcaguacaaguuccaggcggacucccccaagcgccucgccacggccaucgccggcgccugggagaacggggugugcggcauccgcagcaccacccggauggagaaccugcuguggaagcagaucgcgaacgagcucaacuacauccugugggagaacaacaucaagcugaccguggucgugggggacaucaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagacgugcaccuggccgaagucccacacccucuggagcaacggcgugcuggaguccgacaugaucauccccaagagccuggccgggcccaucucccagcacaacuaccggccgggcuaccacacccagacggccgggcccuggcaccucggcaagcuggagcuggacuucaacuacugcgagggcaccaccgucgugaucaccgagaacugcgggacgaagggccccagccuccgcaccaccaccguguccgggaagcugauccacgaguggugcugccggagcugcacgcugcccccgcuccgcuacaugggcgaggacgggugcugguacggcauggagauccggcccaucuccgagaaggaggagaacauggucaagagccugguguccgccggcagcgggaagguggacaacuucaccaugggcguccugugccucgccauccuguucgaggaggugaugcgcgggaaguucggcaagaagcacaugaucgcggggguguucuucaccuucguccugcuccuguccggccagaucaccuggcgggacauggcccacacgcugaucaugaucggcagcaacgccuccgaccgcauggggaugggcgugaccuaccucgcccugaucgccaccuucaagauccagcccuuccuggcgcucggguucuuccugcggaagcugaccagccgcgagaaccuccugcugggcgugggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccaucuucacccugacggucgccuggcggaccgccacccugauccucgcgggggugagccugcugccggucugccaguccagcuccaugcgcaagaccgacuggcuccccaugacgguggccgccaugggcgugccgccccucccgcuguucaucuucagccucaaggacacccugaagcggcgcuccuggccccugaacgagggggucauggccgugggccucgugagcauccuggccuccagccugcuccgcaacgacguccccauggcgggcccccugguggccgggggccugcucaucgccugcuacgugaucaccgggaccuccgccgaccugacggucgagaaggccgcggacgugaccugggaggaggaggccgagcagaccggcgugagccacaaccugaugaucaccgucgacgacgacgggaccaugcggaucaaggacgacgagacggagaacauccucaccgugcugcugaagaccgcccuccugaucguguccggcaucuucccguacagcauccccgccacccugcucgucuggcacacguggcagaagcagacccagcgcuccggcgugcugugggacgugcccagcccgcccgagacccagaaggccgagcuggaggagggggucuaccggaucaagcagcagggcaucuucgggaagacccaggugggcguggggguccagaaggagggcguguuccacacgauguggcacgugacccgcggcgcgguccucaccuacaacgggaagcggcuggagcccaacugggccuccgugaagaaggaccugaucagcuacggcgggggcuggcgccucuccgcccaguggcagaagggggaggaggugcaggucaucgccguggagcccggcaagaaccccaagaacuuccagaccaugcccggcacguuccagaccaccaccggggagaucggcgcgaucgcccuggacuucaagcccgggacgagcggcagccccaucaucaaccgggagggcaagguggucgggcuguacggcaacgggguggugaccaagaacggcggguacgucuccggcaucgcccagaccaacgccgagccggacggccccacccccgagcuggaggaggagauguucaagaagcgcaaccucacgaucauggaccugcaccccgggagcggcaagacccggaaguaccugccggccaucgugcgcgaggcgaucaagcggcgccuccggacccugauccuggcccccacccgcguggucgccgccgagauggaggaggcccucaaggggcugcccauccgguaccagacgaccgcgaccaaguccgagcacaccggccgcgagaucguggaccugaugugccacgccacguucaccaugcggcuccugagccccgugcgcgucccgaacuacaaccugaucaucauggacgaggcccacuucaccgaccccgccuccaucgccgcgcggggguacaucagcacccgcgugggcaugggcgaggccgccgccaucuucaugacggcgacgccgcccgggaccgccgacgccuucccgcaguccaacgcccccauccaggacgaggagcgggacauccccgagcgcagcuggaacuccggcaacgaguggaucaccgacuucgccgggaagacggugugguucguccccagcaucaaggcgggcaacgacaucgccaacugccuccgcaagaacgggaagaaggugauccagcugucccggaagaccuucgacaccgaguaccagaagaccaagcugaacgacugggacuucguggucacgaccgacaucagcgagaugggcgccaacuucaaggccgaccgcgugaucgacccgcggcgcugccucaagcccgugauccugaccgacggccccgagcgggucauccuggccgggcccaugccggugaccgcggccuccgccgcccagcgccggggccgcguggggcggaacccccagaaggagaacgaccaguacaucuucaccggccagccccucaacaacgacgaggaccacgcccacuggacggaggcgaagaugcugcuggacaacaucaacacccccgaggggaucaucccggcccucuucgagcccgagcgcgagaaguccgccgccaucgacggcgaguaccggcugaagggcgagucccgcaagaccuucgucgagcugaugcggcgcggggaccuccccguguggcuggcgcacaaggucgccagcgagggcaucaaguacaccgaccggaaguggugcuucgacgggcagcgcaacaaccagauccuggaggagaacauggacguggagaucuggacgaaggagggcgagaagaagaagcuccggccccgcuggcuggacgcccggaccuacuccgacccgcuggcccucaaggaguucaaggacuucgccgcgggccgcaagagcaucgcccuggaccuggugaccgagaucgggcgcguccccucccaccucgcccaccggacccgcaacgcccuggacaaccuggugaugcuccacacgagcgagcacggcgggaaggccuaccggcacgcgguggaggagcugcccgagaccauggagacccugcuccugcugggccucaugauccugcugaccgggggcgccaugcuguuccugaucagcggcaaggggaucggcaagacguccaucgggcugaucugcgucaucgccagcuccggcaugcucuggauggccgagaucccgcugcaguggaucgccagcgcgaucgugcuggaguucuucaugauggugcuccugauccccgagcccgagaagcagcgcacgccccaggacaaccagcuggccuacgucgugaucgggauccucacccuggccgccaucaucgccgcgaacgagaugggccugcucgagaccacgaagcgggaccugggcauguccaaggagccggggguggucagccccaccuccuaccuggacguggaccuccaccccgccagcgccuggacccuguacgccguggcgaccacggucaucacccccaugcugcgccacaccaucgagaacuccaccgccaacgugagccucgccgccaucgccaaccaggcggugguccugaugggccuggacaagggguggccgaucuccaagauggaccucggcgugccccugcuggcccucgggugcuacagccaggugaacccccugacgcugaccgccgccguccuccugcugaucacccacuacgccaucaucggccccggccuccaggcgaaggccacccgggaggcccagaagcgcacggccgccgggaucaugaagaacccgaccguggacggcaucaugaccaucgaccuggaccccgugaucuacgacuccaaguucgagaagcagcuggggcaggucaugcuccuggugcugugcgcggugcagcuccugcugaugcggaccagcugggcccucugcgaggcccugacgcuggccaccggccccaucaccacccucugggagggcucccccgggaaguucuggaacacgaccaucgcggucagcauggccaacaucuuccgcggcuccuaccuggccggggccggccuggccuucagcaucaugaaguccguggggaccggcaagcggggcaccgggagccagggcgagacccucggggagaaguggaagaagaagcugaaccagcugagccgcaaggaguucgaccucuacaagaaguccggcaucacggagguggaccggaccgaggcgaaggaggggcugaagcgcggcgagaucacccaccacgccgucagccggggcuccgccaagcugcagugguucguggagcgcaacauggugaucccggaggggcgggucaucgaccucggcugcgggcgcggcggguggagcuacuacugcgccggccugaagaaggugaccgaggugcggggcuacacgaagggcgggcccgggcacgaggagcccguccccauguccaccuacggcuggaacaucgugaagcugaugagcgggaaggacguguucuaccucccgcccgagaagugcgacacccugcugugcgacaucggcgaguccagccccucccccaccgucgaggagagccgcacgauccgggugcugaagaugguggagccguggcucaagaacaaccaguucugcaucaagguccugaaccccuacaugcccaccgugaucgagcaccuggagcgccuccagcgcaagcacggcgggaugcuggugcggaacccccugucccgcaacagcacccacgagauguacuggaucuccaacggcaccgggaacaucgucgccagcgugaacauggugucccggcuccugcugaaccgcuucacgaugacccaccggcgcccgaccaucgagaaggacgucgaccucggcgcgggcacccggcacgugaacgccgagcccgagacgcccaacauggacgugaucggggagcgcaucaagcggaucaaggaggagcacaacagcaccuggcacuacgacgacgagaacccguacaagaccugggccuaccacggcuccuacgaggucaaggccaccgggagcgccuccagcaugaucaacggcguggucaagcugcugacgaagcccugggacguggugcccauggucacccagauggcgaugaccgacaccacgcccuucgggcagcagcgcguguucaaggagaagguggacacccggaccccgcgcagcaugcccggcacccggcgcgucaugggcaucacggccgaguggcucuggcggacccuggggcgcaacaagaagccccggcugugcacccgcgaggaguucaccaagaaggugcggacgaacgccgccaugggcgcgguguucaccgaggagaaccagugggacuccgccaaggccgccgucgaggacgaggacuucuggaagcucguggaccgcgagcgcgagcugcacaagcuggggaagugcggcagcugcguguacaacaugauggggaagcgggagaagaagcucggcgaguucggcaaggccaaggggucccgcgcgaucugguacauguggcugggcgcccgguaccuggaguucgaggcccucggguuccugaacgaggaccacugguucagccgcgagaacuccuacagcggcgucgagggggagggccugcacaagcucggcuacauccugcgggacaucuccaagauccccgggggcgccauguacgccgacgacaccgcggggugggacacccgcaucacggaggacgaccugcacaacgaggagaagaucacccagcagauggacccggagcaccggcagcucgccaacgccaucuucaagcugaccuaccagaacaagguggugaagguccagcgccccacccccaccggcacggugauggacaucaucagccggaaggaccagcgcggcuccggccaggugggcaccuacgggcugaacaccuucaccaacauggaggcccagcucauccggcagauggagggcgaggggguccugagcaaggccgaccuggagaacccccaccucccggagaagaagaucacgcaguggcuggagaccaagggcguggagcgccugaagcggauggcgaucuccggcgacgacugcguggucaagcccaucgacgaccgcuucgccaacgcccuccuggcccugaacgacauggggaaggugcggaaggacaucccccaguggcagcccagcaagggcuggcacgacuggcagcaggucccguucugcucccaccacuuccacgagcucaucaugaaggacgggcgcaagcuggucgugcccugccggccccaggacgagcugaucggccgcgcccggaucagccagggggcgggcuggucccuccgcgagaccgccugccugggcaaggccuacgcccagauguggagccugauguacuuccaccggcgcgaccuccgccuggcguccaacgccaucugcagcgccgugcccguccacugggugccgaccucccggacgaccuggagcauccacgcccaccaccaguggaugaccaccgaggacaugcugacgguguggaaccgcgucuggaucgaggacaaccccuggauggaggacaagacccccgugaccaccugggagaacgugcccuaccucgggaagcgggaggaccaguggugcggcagccugaucgggcugacgucccgcgccaccugggcgcagaacaucccgaccgccauccagcagguccggagccucaucggcaacgaggaguuccuggacuacaugcccuccaugaagcgcuuccggaaggaggaggagagcgagggggccaucugguga

SEQ ID NO: 10135 - RNA, 9873 nt, Artificial Sequence
  derived and/or modified CDS sequence (opt1) from DENV-3__EU529702__SS-prME
accagccucugccucaugaugauccugcccgccgcccuggcguuccaccucaccagccgggacggggagccgcggaugaucguggggaagaacgagcgcggcaagagccugcuguucaagaccgccagcgggaucaacaugugcacccucaucgccauggaccugggggagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaagguggagacgugggcccugcgccacccgggguucaccauccucgcgcuguuccuggcccacuacgugggcaccucccucacccagaagguggucaucuucauccugcugaugcucgugacgcccagcaugaccaugcggugcgugggggucggcaaccgcgacuucguggagggccuguccggggccaccuggguggacgucgugcuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccguccugccggaggagcaggaccagaacuacgugugcaagcacaccuacguggaccggggguggggcaacgggugcggccucuucgggaagggcucccuggugaccugcgccaaguuccagugccuggagcccaucgagggcaagguggugcaguacgagaaccucaaguacaccgucaucaucacggugcacaccggggaccagcaccaggucggcaacgagacccagggggugaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggucaccuucaagaacgcccacgccaagaagcaggagguggugguccuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucgugcugaagaaggagguguccgagacccagcacgggaccauccucaucaaggucgaguacaagggcgaggacgugccgugcaaggugcccuucagcaccgaggacgggcagggcaaggcgcacaacggccgccugaucacggccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacaccgccugggacuucggguccgugggcggggugcucaacagccugggcaagaugguccaccagaucuucggguccgcguacacggcccuguucagcggcguguccugggugaugaagaucggcaucgggguccuccugaccuggaucggccugaacagcaagaacaccuccaugagcuucuccugcaucgugaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggccgacucccccaagcgccucgcgaccgccaucgccggcgccugggagaacggggugugcggcauccgcagcacgacccggauggagaaccugcuguggaagcagaucgccaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggcgaagaucgucaccgccgagacccagaacagcuccuucaucaucgacggccccaacacgcccgagugccccagcgccucccgggccuggaacgugugggagguggaggacuacggguucggcgucuucagcaccaacaucuggcucaagcugcgcgagguguacacccagcugugcgaccaccggcucaugagcgcggccgugaaggacgagcgcgccguccacgccgacaugggcuacuggaucgagucccagaagaacgggagcuggaagcuggagaaggccucccugaucgaggugaagaccugcaccuggcccaagucccacacgcucugguccaacggcgugcuggagagcgacaugaucauccccaagucccuggcggggcccaucagccagcacaacuaccggccgggcuaccacacccagaccgccgggcccuggcaccucggcaagcuggagcuggacuucaacuacugcgagggcaccacggucgugaucaccgagaacugcgggacccgcggccccucccuccggaccacgaccgugagcgggaagcugauccacgaguggugcugccgcuccugcacccugcccccgcuccgguacaugggcgaggacgggugcugguacggcauggagauccgccccaucagcgagaaggaggagaacauggucaagucccuggugagcgccggcuccgggaagguggacaacuucaccaugggcgcccugugccucgccauccuguucgaggaggucaugcgggggaaguucggcaagaagcacaugaucgcggggguguucuucacguucgugcugcuccugagcggccagaucaccuggcgcgacauggcccacacccugaucaugaucggcuccaacgccagcgaccggauggggaugggcgucaccuaccucgcccugaucgccacguucaagauccagcccuuccuggcgcucggguucuuccugcgcaagcugaccagccgggagaaccuccugcugggcgugggccucgccauggccaccacccugcagcugcccgaggacaucgagcagauggccaacgggaucgcgcucggccugauggcccugaagcucaucacgcaguucgagaccuaccagcuguggaccgcccugaucucccugaccugcagcaacacgaucuucacccugaccgucgccuggcgcaccgccacgcugauccucgcgggggugucccugcugccggugugccagagcuccagcaugcggaagaccgacuggcuccccaugaccgucgccgccaugggcgugccgccccucccgcuguucaucuucucccucaaggacacccugaagcgccgcagcuggccccugaacgagggggugauggccgucggccucguguccauccuggccagcucccugcuccggaacgacgugcccauggcgggcccccuggucgccgggggccugcucaucgccugcuacgugaucacggggaccagcgccgaccugaccguggagaaggccgcggacgucaccugggaggaggaggccgagcagacgggcgugucccacaaccugaugaucaccguggacgacgacgggaccaugcgcaucaaggacgacgagaccgagaacauccucaccguccugcugaagacggcccuccugaucgugagcggcaucuucccguacuccauccccgccacccugcucguguggcacaccuggcagaagcagacccagcggagcggcguccugugggacgugcccagcccgcccgagacgcagaaggccgagcuggaggaggggguguaccgcaucaagcagcagggcaucuucgggaagacccaggucggcgugggggugcagaaggagggcgucuuccacaccauguggcacgugacccggggcgcggugcucacguacaacgggaagcgccuggagcccaacugggccagcgucaagaaggaccugaucuccuacggcgggggcuggcggcucagcgcccaguggcagaagggggaggagguccaggugaucgccgucgagcccggcaagaaccccaagaacuuccagaccaugcccggcaccuuccagaccacgaccggggagaucggcgcgaucgcccuggacuucaagcccgggaccagcggcucccccaucaucaaccgcgagggcaaggugguggggcuguacggcaacggggucgugaccaagaacggcggguacgugagcggcaucgcccagacgaacgccgagccggacggccccacccccgagcuggaggaggagauguucaagaagcggaaccucaccaucauggaccugcaccccggguccggcaagacccgcaaguaccugccggccaucguccgggaggcgaucaagcgccggcuccgcacgcugauccuggcccccacccgggugguggccgccgagauggaggaggcccucaaggggcugcccauccgcuaccagaccaccgcgaccaagagcgagcacaccggccgggagaucgucgaccugaugugccacgccaccuucaccaugcgccuccugucccccgugcgggugccgaacuacaaccugaucaucauggacgaggcccacuucacggaccccgccagcaucgccgcgcgcggguacaucuccacccgggucggcaugggcgaggccgccgccaucuucaugaccgcgacgccgcccgggacggccgacgccuucccgcagagcaacgcccccauccaggacgaggagcgcgacauccccgagcgcuccuggaacagcggcaacgaguggaucaccgacuucgccgggaagaccgugugguucgugcccuccaucaaggcgggcaacgacaucgccaacugccuccggaagaacgggaagaaggucauccagcugagccgcaagaccuucgacacggaguaccagaagaccaagcugaacgacugggacuucguggugaccaccgacaucuccgagaugggcgccaacuucaaggccgaccgggucaucgacccgcgccggugccucaagcccgugauccugacggacggccccgagcgcgugauccuggccgggcccaugccggucaccgcggccagcgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacccccgaggggaucaucccggcccucuucgagcccgagcgggagaaguccgccgccaucgacggcgaguaccgccugaagggcgagagccggaagacguucgucgagcugaugcgccgcggggaccuccccguguggcuggcgcacaagguggccuccgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcaccuacagcgacccgcuggcccucaaggaguucaaggacuucgccgcgggccgcaaguccaucgcccuggaccuggugacggagaucgggcgggugcccagccaccucgcccaccgcacccggaacgcccuggacaaccuggucaugcuccacaccagcgagcacggcgggaaggccuaccgccacgcgguggaggagcugcccgagaccauggagacgcugcuccugcugggccucaugauccugcugaccgggggcgccaugcuguuccugaucuccggcaaggggaucggcaagaccagcaucgggcugaucugcgugaucgccuccagcggcaugcucuggauggccgagaucccgcugcaguggaucgccuccgcgaucguccuggaguucuucaugauggugcuccugauccccgagcccgagaagcagcggacgccccaggacaaccagcuggccuacguggucaucgggauccucacgcuggccgccaucaucgccgcgaacgagaugggccugcucgagaccaccaagcgcgaccugggcaugagcaaggagccggggguggugucccccaccagcuaccuggacgucgaccuccaccccgccuccgccuggacgcuguacgccguggcgaccaccgugaucacccccaugcugcggcacacgaucgagaacagcaccgccaacgucucccucgccgccaucgccaaccaggcgguggugcugaugggccuggacaagggguggccgaucagcaagauggaccucggcgucccccugcuggcccucgggugcuacucccaggugaacccccugacccugaccgccgccgugcuccugcugaucacgcacuacgccaucaucggccccggccuccaggcgaaggccacccgcgaggcccagaagcggaccgccgccgggaucaugaagaacccgaccgucgacggcaucaugacgaucgaccuggaccccgugaucuacgacagcaaguucgagaagcagcugggccaggugaugcuccugguccugugcgcggugcagcuccugcugaugcgcaccuccugggcccucugcgaggcccugacccuggccaccggccccaucacgacccucugggagggcagccccgggaaguucuggaacaccaccaucgcgguguccauggccaacaucuuccggggcagcuaccuggccggggccggccuggccuucuccaucaugaaguccgucgggacgggcaagcgcggcaccgggagccagggcgagacccucggggagaaguggaagaagaagcugaaccagcugucccggaaggaguucgaccucuacaagaaguccggcaucaccgagguggaccgcaccgaggcgaaggaggggcugaagcggggcgagaucacgcaccacgccgugucccgcggcagcgccaagcugcagugguucgucgagcggaacauggugaucccggaggggcgcgugaucgaccucggcugcgggcggggcgggugguccuacuacugcgccggccugaagaaggucaccgaggugcgcggcuacaccaagggcgggcccgggcacgaggagcccgugcccaugagcaccuacggcuggaacaucgucaagcugauguccgggaaggacguguucuaccucccgcccgagaagugcgacacgcugcugugcgacaucggcgagagcucccccagccccaccguggaggagucccggaccauccgcguccugaagaugguggagccguggcucaagaacaaccaguucugcaucaaggugcugaaccccuacaugcccaccgucaucgagcaccuggagcgccuccagcggaagcacggcgggaugcuggugcgcaacccccugagccggaacuccacgcacgagauguacuggaucagcaacggcaccgggaacaucguggccuccgucaacauggugagccgccuccugcugaaccgguucaccaugacccaccgccggccgacgaucgagaaggacguggaccucggcgcgggcacccgccacgucaacgccgagcccgagacccccaacauggacgugaucggggagcggaucaagcgcaucaaggaggagcacaacuccaccuggcacuacgacgacgagaacccguacaagacgugggccuaccacggcagcuacgaggucaaggccaccggguccgccagcagcaugaucaacggcguggugaagcugcugaccaagcccugggacgucgugcccauggugacccagauggcgaugacggacaccacccccuucgggcagcagcgggucuucaaggagaagguggacacccgcacgccgcgguccaugcccggcacccgccgggugaugggcaucaccgccgaguggcucuggcgcacccuggggcggaacaagaagccccgccugugcacgcgggaggaguucaccaagaagguccgcaccaacgccgccaugggcgcgguguucaccgaggagaaccagugggacagcgccaaggccgccguggaggacgaggacuucuggacgcucgucgaccgcgagcgggagcugcacaagcuggggaagugcggcuccugcguguacaacaugauggggaagcgcgagaagaagcucggcgaguucggcaaggccaaggggagccgggcgaucugguacauguggcugggcgcccgcuaccuggaguucgaggcccucggguuccugaacgaggaccacugguucucccgggagaacagcuacuccggcguggagggggagggccugcacaagcucggcuacauccugcgcgacaucagcaagauccccgggggcgccauguacgccgacgacaccgcggggugggacacccggaucaccgaggacgaccugcacaacgaggagaagaucacgcagcagauggacccggagcaccgccagcucgccaacgccaucuucaagcugaccuaccagaacaaggucgugaaggugcagcggcccacccccaccggcaccgucauggacaucaucucccgcaaggaccagcggggcagcggccaggugggcacguacgggcugaacaccuucaccaacauggaggcccagcucauccgccagauggagggcgagggggugcuguccaaggccgaccuggagaacccccaccucccggagaagaagaucacccaguggcuggagacgaagggcgucgagcggcugaagcgcauggcgaucagcggcgacgacugcguggugaagcccaucgacgaccgguucgccaacgcccuccuggcccugaacgacauggggaagguccgcaaggacaucccccaguggcagcccuccaagggcuggcacgacuggcagcaggucccguucugcagccaccacuuccacgagcucaucaugaaggacgggcggaagcuggugguccccugccgcccccaggacgagcugaucggccgggcccgcaucucccagggggcgggcuggagccuccgggagaccgccugccugggcaaggccuacgcccagauguggucccugauguacuuccaccgccgcgaccuccggcuggcgagcaacgccaucugcuccgccgugcccgugcacugggucccgaccagccgcaccacguggagcauccacgcccaccaccaguggaugaccaccgaggacaugcugaccguguggaaccggguguggaucgaggacaaccccuggauggaggacaagacgcccgucaccaccugggagaacgugcccuaccucgggaagcgcgaggaccaguggugcggcucccugaucgggcugaccagccgggccacgugggcgcagaacaucccgaccgccauccagcagguccgcucccucaucggcaacgaggaguuccuggacuacaugcccagcaugaagcgguuccgcaaggaggaggaguccgagggggccaucugguga

SEQ ID NO: 10136 - RNA, 9873 nt, Artificial Sequence
  derived and/or modified CDS sequence (opt1) from DENV-3__EU529703__SS-prME
accagccugugccucaugaugauccugcccgcggcccuggcguuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgcccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacaccgugaucaucacggugcacaccggggaccagcaccaggucggcaacgagacccagggggugaccgccgagaucacgccccaggcgagcaccaccgaggccauccugcccgaguacggcacccuggggcucgagugcuccccgcgcaccggccuggacuucaacgagaugauccugcucacgaugaagaacaaggccuggaugguccaccggcagugguucuucgaccugccccugcccuggaccagcggcgccaccaccgagacgcccaccuggaaccgcaaggagcuccuggugaccuucaagaacgcccacgcgaagaagcaggagguggucgugcuggggucccaggagggcgccaugcacaccgcccucacgggggccaccgagauccagaacagcggcgggaccuccaucuucgccggccaccugaagugccggcugaagauggacaagcucgagcugaagggcaugagcuacgcgaugugcaccaacacguucgugcugaagaaggaggucuccgagacccagcacgggaccauccucaucaagguggaguacaagggcgaggacgccccgugcaagauccccuucagcaccgaggacgggcagggcaaggcccacaacggccgccugaucacggccaaccccguggucaccaagaaggaggagcccgugaacaucgaggcggagccgcccuucggggagagcaacaucgugaucggcaucggggacaacgcccugaagaucaacugguacaagaagggcuccagcaucgggaagauguucgaggccaccgcccggggcgcccgccggauggcgauccugggcgacaccgccugggacuucggguccgucggcggggugcucaacagccugggcaagauggugcaccagaucuucggguccgccuacacggcccuguucagcggcgucuccugggugaugaagaucggcaucggggugcuccugaccuggaucggccugaacagcaagaacaccuccaugagcuucuccugcaucgccaucgggaucaucacccucuaccugggcgcggucgugcaggccgacauggggugcgugaucaacuggaagggcaaggagcugaagugcggcagcgggaucuucgucacgaacgaggugcacaccuggaccgagcaguacaaguuccaggccgacucccccaagcgccucgccaccgccaucgcgggcgccugggagaacggggugugcggcauccgcagcacgacccggauggagaaccugcuguggaagcagaucgccaacgagcucaacuacauccugugggagaacaacaucaagcugaccgucguggugggggacaucaucggcguccucgagcagggcaagcgcacccugacgccccagccgauggagcugaaguacuccuggaagaccugggggaaggccaagaucgugaccgcggagacccagaacagcuccuucaucaucgacggccccaacacgcccgagugccccagcgccucccgggccuggaacgugugggaggucgaggacuacggguucggcguguucaccaccaacaucuggcucaagcugcgcgagguguacacccagcugugcgaccaccggcucaugagcgccgccgucaaggacgagcgcgcggugcacgccgacaugggcuacuggaucgagagccagaagaacggguccuggaagcuggagaaggccagccugaucgaggugaagaccugcacguggccgaagucccacacccucuggagcaacggcguccuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgcgggcagcgggaaggucgacaacuucacgaugggcgugcugugccucgccauccuguucgaggaggugaugcgggggaaguucggcaagaagcacaugaucgccggggucuucuucaccuucgugcugcuccuguccggccagaucaccuggcgcgacauggcccacacccugaucaugaucggcagcaacgccuccgaccggauggggaugggcgugacguaccucgcgcugaucgccaccuucaagauccagcccuuccuggcccucggguucuuccugcgcaagcugaccagccgggagaaccuccugcugggcgucggccucgccauggcgaccacgcugcagcugcccgaggacaucgagcagauggccaacgggaucgcccucggccugauggcccugaagcucaucacccaguucgagaccuaccagcuguggaccgcccugaucagccucacgugcuccaacaccaucuucacccugaccguggcguggcgcacggccacccugauccucgccggggugagccugcugccggucugccaguccagcuccaugcggaagaccgacuggcuccccauggccguggccgcgaugggcgugccgccccucccgcuguucaucuucagccucaaggacacccugaagcgccgcuccuggccccugaacgagggggugauggccgugggccucgucagcauccuggccuccagccugcuccggaacgacgugcccauggccggcccccugguggccgggggccugcucaucgcgugcuacgucaucacggggaccuccgccgaccugaccguggagaaggccgccgacaucaccugggaggaggaggccgagcagacgggcgugagccacaaccugaugaucaccgucgacgacgacgggaccaugcgcaucaaggacgacgagaccgagaacauccucaccgugcugcugaagacggcgcuccugaucguguccggcaucuucccguacagcauccccgccacccugcucgucuggcacaccuggcagaagcagacccagcgguccggcgugcugugggacgugcccagcccgcccgagacgcagaaggccgagcuggaggagggggucuaccgcaucaagcagcagggcaucuucgggaagacccaggugggcguggggguccagaaggagggcguguuccacaccauguggcacgugacccggggcgccguccucacguacaacgggaagcgccuggagcccaacugggcguccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagaccacgaccggggagaucggcgccaucgcccuggacuucaagcccgggaccagcggcagccccaucaucaaccgcgagggcaagguggucgggcuguacggcaacgggguggugaccaagaacggcggguacgucuccggcaucgcgcagacgaacgccgagccggacggccccacccccgagcuggaggaggagauguucaagaagcggaaccucaccaucauggaccugcaccccgggagcggcaagacccgcaaguaccugccggccaucgugcgggaggccaucaagcgccggcuccgcacgcugauccuggcccccacccggguggucgcggccgagauggaggaggcccucaaggggcugcccauccgcuaccagaccaccgccacgaaguccgagcacaccggccgggagaucguggaccugaugugccacgccaccuucaccaugcgccuccugagccccgugcgggucccgaacuacaaccugaucaucauggacgaggcgcacuucacggaccccgccuccaucgccgcccgcggguacaucagcacccgggugggcaugggcgaggcggccgccaucuucaugaccgccacgccgcccgggacggccgacgcguucccgcaguccaacgcccccauccaggacgaggagcgcgacauccccgagcgcagcuggaacuccggcaacgaguggaucaccgacuucgccgggaagaccgugugguucguccccagcaucaaggccggcaacgacaucgccaacugccuccggaagaacgggaagaaggugauccagcugucccgcaagaccuucgacacggaguaccagaagaccaagcugaacgacugggacuucguggucaccaccgacaucagcgagaugggcgcgaacuucaaggccgaccgggugaucgacccgcgccggugccucaagcccgugauccugacggacggccccgagcgcgucauccuggccgggcccaugccggugaccgccgccuccgcggcccagcggcgcggccggguggggcgcaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgggagaaguccgccgccaucgacggcgaguaccgccugaagggcgagucccggaagacguucgucgagcugaugcgccgcggggaccuccccguguggcuggcccacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcgcgcaccuacuccgacccgcuggcccucaaggaguucaaggacuucgccgccggccgcaagagcaucgcccuggaccuggugacggagaucgggcggguccccucccaccucgcgcaccgcacccggaacgcccuggacaaccuggugaugcuccacaccagcgagcacggcgggcgcgccuaccggcacgccguggaggagcugcccgagaccauggagacgcugcuccugcugggccucaugauccugcugaccgggggcgccaugcuguuccugaucagcggcaaggggaucggcaagaccuccaucgggcugaucugcgucaucgcgagcuccggcaugcucuggauggccgagaucccgcugcaguggaucgccagcgccaucgugcuggaguucuucaugauggugcuccugauccccgagcccgagaagcagcgcacgccccaggacaaccagcuggccuacgucgugaucgggauccucacgcuggcggccaucaucgccgccaacgagaugggccugcucgagaccaccaagcgggaccugggcauguccaaggagccggggguggucagccccaccuccuaccuggacguggaccuccaccccgcgagcgccuggacgcuguacgccguggccaccaccgucaucacccccaugcugcgccacacgaucgagaacuccaccgccaacgugagccucgcggccaucgccaaccaggccgugguccugaugggccuggacaagggguggccgaucuccaagauggaccucggcgugccccugcuggcccucgggugcuacagccaggugaacccccugacccugaccgcggccguccuccugcugaucacgcacuacgccaucaucggccccggccuccaggccaaggccacccgggaggcgcagaagcgcaccgccgccgggaucaugaagaacccgaccguggacggcaucaugacgaucgaccuggaccccgugaucuacgacuccaaguucgagaagcagcuggggcaggucaugcuccuggugcugugcgccgugcagcuccugcugaugcggaccagcugggcgcucugcgaggcccugacccuggccaccggccccaucacgacccucugggagggcucccccgggaaguucuggaacaccaccaucgccgucagcauggccaacaucuuccgcggcuccuaccuggcgggggccggccuggccuucagcaucaugaaguccguggggacgggcaagcggggcaccgggagccagggcgagacccucggggagaaguggaagaagaagcugaaccagcugagccgcaaggaguucgaccucuacaagaaguccggcaucaccgagguggaccggaccgaggccaaggaggggcugaagcgcggcgagaucacgcaccacgccgucagccggggcuccgcgaagcugcagugguucguggagcgcaacauggugaucccggaggggcgggucaucgaccucggcugcgggcgcggcggguggagcuacuacugcgccggccugaagaaggugaccgaggugcggggcuacaccaagggcgggcccgggcacgaggagcccguccccauguccaccuacggcuggaacaucgugaagcugaugagcgggaaggacguguucuaccucccgcccgagaagugcgacacgcugcugugcgacaucggcgaguccagccccucccccaccgucgaggagagccgcaccauccgcgugcugaagaugguggagccguggcucaagaacaaccaguucugcaucaagguccugaaccccuacaugcccaccgugaucgagcaccuggagcggcuccagcgcaagcacggcgggaugcuggugcggaacccccugucccgcaacagcacgcacgagauguacuggaucuccaacggcaccgggaacaucgucgccagcgugaacauggugucccggcuccugcugaaccgcuucaccaugacccaccggcgcccgacgaucgagaaggacgucgaccucggcgccggcacccggcacgugaacgccgagcccgagacccccaacauggacgugaucggggagcgcaucaagcggaucaaggaggagcacaacagcaccuggcacuacgacgacgagaacccguacaagacgugggcguaccacggcuccuacgaggucaaggccaccgggagcgccuccagcaugaucaacggcguggugaagcugcugaccaagcccugggacgucgugcccauggucacccagauggccaugacggacaccacccccuucgggcagcagcgcguguucaaggagaagguggacacccggacgccgcgcagcaugcccggcacccggcgcgucaugggcaucaccgcggaguggcucuggcggacccuggggcgcaacaagaagccccggcugugcacgcgcgaggaguucaccaagaaggugcgcaccaacgccgccaugggcgccguguucaccgaggagaaccagugggacuccgccaaggcggccgucgaggacgaggacuucuggaagcucguggaccgggagcgcgagcugcacaagcuggggaagugcggcagcugcguguacaacaugauggggaagcgggagaagaagcucggcgaguucggcaaggccaaggggucccgcgccaucugguacauguggcugggcgcccgguaccuggaguucgaggcgcucggguuccugaacgaggaccacugguucagccgcgagaacuccuacagcggcgucgagggggagggccugcacaagcucggcuacauccugcgggacaucuccaagauccccgggggcgccauguacgccgacgacacggccgggugggacacccgcaucaccgaggacgaccugcacaacgaggagaagaucacccagcagauggacccggagcaccggcagcucgccaacgcgaucuucaagcugacguaccagaacaagguggugaagguccagcgccccacccccaccggcaccgugauggacaucaucagccggaaggaccagcgcggcuccggccaggugggcaccuacgggcugaacacguucaccaacauggaggcccagcucauccggcagauggagggcgaggggguccugagcaaggccgaccuggagucccaccaccuccccgagaagaagaucacccaguggcuggagaccaagggcguggagcgccugaagcggauggccaucagcggcgacgacugcguggucaagccgaucgacgaccgcuucgccaacgcgcuccuggcccugaacgacauggggaaggugcggaaggacaucccccaguggcagcccuccaagggcuggcacgacuggcagcagguccccuucugcagccaccacuuccacgagcucaucaugaaggacgggcgcaagcuggucgugccgugccggccccaggacgagcugaucggccgcgcccggaucucccagggggccggcuggagccuccgcgagacggcgugccugggcaaggccuacgcccagauguggucccugauguacuuccaccgccgggaccuccgccuggccagcaacgccaucugcuccgcggugcccguccacugggugcccaccagccggaccaccuggagcauccacgcccaccaccaguggaugacgaccgaggacaugcugaccguguggaaccgcgucuggaucgaggacaacccguggauggaggacaagacccccgugacgaccugggagaacgugcccuaccucgggaagcgggaggaccaguggugcggcucccugaucgggcugaccagccgcgccaccugggcccagaacauccccacggccauccagcagguccggucccucaucggcaacgaggaguuccuggacuacaugccgagcaugaagcgcuuccggaaggaggaggaguccgagggggcgaucugguga

SEQ ID NO: 10137 - RNA, 9873 nt, Artificial Sequence
  derived and/or modified CDS sequence (opt1) from DENV-3__EU529705__SS-prME
accagccucugccucaugaugauccugcccgccgcccuggcguuccaccucaccagccgggacggcgagccgcggaugaucguggggaagaacgagcggggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcguggggaucggcaaccgcgacuucguggagggccuguccggggccaccugggucgacguggugcuggagcacggcgggugcgucaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacaccgugaucaucacggugcacaccggggaccagcaccaggucggcaacgagacccagggggugaccgccgagaucacgccccaggccagcaccaccgaggcgauccugcccgaguacggcacccuggggcucgagugcuccccgcgcaccggccuggacuucaacgagaugauccugcucacgaugaagaacaaggccuggaugguccaccggcagugguucuucgaccugccccugcccuggaccagcggcgccaccaccgagacgcccaccuggaaccgcaaggagcuccuggugaccuucaagaacgcccacgccaagaagcaggagguggucgugcuggggucccaggagggcgcgaugcacaccgcccucacgggggccaccgagauccagaacagcggcgggaccuccaucuucgccggccaccugaagugccggcugaagauggacaagcucggccugaaggggaugagcuacgccaugugcaccaacacguucgugcugaagaaggaggucuccgagacccagcacggcaccauccucaucaagguggaguacaagggggaggacgugccgugcaagguccccuucagcaccgaggacggccagggcaaggcgcacagcgggcgccugaucacggccaaccccguggugaccaagaaggaggagcccgucaacaucgaggccgagccgcccuucggcgaguccaacaucgugaucgggaucggcgacaacgcccugaagaucaacugguacaagaaggggagcuccaucggcaagauguucgaggcgaccgcccggggcgcccgccggauggccauccugggggacaccgccugggacuucggcagcgucgggggcguccucaacucccuggggaagauggugcaccagaucuucggcagcgcguacacggcccuguucuccggcgugagcugggucaugaagaucgggaucggcauccuccugaccuggaucgggcugaacuccaagaacaccagcauguccuucagcugcaucgugaucggcaucaucacccucuaccugggggccgugguccaggccgacaugggcugcgugaucaacuggaagggcaaggagcugaagugcggguccggcaucuucgugacgaacgagguccacaccuggaccgagcaguacaaguuccaggccgacagccccaagcgccucgcgaccgccaucgccggggccugggagaacggcgugugcgggauccgcuccacgacccggauggagaaccugcuguggaagcagaucgccaacgagcucaacuacauccugugggagaacaacaucaagcugaccguggucgugggcgacaucaucggcgugcucgagcaggggaagcgcacccugacgccccagccgauggagcugaaguacagcuggaaggcguggggcaaggccaagaucgucaccgccgagacccagaacuccagcuucaucaucgacgggcccaacacccccgagugccccuccgccagccgggcguggaacgugugggagguggaggacuacggcuucggcgucuucacgaccaacaucuggcucaagcugcgcgagguguacacccagcugugcgaccaccggcucaugagcgccgccgugaaggacgagcgcgccguccacgccgacaugggguacuggaucgagucccagaagaacggcagcuggaagcuggagaaggcgucccugaucgaggugaagaccugcaccuggcccaagucccacacgcucugguccaacggggugcuggagagcgacaugaucauccccaagucccuggccggccccaucagccagcacaacuaccggccgggguaccacacccagaccgccggccccuggcaccucggcaagcuggagcuggacuucaacuacugcgaggggaccacggucgugaucaccgagaacugcggcacccgcgggcccucccuccggaccacgaccgugagcggcaagcugauccacgaguggugcugccgcuccugcacccugcccccgcuccgguacaugggggaggacggcugcugguacggcauggagauccgccccaucagcgagaaggaggagaacauggucaagucccuggugagcgccggguccggcaagguggacaacuucaccauggggguccugugccucgccauccuguucgaggaggugaugcggggcaaguucgggaagaagcacaugaucgcgggcguguucuucacguucguccugcuccugagcggccagaucaccuggcgcgacauggcccacacccugaucaugaucggguccaacgccagcgaccggaugggcaugggggugaccuaccucgcccugaucgccacguucaagauccagcccuuccuggcgcucggcuucuuccugcgcaagcugaccagccgggagaaccuccugcugggcguggggcucgccauggccaccacccugcagcugcccgaggacaucgagcagauggccaacggcaucgcgcucgggcugauggcccugaagcucaucacgcaguucgagaccuaccagcuguggaccgcccugaucucccugaccugcagcaacacgaucuucacccugaccgucgccuggcgcaccgccacgcugauccucgcgggcgugucccugcugccggucugccagagcuccagcaugcggaagaccgacuggcuccccaugaccguggccgccaugggggugccgccccucccgcuguucaucuucucccucaaggacacccugaagcgccgcagcuggccccugaacgagggcgucauggccgugggccucguguccauccuggccagcucccugcuccggaacgacguccccauggcggggccccugguggccggcgggcugcucaucgccugcuacgugaucacgggcaccagcgccgaccugaccgucgagaaggccgcggacgugaccugggaggaggaggccgagcagacgggggugucccacaaccugaugaucaccgucgacgacgacggcaccaugcgcaucaaggacgacgagaccgagaacauccucaccgugcugcugaagacggcccuccugaucgugagcggcaucuucccguacuccauccccgccacccugcucgucuggcacaccuggcagaagcagacccagcggagcggggugcugugggacgugcccagcccgcccgagacgcagaaggccgagcuggaggagggcgucuaccgcaucaagcagcaggggaucuucggcaagacccaggugggggugggcguccagaaggagggcguguuccacaccauguggcacgugacccgcggggcgguccucacguacaacggcaagcgccuggagcccaacugggccagcgugaagaaggaccugaucuccuacgggggcggguggcggcucagcgcccaguggcagaagggcgaggaggugcaggucaucgccguggagcccggcaagaaccccaagaacuuccagaccaugcccgggaccuuccagaccacgaccggcgagaucggggcgaucgcccuggacuucaagcccggcaccagcggcucccccaucaucaaccgcgaggggaagguggucggccuguacgggaacggcguggugaccaagaacgggggcuacgucagcggcaucgcccagacgaacgccgagccggacgggcccacccccgagcuggaggaggagauguucaagaagcggaaccucaccaucauggaccugcaccccggcuccgggaagacccgcaaguaccugccggccaucgugcgggaggcgaucaagcgccggcuccgcacgcugauccuggcccccacccggguggucgccgccgagauggaggaggcccucaagggccugcccauccgcuaccagaccaccgcgaccaagagcgagcacaccgggcgggagaucguggaccugaugugccacgccaccuucaccaugcgccuccugucccccgugcgggucccgaacuacaaccugaucaucauggacgaggcccacuucacggaccccgccagcaucgccgcgcgcggcuacaucuccacccgggugggcaugggggaggccgccgccaucuucaugaccgcgacgccgcccggcacggccgacgccuucccgcagagcaacgcccccauccaggacgaggagcgcgacauccccgagcgcuccuggaacagcgggaacgaguggaucaccgacuucgccggcaagaccgugugguucguccccuccaucaaggcggggaacgacaucgccaacugccuccggaagaacggcaagaaggugauccagcugagccgcaagaccuucgacacggaguaccagaagaccaagcugaacgacugggacuucguggucaccaccgacaucuccgagaugggcgccaacuucaaggccgaccgggugaucgacccgcgccggugccucaagcccgugauccugacggacgggcccgagcgcgucauccuggccggccccaugccggugaccgcggccagcgccgcccagcggcgcgggcgggugggccgcaacccccagaaggagaacgaccaguacaucuucaccgggcagccccucaacaacgacgaggaccacgcccacuggaccgaggcgaagaugcugcuggacaacaucaacacccccgagggcaucaucccggcccucuucgagcccgagcgggagaaguccgccgccaucgacggcgaguaccgccugaagggggagagccggaagacguucgucgagcugaugcgccggggcgaccuccccguguggcuggcgcacaaggucgccuccgaggggaucaaguacaccgaccgcaaguggugcuucgacggccagcggaacaaccagauccuggaggagaacauggacguggagaucuggaccaaggagggcgagaagaagaagcuccgcccccgguggcuggacgcccgcaccuacagcgacccgcuggcccucaaggaguucaaggacuucgccgcggggcgcaaguccaucgcccuggaccuggugacggagaucggccggguccccagccaccucgcccaccgcacccggaacgcccuggacaaccuggugaugcuccacaccagcgagcacgggggccgcgccuaccggcacgcgguggaggagcugcccgagaccauggagacgcugcuccugcuggggcucaugauccugcugaccggcggcgccaugcuguuccugaucuccgggaagggcaucgggaagaccagcaucggccugaucugcgucaucgccuccagcgggaugcucuggauggccgagaucccgcugcaguggaucgccuccgcgaucgugcuggaguucuucaugauggugcuccugauccccgagcccgagaagcagcgcacgccccaggacaaccagcuggccuacgucgugaucggcauccucacgcuggccgccaucaucgccgcgaacgagaugggccugcucgagaccaccaagcgggaccuggggaugagcaaggagccgggcguggucucccccaccagcuaccuggacguggaccuccaccccgccuccgccuggacgcuguacgccguggcgaccaccgucaucacccccaugcugcgccacacgaucgagaacagcaccgccaacgugucccucgccgccaucgccaaccaggcggugguccugauggggcuggacaagggcuggccgaucagcaagauggaccucggggugccccugcuggcccucggcugcuacucccaggugaacccccugacccugaccgccgccguccuccugcugaucacgcacuacgccaucaucggccccgggcuccaggcgaaggccacccgggaggcccagaagcgcaccgccgccggcaucaugaagaacccgaccguggacgggaucaugacgaucgaccuggaccccgugaucuacgacagcaaguucgagaagcagcugggccaggucaugcuccuggugcugugcgcggugcagcuccugcugaugcggaccuccugggcccucugcgaggcccugacccuggccaccggccccaucacgacccucugggaggggagccccggcaaguucuggaacaccaccaucgcggucuccauggccaacaucuuccgcgggagcuaccuggccggcgccgggcuggccuucuccaucaugaaguccgugggcacgggcaagcgggggaccggcagccagggggagacccucggcgagaaguggaagaagaagcugaaccagcugucccgcaaggaguucgaccucuacaagaaguccgggaucaccgagguggaccggaccgaggcgaaggagggccugaagcgcggcgagaucacgcaccacgccgucucccgggggagcgccaagcugcagugguucguggagcgcaacauggugaucccggagggccgggucaucgaccucgggugcggccgcgggggcugguccuacuacugcgccggccugaagaaggugaccgaggugcggggguacaccaagggcgggcccggccacgaggagcccguccccaugagcaccuacggguggaacaucgugaagcugauguccggcaaggacguguucuaccucccgcccgagaagugcgacacgcugcugugcgacaucggcgagagcucccccagccccaccgucgaggagucccgcaccauccgcgugcugaagaugguggagccguggcucaagaacaaccaguucugcaucaagguccugaaccccuacaugcccaccgugaucgagcaccuggagcggcuccagcgcaagcacgggggcaugcuggugcggaacccccugagccgcaacuccacgcacgagauguacuggaucagcaacgggaccggcaacaucgucgccuccgugaacauggugagccggcuccugcugaaccgcuucaccaugacccaccggcgcccgacgaucgagaaggacgucgaccucggcgcggggacccggcacgugaacgccgagcccgagacccccaacauggacgugaucggcgagcgcaucaagcggaucaaggaggagcacaacuccaccuggcacuacgacgacgagaacccguacaagacgugggccuaccacgggagcuacgaggucaaggccaccggcuccgccagcagcaugaucaacgggguggucaagcugcugaccaagcccugggacguggugcccauggucacccagauggcgaugacggacaccacccccuucggccagcagcgcguguucaaggagaagguggacacccggacgccgcgcuccaugcccggcacccggcgcgucauggggaucaccgccgaguggcucuggcggacccugggccgcaacaagaagccccggcugugcacgcgcgaggaguucaccaagaaggugcgcaccaacgccgccaugggggcgguguucaccgaggagaaccagugggacagcgccaaggccgccgucgaggacgaggacuucuggauccucguggaccgggagcgcgagcugcacaagcugggcaagugcggguccugcguguacaacaugaugggcaagcgggagaagaagcucggcgaguucgggaaggccaagggcagccgcgcgaucugguacauguggcugggggcccgguaccuggaguucgaggcccucggcuuccugaacgaggaccacugguucucccgcgagaacagcuacuccggggucgagggcgagggccugcacaagcucggguacauccugcgggacaucagcaagauccccggcggggccauguacgccgacgacacggcgggcugggacacccgcaucaccgaggacgaccugcacaacgaggagaagaucacccagcagauggacccggagcaccggcagcucgccuccgccaucuucaagcugacguaccagaacaagguggugaagguccagcgccccacccccaccggcaccgugauggacaucaucagccggaaggaccagcgcggguccggccagguggggaccuacggccugaacacguucaccaacauggaggcccagcucauccggcagauggagggggagggcguccugagcaaggccgaccuggagaacccccaccucccggagaagaagaucacccaguggcuggagaccaagggcguggagcgccugaagcggauggcgaucuccggggacgacugcguggucaagcccaucgacgaccgcuucgccaacgcccuccuggcccugaacgacaugggcaaggugcggaaggacaucccccaguggcagcccagcaagggguggcacgacuggcagcaggucccguucugcucccaccacuuccacgagcucaucaugaaggacggccgcaagcuggucgugcccugccggccccaggacgagcugaucgggcgcgcccggaucagccagggcgcgggcuggucccuccgcgagacggccugccuggggaaggccuacgcccagauguggagccugauguacuuccaccgccgggaccuccgccuggcguccaacgccaucugcagcgccgugcccguccacugggugccgaccagccggaccaccugguccauccacgcccaccaccaguggaugacgaccgaggacaugcugaccguguggaaccgcgucuggaucgaggacaaccccuggauggaggacaagacccccgugacgaccugggagaacgugcccuaccucggcaagcgggaggaccaguggugcgggagccugaucggccugaccucccgcgccaccugggcgcagaacaucccgacggccauccagcagguccggagccucaucgggaacgaggaguuccuggacuacaugcccuccaugaagcgcuuccggaaggaggaggagagcgagggcgccaucugguga

SEQ ID NO: 10138 - RNA, 9873 nt, Artificial Sequence
  derived and/or modified CDS sequence (opt1) from DENV-3__EU596492__SS-prME
accagccugugccucaugaugauccugcccgccgcccuggcguuccaccucaccagccgcgacggggagccccggaugaucguggggaagaacgagcgcggcaagagccugcuguucaagaccgccagcgggaucaacaugugcacccucaucgccauggaccugggcgagaugugcgacgacaccgugaccuacaagugcccccacaucgccgagguggagcccgaggacaucgacugcuggugcaaccugaccagcaccugggugaccuacgggaccugcaaccaggccggcgagcaccggcgcgacaagcgguccguggcgcucgcgccccacgugggcauggggcuggacacgcgcacccagaccuggaugagcgccgagggcgccuggcggcaggucgagaagguggagaccugggcgcugcgccacccgggguucacgauccucgcccuguuccuggcccacuacaucggcaccucccucacccagaagguggugaucuucguccugcugaugcucgugacccccagcaugacgaugcggugcgugggggucggcaaccgcgacuucguggagggccuguccggggccaccuggguggacgucgugcuggagcacggcgggugcgugaccaccauggccaagaacaagcccacgcucgacaucgagcugcagaagaccgaggcgacccagcuggccacccuccggaagcugugcaucgagggcaagaucacgaacaucaccaccgacagccgcugccccacccagggcgaggccgcccugccggaggagcaggaccagaacuacgucugcaagcacacguacguggaccggggguggggcaacgggugcggccucuucgggaagggcucccuggugaccugcgccaaguuccagugccuggagcccaucgagggcaaggucgugcaguacgagaaccucaaguacaccgugaucaucaccguccacacgggggaccagcaccaggugggcaacgagacccagggggucaccgcggagaucacgccccaggccagcacgaccgaggccauccugcccgaguacggcacccuggggcucgagugcuccccgcgcaccggccuggacuucaacgagaugauccugcucaccaugaagaacaaggccuggauggugcaccggcagugguucuucgaccugccccugcccuggacgagcggcgccaccaccgagacccccacguggaaccgcaaggagcuccuggugaccuucaagaacgcgcacgccaagaagcaggaggucguggugcuggggucccaggagggcgccaugcacaccgcccucaccggggccacggagauccagaacagcggcgggaccuccaucuucgcgggccaccugaagugccggcugaagauggacaagcucgagcugaagggcaugagcuacgccaugugcaccaacaccuucguccugaagaaggagguguccgagacgcagcacgggaccauccucaucaagguggaguacaagggcgaggacgccccgugcaagauccccuucagcaccgaggacgggcagggcaaggcccacaacggccgccugaucaccgcgaaccccgucgugacgaagaaggaggagcccgugaacaucgaggccgagccgcccuucggggagagcaacaucgucaucggcaucggggacaacgcccugaagaucaacugguacaagaagggcuccagcaucgggaagauguucgaggccaccgcccggggcgcgcgccggauggccauccugggcgacaccgccugggacuucggguccgugggcggggugcucaacagccugggcaagaugguccaccagaucuucggguccgccuacaccgcccuguucagcggcguguccugggugaugaagaucggcaucgggguccuccugacguggaucggccugaacagcaagaacaccuccaugagcuucuccugcaucgcgaucgggaucaucacccucuaccugggcgccguggugcaggccgacaccgggugcgucgugaacuggaagggcaaggagcugaagugcggcagcgggaucuucgugacgaacgagguccacaccuggaccgagcaguacaaguuccaggccgacucccccaagcgccucgccaccgcgaucgccggcgccugggagaacggggugugcggcauccgcagcacgacccggauggagaaccugcuguggaagcaggucgccaacgagcucaacuacauccugugggagaacaacaucaagcugaccgucguggugggggacaucaucggcguccucgagcagggcaagcgcacccugacgccccagccgauggagcugaaguacuccuggaagaccugggggaaggcgaagaucgugaccgccgagacccagaacagcuccuucaucaucgacggccccaacacgcccgagugccccagcgccucccgggccuggaacgugugggaggucgaggacuacggguucggcguguucaccaccaacaucuggcucaagcugcgcgagguguacacccagcugugcgaccaccggcucaugagcgccgcggucaaggacgagcgcgccgugcacgccgacaugggcuacuggaucgagagccagaagaacggguccuggaagcuggagaaggccagccugaucgaggugaagaccugcacguggccgaagucccacacccucuggagcaacggcguccuggaguccgacaugaucauccccaagagccuggccgggcccaucucccagcacaacuaccggccgggcuaccacacccagaccgcggggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaaggucgacaacuucacgaugggcgugcugugccucgccauccuguucgaggaggugaugcgggggaaguucggcaagaagcacaugaucgccggggucuucuucaccuucgugcugcuccuguccggccagaucaccuggcgcgacauggcccacacccugaucaugaucggcagcaacgcguccgaccggauggggaugggcgugacguaccucgcccugaucgccaccuucaagauccagcccuuccuggcccucggguucuuccugcgcaagcugaccagccgggagaaccuccugcugggcgucggccucgcgauggccaccacgcugcagcugcccgaggacaucgagcagauggccaacgggaucgcccucggccugauggcccugaagcucaucacccaguucgagaccuaccagcuguggaccgcgcugaucagccucacgugcuccaacaccaucuucacccugaccguggccuggcgcacggccacccugauccucgccggggucagccugcugccggugugccaguccagcuccaugcggaaguccgacuggcuccccaugaccguggccgcgaugggcgugccgccccucccgcuguucaucuucucccucaaggacacccugaagcgccgcagcuggccccugaacgagggggugauggccgugggccucgucuccauccuggccagcucccugcuccggaacgacgugcccauggccggcccccugguggccgggggccugcucaucgcgugcuacgucaucacggggaccagcgccgaccugaccguggagaaggccgccgacgugaccugggaggaggaggccgagcagacgggcgucucccacaaccugaugaucaccguggacgacgacgggaccaugcgcaucaaggacgacgagaccgagaacauccucaccgugcugcugaagacggcgcuccugaucgucagcggcaucuucccguacuccauccccgccacccugcucguguggcacaccuggcagaagcagacccggcgcagcggcgugcugugggacguccccagcccgcccgagacgcagaaggccgagcuggaggaggggguguaccggaucaagcagcagggcaucuucgggaagacccaggugggcgucggggugcagaaggagggcguguuccacaccauguggcacgucacccgcggcgccgugcucacguacaacgggaagcggcuggagcccaacugggcgagcgugaagaaggaccugaucuccuacggcgggggcuggcgccucagcgcccaguggcagaagggggaggagguccaggugaucgccguggagcccggcaagaaccccaagaacuuccagaccaugcccggcaccuuccagaccacgaccggggagaucggcgccaucgcccuggacuucaagcccgggaccagcggcucccccaucaucaaccgggagggcaaggucguggggcuguacggcaacgggguggucaccaagaacggcggguacgugagcggcaucgcgcagacgaacgccgagccggacggccccacccccgagcuggaggaggagauguucaagaagcgcaaccucaccaucauggaccugcaccccggguccggcaagacccggaaguaccugccggccaucgugcgcgaggccaucaagcggcgccuccggacgcugauccuggcccccacccgcgucguggcggccgagauggaggaggcccucaaggggcugcccauccgguaccagaccaccgccaccaagagcgagcacaccggccgcgagaucguggaccugaugugccacgccaccuucaccaugcggcuccugucccccguccgcgugccgaacuacaaccugaucaucauggacgaggcgcacuucacggaccccgccagcaucgccgcccggggguacaucuccacccgcgugggcaugggcgaggcggccgccaucuucaugaccgccacgccgcccgggacggccgacgcguucccgcagagcaacgcccccauccaggacgaggagcgcgacauccccgagcgguccuggaacagcggcaacgaguggaucaccgacuucgccgggaagaccgucugguucgugcccuccaucaaggccggcaacgacaucgccaacugccuccgcaagaacgggaagaaggugauccagcugagccggaagaccuucgacacggaguaccagaagaccaagcugaacgacugggacuucgucgugaccaccgacaucuccgagaugggcgcgaacuucaaggccgaccgcgugaucgacccgcggcgcugccucaagcccgucauccugacggacggccccgagcgggugauccuggccgggcccaugccggugaccgccgccagcgcggcccagcgccggggccgcgucgggcggaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgcgagaaguccgccgccaucgacggcgaguaccggcugaagggcgagagccgcaagacguucguggagcugaugcggcgcggggaccuccccgucuggcuggcccacaagguggccuccgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcgcgcaccuacagcgacccgcuggcccucaaggaguucaaggacuucgccgccggccggaaguccaucgcccuggaccuggucacggagaucgggcgcgugcccagccaccucgcgcaccggacccgcaacgcccuggacaaccuggugaugcuccacaccagcgagcacggcgggaaggccuaccggcacgccgucgaggagcugcccgagaccauggagacgcugcuccugcugggccucaugauccugcugaccgggggcgccaugcuguuccugaucuccggcaaggggaucggcaagaccagcaucgggcugaucugcgugaucgcguccagcggcaugcucuggauggccgagaucccgcugcaguggaucgccuccgccaucgugcuggaguucuucaugaugguccuccugauccccgagcccgagaagcagcgcacgccccaggacaaccagcuggccuacguggugaucgggauccucacgcuggcggccaucaucgccgccaacgagaugggccugcucgagaccaccaagcgggaccugggcaugagcaaggagccgggggucgugucccccaccagcuaccuggacguggaccuccaccccgcguccgccuggacgcuguacgccgucgccaccaccgugaucacccccaugcugcgccacacgaucgagaacagcaccgccaacgugucccucgcggccaucgccaaccaggccgucgugcugaugggccugaacaagggguggccgaucagcaagauggaccucggcgugccccugcuggcccucgggugcuacucccaggucaacccccugacccugaccgcggccgugcuccugcugaucacgcacuacgccaucaucggccccggccuccaggccaaggccacccgggaggcgcagaagcgcaccgccgccgggaucaugaagaacccgaccguggacggcaucaugacgaucgaccuggaccccgucaucuacgacagcaaguucgagaagcagcugggccaggugaugcuccuggugcugugcgccguccagcuccugcugaugcggaccuccugggcgcucugcgaggcccugacccuggccaccggccccaucacgacccucugggagggcagccccgggaaguucuggaacaccaccaucgccguguccauggccaacaucuuccgcggcagcuaccuggcgggggccggccuggccuucuccaucaugaaguccguggggacgggcaagcggggcaccgggagccagggcgagacccucggggagaaguggaagaagaagcugaaccagcugucccgcaaggaguucgaccucuacaagaaguccggcaucaccgaggucgaccggaccgaggccaaggaggggcugaagcgcggcgagaucacgcaccacgccgugucccggggcagcgcgaagcugcagugguucguggagcgcaacauggucaucccggaggggcgggugaucgaccucggcugcgggcgcggcgggugguccuacuacugcgccggccugaagaaggugaccgagguccggggcuacaccaagggcgggcccgggcacgaggagcccgugcccaugagcaccuacggcuggaacaucgugaagcugauguccgggaaggacgucuucuaccucccgcccgagaagugcgacacgcugcugugcgacaucggcgagagcucccccagccccaccguggaggagucccgcaccauccgcgugcugaagauggucgagccguggcucaagaacaaccaguucugcaucaaggugcugaaccccuacaugcccaccgugaucgagcaccuggagcggcuccagcgcaagcacggcgggaugcugguccggaacccccugagccgcaacuccacgcacgagauguacuggaucagcaacggcaccgggaacaucguggccuccgugaacauggucagccggcuccugcugaaccgcuucaccaugacccaccggcgcccgacgaucgagaaggacguggaccucggcgccggcacccggcacgugaacgccgagcccgagacccccaacauggacgucaucggggagcgcaucaagcggaucaaggaggagcacaacuccaccuggcacuacgacgacgagaacccguacaagacgugggcguaccacggcagcuacgaggugaaggccaccggguccgccagcagcaugaucaacggcgucgugaagcugcugaccaagcccugggacgugguccccauggugacccagauggccaugacggacaccacccccuucgggcagcagcgcguguucaaggagaaggucgacacccggacgccgcgcuccaugcccggcacccggcgcgugaugggcaucaccgcggaguggcucuggcggacccuggggcgcaacaagaagccccggcugugcacgcgcgaggaguucaccaagaaggugcgcaccaacgccgccaugggcgccgucuucaccgaggagaaccagugggacagcgccaaggcggccguggaggacgaggacuucuggaagcucguggaccgggagcgcgagcugcacaagcuggggaagugcggcuccugcgucuacaacaugauggggaagcgggagaagaagcucggcgaguucggcaaggccaaggggagccgcgccaucugguacauguggcugggcgcccgguaccuggaguucgaggcgcucggguuccugaacgaggaccacugguucucccgcgagaacagcuacuccggcguggagggggagggccugcacaagcucggcuacauccugcgggacaucagcaagauccccgggggcgccauguacgccgacgacacggccgggugggacacccgcaucaccgaggacgaccugcacaacgaggagaagaucacccagcagauggacccggagcaccggcagcucgccaacgcgaucuucaagcugacguaccagaacaagguggucaaggugcagcgccccacccccaccggcaccgugauggacaucaucucccggaaggaccagcgcggcagcgggcaggucggcaccuacgggcugaacacguucaccaacauggaggcccagcucauccggcagauggagggcgagggggugcugaccaaggccgaccuggagaacccccaccucuccgagaagaagaucacccaguggcuggagacgaagggcguggagcgccugaagcggauggccaucagcggcgacgacugcgucgugaagccgaucgacgaccgcuucgccaacgcgcuccuggcccugaacgacauggggaaggugcggaaggacaugccccaguggcagcccuccaagggcuggcacgacuggcagcagguccccuucugcagccaccacuuccacgagcucaucaugaaggacgggcgcaagcugguggugccgugccggccccaggacgagcugaucggccgcgcccggaucucccagggggccggcuggagccuccgcgagaccgcgugccugggcaaggccuacgcccagauguggucccugauguacuuccaccgccgggaccuccgccuggccagcaacgccaucugcuccgcgguccccgugcacugggugcccaccagccggaccacguggagcauccacgcccaccaccaguggaugaccaccgaggacaugcugaccgucuggaaccgcguguggaucgaggacaacccguggauggaggacaagacgcccgugaccaccugggagaacguccccuaccucgggaagcgggaggaccaguggugcggcucccugaucgggcugaccagccgcgccacgugggcccagaacauccccaccgccauccagcagguccggucccucaucggcaacgaggaguuccuggacuacaugccgagcaugaagcgcuuccggaaggaggaggaguccgagggggcgaucugguga

SEQ ID NO: 10139 - RNA, 9873 nt, Artificial Sequence
  derived and/or modified CDS sequence (opt1) from DENV-3__EU596493__SS-prME
accagccugugccucaugaugauccugcccgccgcccuggccuuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucgccgagguggagcccgaggacaucgacugcuggugcaaccugaccagcaccugggugaccuacgggaccugcaaccaggccggcgagcaccggcgcgacaagcgguccguggcgcucgcgccccacgugggcauggggcuggacacccgcacccagaccuggaugagcgccgagggcgccuggcggcaggucgagaaggucgagaccugggcgcugcgccacccgggguucacgauccucgcccuguuccuggcccacuacaucggcaccucccucacccagaagguggugaucuucguccugcugaugcucgugacccccagcaugacgaugcggugcgugggggucggcaaccgcgacuucguggagggccuguccggggccaccuggguggacgucgugcuggagcacggcgggugcgugaccaccauggccaagaacaagcccacgcucgacaucgagcugcagaagaccgaggcgacccagcuggccacccuccggaagcugugcaucgagggcaagaucacgaacaucaccaccgacagccgcugccccacccagggcgaggccguccugccggaggagcaggaccagaacuacgugugcaagcacacguacguggaccggggguggggcaacgggugcggccucuucgggaagggcucccuggugaccugcgccaaguuccagugccuggagcccaucgagggcaagguggugcaguacgagaaccucaaguacaccgucaucaucaccgugcacacgggggaccagcaccaggucggcaacgagacccagggggugaccgccgagaucacgccccaggcgagcacgaccgaggccauccugcccgaguacggcacccuggggcucgagugcuccccgcgcaccggccuggacuucaacgagaugauccugcucaccaugaagaacaaggccuggauggugcaccggcagugguucuucgaccugccccugcccuggacgagcggcgccaccaccgagacccccacguggaaccgcaaggagcuccuggucaccuucaagaacgcccacgcgaagaagcaggagguggugguccuggggucccaggagggcgccaugcacaccgcccucaccggggccacggagauccagaacagcggcgggaccuccaucuucgccggccaccugaagugccggcugaagauggacaagcucgagcugaagggcaugagcuacgcgaugugcaccaacaccuucgugcugaagaaggagguguccgagacgcagcacgggaccauccucaucaaggucgaguacaagggcgaggacgccccgugcaagauccccuucagcaccgaggacgggcagggcaaggcccacaacggccgccugaucaccgccaaccccguggugacgaagaaggaggagcccgucaacaucgaggcggagccgcccuucggggagagcaacaucgugaucggcaucggggacaacgcccugaagaucaacugguacaagaagggcuccagcaucgggaagauguucgaggccaccgcccggggcgcccgccggauggcgauccugggcgacaccgccugggacuucggguccgugggcgggguccucaacagccugggcaagauggugcaccagaucuucggguccgccuacaccgcccuguucagcggcguguccugggucaugaagaucggcaucggggugcuccugacguggaucggccugaacagcaagaacaccuccaugagcuucuccugcaucgccaucgggaucaucacccucuaccugggcgcggugguccaggccgacaccgggugcgugaucaacuggaagggcaaggagcugaagugcggcagcgggaucuucgugacgaacgagguccacaccuggaccgagcaguacaaguuccaggccgacucccccaagcgccucgccaccgccaucgcgggcgccugggagaacggggugugcggcauccgcagcacgacccggauggagaaccugcuguggaagcaggucgccaacgagcucaacuacauccugugggagaacaacaucaagcugaccgucguggugggggacaucaucggcguccucgagcagggcaagcgcacccugacgccccagccgauggagcugaaguacuccuggaagaccugggggaaggccaagaucgugaccgcggagacccagaacagcuccuucaucaucgacggccccaacacgcccgagugccccagcgccucccgggccuggaacgugugggaggucgaggacuacggguucggcguguucaccaccaacaucuggcucaagcugcgcgagguguacacccagcugugcgaccaccggcucaugagcgccgccgucaaggacgagcgcgcggugcacgccgacaugggcuacuggaucgagagccagaagaacggguccuggaagcuggagaaggccagccugaucgaggugaagaccugcacguggccgaagucccacacccucuggagcaacggcguccuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgcgggcagcgggaaggucgacaacuucacgaugggcgugcugugccucgccauccuguucgaggaggugaugcgggggaaguucggcaagaagcacaugaucgccggggucuucuucaccuucgugcugcuccuguccggccagaucaccuggcgcgacauggcccacacccugaucaugaucggcagcaacgccuccgaccggauggggaugggcgugacguaccucgcgcugaucgccaccuucaagauccagcccuuccuggcccucggguucuuccugcgcaagcugaccagccgggagaaccuccugcugggcgucggccucgccauggcgaccacgcugcagcugcccgaggacaucgagcagauggccaacgggaucgcccucggccugauggcccugaagcucaucacccaguucgagaccuaccagcuguggaccgcccugaucagccucacgugcuccaacaccaucuucacccugaccguggcguggcgcacggccacccugauccucgccggggucagccugcugccggugugccaguccagcuccaugcggaaguccgacuggcuccccaugaccguggccgccaugggcgugccgccccucccgcuguucaucuucucccucaaggacacccugaagcgccgcagcuggccccugaacgagggggugauggcggugggccucgucuccauccuggccagcucccugcuccggaacgacgugcccauggccggcccccugguggccgggggccugcucaucgccugcuacgucaucacggggaccagcgcggaccugaccguggagaaggccgccgacgugaccugggaggaggaggccgagcagacgggcgucucccacaaccugaugaucaccguggacgacgacgggaccaugcgcaucaaggacgacgagaccgagaacauccucaccgugcugcugaagacggcccuccugaucgucagcggcaucuucccguacuccauccccgcgacccugcucguguggcacaccuggcagaagcagacccggcgcagcggcgugcugugggacguccccagcccgcccgagacgcagaaggccgagcuggaggaggggguguaccggaucaagcagcagggcaucuucgggaagacccaggugggcgucggggugcagaaggagggcguguuccacaccauguggcacgucacccgcggcgccgugcucacguacaacgggaagcggcuggagcccaacugggccagcgugaagaaggaccugaucuccuacggcgggggcuggcgccucaacgcgcaguggcagaagggggaggagguccaggugaucgccguggagcccggcaagaaccccaagaacuuccagaccaugcccggcaccuuccagaccacgaccggggagaucggcgccaucgcccuggacuucaagcccgggaccagcggcagccccaucaucaaccgggagggcaaggucguggggcuguacggcaacgggguggucaccaagaacggcggguacguguccggcaucgcccagacgaacgcggagccggacggccccacccccgagcuggaggaggagauguucaagaagcgcaaccucaccaucauggaccugcaccccgggagcggcaagacccggaaguaccugccggccaucgugcgcgaggccaucaagcggcgccuccggacgcugauccuggcccccacccgcgucguggccgcggagauggaggaggcccucaaggggcugcccauccgguaccagaccaccgccacgaaguccgagcacaccggccgcgagaucguggaccugaugugccacgccaccuucaccaugcggcuccugagccccguccgcgugccgaacuacaaccugaucaucauggacgaggcccacuucacggaccccgcguccaucgccgcccggggguacaucagcacccgcgugggcaugggcgaggccgcggccaucuucaugaccgccacgccgcccgggacggccgacgccuucccgcaguccaacgcgcccauccaggacgaggagcgcgacauccccgagcggagcuggaacuccggcaacgaguggaucaccgacuucgccgggaagaccgucugguucgugcccagcaucaaggccggcaacgacaucgccaacugccuccgcaagaacgggaagaaggugauccagcugucccggaagaccuucgacacggaguaccagaagaccaagcugaacgacugggacuucgucgugaccaccgacaucagcgagaugggcgccaacuucaaggcggaccgcgugaucgacccgcggcgcugccucaagcccgucauccugacggacggccccgagcgggugauccuggccgggcccaugccggugaccgccgccuccgccgcgcagcgccggggccgcgucgggcggaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgcgagaaguccgcggccaucgacggcgaguaccggcugaagggcgagucccgcaagacguucguggagcugaugcggcgcggggaccuccccgucuggcuggcccacaagguggccagcgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcccgcaccuacuccgacccgcuggcgcucaaggaguucaaggacuucgccgccggccgcaagagcaucgcccuggaccuggucacggagaucgggcgcgugcccucccaccucgcccaccggacccgcaacgcgcuggacaaccuggugaugcuccacaccagcgagcacggcgggaaggccuaccggcacgccgucgaggagcugcccgagaccauggagacgcugcuccugcugggccucaugauccugcugaccgggggcgccaugcuguuccugaucagcggcaaggggaucggcaagaccuccaucgggcugaucugcgugaucgccagcuccggcaugcucuggauggcggagaucccgcugcaguggaucgccagcgccaucgugcuggaguucuucaugaugguccuccugauccccgagcccgagaagcagcgcacgccccaggacaaccagcuggccuacguggugaucgggauccucacgcuggccgcgaucaucgccgccaacgagaugggccugcucgagaccaccaagcgggaccugggcauguccaaggagccgggggucgugagccccaccuccuaccuggacguggaccuccaccccgccagcgcguggacgcuguacgccgucgccaccaccgugaucacccccaugcugcgccacacgaucgagaacuccaccgccaacgugagccucgccgcgaucgccaaccaggccgucgugcugaugggccuggacaagggguggccgaucuccaagauggaccucggcgugccccugcuggcccucgggugcuacagccaggucaacccccugacccugaccgccgcggugcuccugcugaucacgcacuacgccaucaucggccccggccuccaggccaaggccacccgggaggcccagaagcgcaccgcggccgggaucaugaagaacccgaccguggacggcaucaugacgaucgaccuggaccccgucaucuacgacuccaaguucgagaagcagcugggccaggugaugcuccuggugcugugcgccguccagcuccugcugaugcggaccagcugggcccucugcgaggcgcugacccuggccaccggccccaucacgacccucugggagggcucccccgggaaguucuggaacaccaccaucgccgugagcauggccaacaucuuccgcggcuccuaccuggccggggcgggccuggccuucagcaucaugaaguccguggggacgggcaagcggggcaccgggagccagggcgagacccucggggagaaguggaagaagaagcugaaccagcugagccgcaaggaguucgaccucuacaagaaguccggcaucaccgaggucgaccggaccgaggccaaggaggggcugaagcgcggcgagaucacgcaccacgccgugagccggggcuccgccaagcugcagugguucguggagcgcaacauggucaucccggaggggcgggugaucgaccucggcugcgggcgcggcggguggagcuacuacugcgcgggccugaagaaggugaccgagguccggggcuacaccaagggcgggcccgggcacgaggagcccgugcccauguccaccuacggcuggaacaucgugaagcugaugagcgggaaggacgucuucuaccucccgcccgagaagugcgacacgcugcugugcgacaucggcgaguccagccccucccccaccguggaggagagccgcaccauccgcgugcugaagauggucgagccguggcucaagaacaaccaguucugcaucaaggugcugaaccccuacaugcccaccgugaucgagcaccuggagcggcuccagcgcaaguacggcgggaugcugguccggaacccccugucccgcaacagcacgcacgagauguacuggaucuccaacggcaccgggaacaucguggccagcgugaacauggucucccggcuccugcugaaccgcuucaccaugacccaccggcgcccgacgaucgagaaggacguggaccucggcgccggcacccggcacgugaacgccgagcccgagacccccaacauggacgucaucggggagcgcaucaagcggaucaaggaggagcacaacagcaccuggcacuacgacgacgagaacccguacaagacgugggccuaccacggcuccuacgaggugaaggcgaccgggagcgccuccagcaugaucaacggcgucgugaagcugcugaccaagcccugggacgugguccccauggugacccagauggccaugacggacaccacccccuucgggcagcagcgcguguucaaggagaaggucgacacccggacgccgcgcagcaugcccggcacccggcgcgugaugggcaucaccgccgaguggcucuggcggacccuggggcgcaacaagaagccccggcugugcacgcgcgaggaguucaccaagaaggugcgcaccaacgcggccaugggcgccgucuucaccgaggagaaccagugggacuccgccaaggccgcgguggaggacgaggacuucuggaagcucguggaccgggagcgcgagcugcacaagcuggggaagugcggcagcugcgucuacaacaugauggggaagcgggagaagaagcucggcgaguucggcaaggccaaggggucccgcgccaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgcgauguacgccgacgacacggccgggugggacacccgcaucaccgaggacgaccugcacaacgaggagaagaucacccagcagauggacccggagcaccggcagcucgccaacgccaucuucaagcugacguaccagaacaagguggucaaggugcagcgccccacccccaccggcaccgugauggacaucaucagccggaaggaccagcgcggcuccgggcaggucggcaccuacgggcugaacacguucaccaacauggaggcgcagcucauccggcagauggagggcgagggggugcugaccaaggccgaccuggagaacccccaccucagcgagaagaagaucacccaguggcuggagacgaagggcguggagcgccugaagcggauggccaucuccggcgacgacugcgucgugaagccgaucgacgaccgcuucgccaacgcccuccuggcgcugaacgacauggggaaggugcggaaggacaucccccaguggcagcccagcaagggcuggcacgacuggcagcagguccccuucugcucccaccacuuccacgagcucaucaugaaggacgggcgcaagcugguggugccgugccggccccaggacgagcugaucggccgcgcccggaucagccagggggccggcuggucccuccgcgagaccgccugccugggcaaggcguacgcccagauguggagccugauguacuuccaccgccgggaccuccgccuggccuccaacgccaucugcagcgccguccccgugcacugggugcccaccucccggaccacguggagcauccacgcgcaccaccaguggaugaccaccgaggacaugcugaccgucuggaaccgcguguggaucgaggacaacccguggauggaggacaagacgcccgugaccaccugggagaacguccccuaccucgggaagcgggaggaccaguggugcggcagccugaucgggcugaccucccgcgccacgugggcccagaacauccccaccgccauccagcagguccggagccucaucggcaacgaggaguuccuggacuacaugccguccaugaagcgcuuccggaaggaggaggagagcgagggggccaucugguga

SEQ ID NO: 10140 - RNA, 9873 nt, Artificial Sequence
  derived and/or modified CDS sequence (opt1) from DENV-3__EU596494__SS-prME
accagccugugccucaugaugauccugcccgccgcccuggccuuccaccucaccagccgggacggggagccgcggaugaucguggggaagaacgagcgcggcaagagccugcuguucaagaccgccagcgggaucaacaugugcacccucaucgccauggaccugggcgagaugugcgacgacaccgugaccuacaagugcccccacaucgccgagguggagcccgaggacaucgacugcuggugcaaccugaccagcaccugggugaccuacgggaccugcaaccaggccggcgagcaccggcgcgacaagcgguccgucgcgcucgcgccccacgugggcauggggcuggacacccgcacccagaccuggaugagcgccgagggcgccuggcggcaggucgagaaggucgagaccugggcgcugcgccacccgggguucacgauccucgcccuguuccuggcccacuacaucggcaccucccucacccagaagguggugaucuucguccugcugaugcucgugacccccagcaugacgaugcggugcgugggggucggcaaccgcgacuucguggagggccuguccggggccaccuggguggacgucgugcuggagcacggcgggugcgugaccaccauggccaagaacaagcccacgcucgacaucgagcugcagaagaccgaggcgacccagcuggccacccuccggaagcugugcaucgagggcaagaucacgaacaucaccaccgacagccgcugccccacccagggcgaggccguccugccggaggagcaggaccagaacuacgugugcaagcacacguacguggaccggggguggggcaacgggugcggccucuucgggaagggcucccuggugaccugcgccaaguuccagugccuggagcccaucgagggcaagguggugcaguacgagaaccucaaguacaccgucaucaucaccgugcacacgggggaccagcaccaggucggcaacgagacccagggggugaccgccgagaucacgccccaggcgagcacgaccgaggccauccugcccgaguacggcacccuggggcucgagugcuccccgcgcaccggccuggacuucaacgagaugauccugcucaccaugaagaacaaggccuggauggugcaccggcagugguucuucgaccugccccugcccuggacgagcggcgccaccaccgagacccccacguggaaccgcaaggagcuccuggucaccuucaagaacgcccacgcgaagaagcaggagguggugguccuggggucccaggagggcgccaugcacaccgcccucaccgggagcacggagauccagaacuccggcgggaccagcaucuucgccggccaccugaagugccggcugaagauggacaagcucgagcugaagggcauguccuacgccaugugcaccaacaccuucgugcugaagaaggaggugagcgagacgcagcacgggaccauccucaucaaggucgaguacaagggcgaggacgcgccgugcaagauccccuucagcaccgaggacgggcagggcaaggcccacaacggccgccugaucaccgccaaccccguggugacgaagaaggaggagcccgucaacaucgaggccgagccgcccuucggggaguccaacaucgugaucggcaucggggacaacgcgcugaagaucaacugguacaagaagggcagcuccaucgggaagauguucgaggccaccgcccggggcgcccgccggauggccauccugggcgacaccgcgugggacuucgggagcgugggcgggguccucaacucccugggcaagauggugcaccagaucuucgggagcgccuacaccgcccuguucuccggcgugagcugggucaugaagaucggcaucggggugcuccugacguggaucggccugaacuccaagaacaccagcauguccuucagcugcaucgccaucgggaucaucacccucuaccugggcgccgugguccaggcggacaccgggugcgugaucaacuggaagggcaaggagcugaagugcggcuccgggaucuucgugacgaacgagguccacaccuggaccgagcaguacaaguuccaggccgacagccccaagcgccucgccaccgccaucgccggcgcgugggagaacggggugugcggcauccgcuccacgacccggauggagaaccugcuguggaagcaggucgccaacgagcucaacuacauccugugggagaacaacaucaagcugaccgucguggugggggacaucaucggcguccucgagcagggcaagcgcacccugacgccccagccgauggagcugaaguacagcuggaagaccugggggaaggccaagaucgugaccgccgagacccagaacuccagcuucaucaucgacggccccaacacgcccgagugccccuccgcgagccgggccuggaacgugugggaggucgaggacuacggguucggcguguucaccaccaacaucuggcucaagcugcgcgagguguacacccagcugugcgaccaccggcucaugagcgccgccgucaaggacgagcgcgccgugcacgcggacaugggcuacuggaucgagucccagaagaacgggagcuggaagcuggagaaggccucccugaucgaggugaagaccugcacguggcccaagagccacacccucugguccaacggcguccuggagagcgacaugaucauccccaagucccuggccgggcccaucagccagcacaacuaccggccgggcuaccacacccagaccgccgggcccuggcaccucggcaagcuggagcuggacuucaacuacugcgagggcacgaccguggugaucaccgagaacugcgggacccgcggccccucccuccggacgaccaccgucagcgggaagcugauccacgaguggugcugccgcuccugcacccugcccccgcuccgguacaugggcgaggacgggugcugguacggcauggagauccgccccaucagcgagaaggaggagaacauggugaagucccuggugagcgccggcuccgggaaggucgacaacuucacgaugggcgugcugugccucgcgauccuguucgaggaggugaugcgggggaaguucggcaagaagcacaugaucgccggggucuucuucaccuucgugcugcuccugagcggccagaucaccuggcgcgacauggcccacacccugaucaugaucggcuccaacgccagcgaccggauggggaugggcgugacguaccucgcccugaucgcgaccuucaagauccagcccuuccuggcccucggguucuuccugcgcaagcugaccagccgggagaaccuccugcugggcgucggccucgccauggccaccacgcugcagcugcccgaggacaucgagcagauggcgaacgggaucgcccucggccugauggcccugaagcucaucacccaguucgagaccuaccagcuguggaccgcccugaucucccucacgugcagcaacaccaucuucacccugaccguggccuggcgcacggcgacccugauccucgccggggucucccugcugccggugugccagagcuccagcaugcggaaguccgacuggcuccccaugaccguggccgccaugggcgugccgccccucccgcuguucaucuucagccucaaggacacccugaagcgccgcuccuggccccugaacgagggggugauggccgugggccucgucagcauccuggcguccagccugcuccggaacgacgugcccauggccggcccccugguggccgggggccugcucaucgccugcuacgucaucacggggaccuccgccgaccugaccguggagaaggcggccgacgugaccugggaggaggaggccgagcagacgggcgucagccacaaccugaugaucaccguggacgacgacgggaccaugcgcaucaaggacgacgagaccgagaacauccucaccgugcugcugaagacggcccuccugaucgucuccggcaucuucccguacagcauccccgccacccugcucguguggcacaccuggcagaagcagacccggcgcuccggcgugcugugggacguccccagcccgcccgagacgcagaaggcggagcuggaggaggggguguaccggaucaagcagcagggcaucuucgggaagacccaggugggcgucggggugcagaaggagggcguguuccacaccauguggcacgucacccgcggcgccgugcucacguacaacgggaagcggcuggagcccaacugggccuccgugaagaaggaccugaucagcuacggcgggggcuggcgccucagcgcccaguggcagaagggggaggagguccaggugaucgcgguggagcccggcaagaaccccaagaacuuccagaccaugcccggcaccuuccagaccacgaccggggagaucggcgccaucgcccuggacuucaagcccgggaccuccggcagccccaucaucaaccgggagggcaaggucguggggcuguacggcaacgggguggucaccaagaacggcggguacguguccggcaucgcccagacgaacgccgagccggacggccccacccccgagcuggaggaggagauguucaagaagcgcaaccucaccaucauggaccugcaccccgggagcggcaagacccggaaguaccugccggcgaucgugcgcgaggccaucaagcggcgccuccggacgcugauccuggcccccacccgcgucguggccgccgagauggaggaggcgcucaaggggcugcccauccgguaccagaccaccgccacgcgcuccgagcacaccggccgggagaucguggaccugaugugccacgccaccuucaccaugcgccuccugagccccguccgggugccgaacuacaaccugaucaucauggacgaggcccacuucacggaccccgccuccaucgcggcccgcggguacaucagcacccgcgugggcaugggcgaggccgccgcgaucuucaugaccgccacgccgcccgggacggccgacgccuucccgcaguccaacgcccccauccaggacgaggagcgggacauccccgagcgcagcuggaacuccggcaacgaguggaucaccgacuucgcggggaagaccgucugguucgugcccagcaucaaggccggcaacgacaucgccaacugccuccggaagaacgggaagaaggugauccagcugucccgcaagaccuucgacacggaguaccagaagaccaagcugaacgacugggacuucgucgugaccaccgacaucagcgagaugggcgccaacuucaaggccgaccgggugaucgacccgcgccggugccucaagcccgucauccugacggacggccccgagcgcgugauccuggcggggcccaugccggugaccgccgccuccgccgcccagcggcgcggccgggucgggcgcaacccccagaaggagaacgaccaguacaucuucaccggccagccccucaacaacgacgaggaccacgcgcacuggaccgaggccaagaugcugcuggacaacaucaacacccccgaggggaucaucccggcccucuucgagcccgagcgggagaaguccgccgcgaucgacggcgaguaccgccugaagggcgagucccggaagacguucguggagcugaugcgccgcggggaccuccccgucuggcuggcccacaagguggccagcgagggcaucaaguacaccgaccgcaaguggugcuucgacgggcagcggaacaaccagauccuggaggagaacauggacguggagaucuggaccaaggagggcgagaagaagaagcuccgcccccgcuggcuggacgcccggaccuacuccgacccgcuggcccucaaggaguucaaggacuucgcggccggccgcaagagcaucgcccuggaccuggucacggagaucgggcgggugcccagccaccucgcccaccgcacccggaacgcccuggacaaccuggugaugcuccacaccuccgagcacggcgggaaggcguaccgccacgccgucgaggagcugcccgagaccauggagacgcugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgcgagcgccaucgugcuggaguucuucaugaugguccuccugauccccgagcccgagaagcagcggacgccccaggacaaccagcuggccuacguggugaucgggauccucacgcuggccgccaucaucgcggccaacgagaugggccugcucgagaccaccaagcgcgaccugggcauguccaaggagccgggggucgugagccccaccuccuaccuggacguggaccuccaccccgccagcgccuggacgcuguacgcggucgccaccaccgugaucacccccaugcugcggcacacgaucgagaacuccaccgccaacgugagccucgccgccaucgcgaaccaggccgucgugcugaugggccuggacaagggguggccgaucuccaagauggaccucggcgugccccugcuggcccucgggugcuacagccaggucaacccccugacccugaccgccgccgugcuccugcugaucacgcacuacgcgaucaucggccccggccuccaggccaaggccacccgcgaggcccagaagcggaccgccgcggggaucaugaagaacccgaccguggacggcaucaugacgaucgaccuggaccccgucaucuacgacuccaaguucgagaagcagcugggccaggugaugcuccuggugcugugcgccguccagcuccugcugaugcgcaccagcugggcccucugcgaggcccugacccuggcgaccggccccaucacgacccucugggagggcucccccgggaaguucuggaacaccaccaucgccgugagcauggccaacaucuuccggggcuccuaccuggccggggccggccuggcguucagcaucaugaaguccguggggacgggcaagcgcggcaccgggucccagggcgagacccucggggagaaguggaagaagaagcugaaccagcugagccggaaggaguucgaccucuacaagaaguccggcaucaccgaggucgaccgcaccgaggccaaggaggggcugaagcggggcgagaucacgcaccacgccgugagccgcggcuccgccaagcugcagugguucguggagcggaacauggucaucccggaggggcgcgugaucgaccucggcugcgggcggggcggguggagcuacuacugcgccggccugaagaaggugaccgagguccgcggcuacaccaagggcgggcccgggcacgaggagcccgugcccauguccaccuacggcuggaacaucgugaagcugaugagcgggaaggacgucuucuaccucccgcccgagaagugcgacacgcugcugugcgacaucggcgaguccagccccucccccaccguggaggagagccgcaccauccgggugcugaagauggucgagccguggcucaagaacaaccaguucugcaucaaggugcugaaccccuacaugcccaccgugaucgagcaccuggagcgccuccagcggaagcacggcgggaugcugguccgcaacccccugucccggaacagcacgcacgagauguacuggaucuccaacggcaccgggaacaucguggcgagcgugaacauggucucccgccuccugcugaaccgguucaccaugacccaccgccggccgacgaucgagaaggacguggaccucggcgccggcacccgccacgugaacgccgagcccgagacccccaacauggacgucaucggggagcggaucaagcgcaucaaggaggagcacaacagcaccuggcacuacgacgacgagaacccguacaagacgugggccuaccacggcuccuacgaggugaaggccaccgggagcgcgagcuccaugaucaacggcgucgugaagcugcugaccaagcccugggacgugguccccauggugacccagauggccaugacggacaccacccccuucgggcagcagcggguguucaaggagaaggucgacacccgcacgccgcggagcaugcccggcacccgccgggugaugggcaucaccgccgaguggcucuggcgcacccuggggcggaacaagaagccccgccugugcacgcgcgaggaguucaccaagaaggugcggaccaacgccgcgaugggcgccgucuucaccgaggagaaccagugggacuccgccaaggccgccguggaggacgaggacuucuggaagcucguggaccgcgagcgggagcugcacaagcuggggaagugcggcagcugcgucuacaacaugauggggaagcgcgagaagaagcucggcgaguucggcaaggcgaaggggucccgggccaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgcggacgacacggccgggugggacacccggaucaccgaggacgaccugcacaacgaggagaagaucacccagcagauggacccggagcaccgccagcucgccaacgccaucuucaagcugacguaccagaacaagguggucaaggugcagcggcccacccccaccggcaccgugauggacaucaucagccgcaaggaccagcggggcuccgggcaggucggcaccuacgggcugaacacguucaccaacauggaggcccagcucauccgccagauggagggcgagggggugcugaccaaggcggaccuggagaacccccaccucagcgagaagaagaucacccaguggcuggagacgaagggcguggagcggcugaagcgcauggccaucuccggcgacgacugcgucgugaagccgaucgacgaccgguucgccaacgcccuccuggcccugaacgacauggggaaggugcgcaaggacaucccccaguggcagcccagcaagggcuggcacgacuggcagcagguccccuucugcucccaccacuuccacgagcucaucaugaaggacgggcggaagcugguggugccgugccgcccccaggacgagcugaucggccgggcgcgcaucagccagggggccggcuggucccuccgcgagaccgccugccugggcaaggccuacgcgcagauguggagccugauguacuuccaccggcgcgaccuccggcuggccuccaacgccaucugcagcgccguccccgugcacugggugcccaccagccgcaccacgugguccauccacgcccaccaccaguggaugaccaccgaggacaugcugaccgucuggaaccggguguggaucgaggacaacccguggauggaggacaagacgcccgugaccaccugggagaacguccccuaccucgggaagcgcgaggaccaguggugcggcagccugaucgggcugaccucccgggcgacgugggcccagaacauccccaccgccauccagcagguccgcagccucaucggcaacgaggaguuccuggacuacaugccguccaugaagcgguuccgcaaggaggaggagagcgagggggccaucugguga

SEQ ID NO: 10141 - RNA, 9873 nt, Artificial Sequence
  derived and/or modified CDS sequence (opt1) from DENV-3__EU687218__SS-prME
accagccugugccucaugaugauccugcccgccgcccuggcguuccaccucaccagccgggacggggagccccggaugaucguggggaagaacgagcggggcaagagccugcuguucaagacggccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagaaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaaguccgagcacaccggccgggagaucguggaccugaugugccacgccaccuucacgaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucguccccagcaucaaggcgggcaacgacaucgccaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggugaccgagaucgggcggguccccucccaccucgcccaccgcacccggaacgcccuggacaaccuggugaugcuccacaccagcgagcacggcgggaaggccuaccgccacgcgguggaggagcugcccgagacgauggagacccugcuccugcugggccucaugauccugcugaccgggggcgccaugcuguuccugaucagcggcaaggggaucggcaagaccuccaucgggcugaucugcgucaucgccagcuccggcaugcucuggauggccgagaucccgcugcaguggaucgccagcgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccaccaagcgcgaccugggcauguccaaggagccggggguggucagccccacguccuaccuggacguggaccuccaccccgccagcgccuggacccuguacgccguggcgaccaccgucaucacgcccaugcugcggcacaccaucgagaacuccaccgccaacgugagccucgccgccaucgccaaccaggcggugguccugaugggccuggacaagggguggccgaucuccaagauggaccucggcgugccccugcuggcccucgggugcuacagccaggugaacccccugacccugacggccgccguccuccugcugaucacccacuacgccaucaucggccccggccuccaggcgaaggccacccgcgaggcccagaagcggaccgccgccgggaucaugaagaacccgacgguggacggcaucaugaccaucgaccuggaccccgugaucuacgacuccaaguucgagaagcagcuggggcaggucaugcuccuggugcugugcgcggugcagcuccugcugaugcgcaccagcugggcccucugcgaggcccugacccuggccacgggccccaucaccacccucugggagggcucccccgggaaguucuggaacaccacgaucgcggucagcauggccaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggaguucgaccucuacaagaaguccggcaucaccgagguggaccgcacggaggcgaaggaggggcugaagcggggcgagaucacccaccacgccgucagccgcggcuccgccaagcugcagugguucguggagcggaacauggugaucccggaggggcgcgucaucgaccucggcugcgggcggggcggguggagcuacuacugcgccggccugaagaaggugaccgaggugcgcggcuacaccaagggcgggcccgggcacgaggagcccguccccauguccacguacggcuggaacaucgugaagcugaugagcgggaaggacguguucuaccucccgcccgagaagugcgacacccugcugugcgacaucggcgaguccagccccucccccaccgucgaggagagccggaccauccgcgugcugaagaugguggagccguggcucaagaacaaccaguucugcaucaagguccugaaccccuacaugcccacggugaucgagcaccuggagcgccuccagcggaagcacggcgggaugcuggugcgcaacccccugucccggaacagcacccacgagauguacuggaucuccaacggcaccgggaacaucgucgccagcgugaacauggugucccgccuccugcugaaccgguucaccaugacgcaccgccggccgaccaucgagaaggacgucgaccucggcgcgggcacccgccacgugaacgccgagcccgagacccccaacauggacgugaucggggagcggaucaagcgcaucaaggaggagcacaacagcacguggcacuacgacgacgagaacccguacaagaccugggccuaccacggcuccuacgaggucaaggccaccgggagcgccuccagcaugaucaacggcguggucaagcugcugaccaagcccugggacguggugcccauggucacgcagauggcgaugaccgacaccacccccuucgggcagcagcggguguucaaggagaagguggacacgcgcaccccgcggagcaugcccggcacccgccgggucaugggcaucaccgccgaguggcucuggcgcacgcuggggcggaacaagaagccccgccugugcacccgggaggaguucaccaagaaggugcgcaccaacgccgccaugggcgcgguguucacggaggagaaccagugggacuccgccaaggccgccgucgaggacgaggacuucuggaagcucguggaccgcgagcgggagcugcacaagcuggggaagugcggcagcugcguguacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcgucgagggggagggccugcacaagcucggcuacauccugcgcgacaucuccaagauccccgggggcgccauguacgccgacgacaccgcggggugggacacccggaucaccgaggacgaccugcacaacgaggagaagaucacgcagcagauggacccggagcaccgccagcucgccaacgccaucuucaagcugaccuaccagaacaagguggugaagguccagcggcccacccccaccggcaccgugauggacaucaucagccgcaaggaccagcggggcuccggccaggugggcacguacgggcugaacaccuucaccaacauggaggcccagcucauccgccagauggagggcgaggggguccugagcaaggccgaccuggagaacccccaccucccggagaagaagaucacccaguggcuggagacgaagggcguggagcggcugaagcgcauggcgaucuccggcgacgacugcguggucaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcuggucgugcccugccgcccccaggacgagcugaucggccgggcccgcaucagccagggggcgggcuggucccuccgggagaccgccugccugggcaaggccuacgcccagauguggagccugauguacuuccaccgccgcgaccuccggcuggcguccaacgccaucugcagcgccgugcccguccacugggugccgaccucccgcaccacguggagcauccacgcccaccaccaguggaugaccaccgaggacaugcugaccguguggaaccgggucuggaucgaggacaaccccuggauggaggacaagacgcccgugaccaccugggagaacgugcccuaccucgggaagcgcgaggaccaguggugcggcagccugaucgggcugaccucccgggccacgugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10142 - RNA, 9873 nt, Artificial Sequence
  derived and/or modified CDS sequence (opt1) from DENV-3__EU726772__SS-prME
accagccugugccucaugaugauccugcccgccgcccuggcguuccaccucaccagccgggacggggagccccggaugaucguggggaagaacgagcggggcaagagccugcuguucaagacggccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaaguccgagcacaccggccgggagaucguggaccugaugugccacgccaccuucacgaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucguccccagcaucaaggcgggcaacgacaucgccaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggugaccgagaucgggcggguccccucccaccucgcccaccgcacccggaacgcccuggacaaccuggugaugcuccacaccagcgagcacggcgggaaggccuaccgccacgcgguggaggagcugcccgagacgauggagacccugcuccugcugggccucaugauccugcugaccgggggcgccaugcuguuccugaucagcggcaaggggaucggcaagaccuccaucgggcugaucugcgucaucgccagcuccggcaugcucuggauggccgagaucccgcugcaguggaucgccagcgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccaccaagcgcgaccugggcauguccaaggagccggggguggucagccccacguccuaccuggacguggaccuccaccccgccagcgccuggacccuguacgccguggcgaccaccgucaucacgcccaugcugcggcacaccaucgagaacuccaccgccaacgugagccucgccgccaucgccaaccaggcggugguccugaugggccuggacaagggguggccgaucuccaagauggaccucggcgugccccugcuggcccucgggugcuacagccaggugaacccccugacccugacggccgccguccuccugcugaucacccacuacgccaucaucggccccggccuccaggcgaaggccacccgcgaggcccagaagcggaccgccgccgggaucaugaagaacccgacgguggacggcaucaugaccaucgaccuggaccccgugaucuacgacuccaaguucgagaagcagcuggggcaggucaugcuccuggugcugugcgcggugcagcuccugcugaugcgcaccagcugggcccucugcgaggcccugacccuggccacgggccccaucaccacccucugggagggcucccccgggaaguucuggaacaccacgaucgcggucagcauggccaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggaguucgaccucuacaagaaguccggcaucaccgagguggaccgcacggaggcgaaggaggggcugaagcggggcgagaucacccaccacgccgucagccgcggcuccgccaagcugcagugguucguggagcggaacauggugaucccggaggggcgcgucaucgaccucggcugcgggcggggcggguggagcuacuacugcgccggccugaagaaggugaccgaggugcgcggcuacaccaagggcgggcccgggcacgaggagcccguccccauguccacguacggcuggaacaucgugaagcugaugagcgggaaggacguguucuaccucccgcccgagaagugcgacacccugcugugcgacaucggcgaguccagccccucccccaccgucgaggagagccggaccauccgcgugcugaagaugguggagccguggcucaagaacaaccaguucugcaucaagguccugaaccccuacaugcccacggugaucgagcaccuggagcgccuccagcggaagcacggcgggaugcuggugcgcaacccccugucccggaacagcacccacgagauguacuggaucuccaacggcaccgggaacaucgucgccagcgugaacauggugucccgccuccugcugaaccgguucaccaugacgcaccgccggccgaccaucgagaaggacgucgaccucggcgcgggcacccgccacgugaacgccgagcccgagacccccaacauggacgugaucggggagcggaucaagcgcaucaaggaggagcacaacagcacguggcacuacgacgacgagaacccguacaagaccugggccuaccacggcuccuacgaggucaaggccaccgggagcgccuccagcaugaucaacggcguggucaagcugcugaccaagcccugggacguggugcccauggucacgcagauggcgaugaccgacaccacccccuucgggcagcagcggguguucaaggagaagguggacacgcgcaccccgcggagcaugcccggcacccgccgggucaugggcaucaccgccgaguggcucuggcgcacgcuggggcggaacaagaagccccgccugugcacccgggaggaguucaccaagaaggugcgcaccaacgccgccaugggcgcgguguucacggaggagaaccagugggacuccgccaaggccgccgucgaggacgaggacuucuggaagcucguggaccgcgagcgggagcugcacaagcuggggaagugcggcagcugcguguacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcgucgagggggagggccugcacaagcucggcuacauccugcgcgacaucuccaagauccccgggggcgccauguacgccgacgacaccgcggggugggacacccggaucaccgaggacgaccugcacaacgaggagaagaucacgcagcagauggacccggagcaccgccagcucgccaacgccaucuucaagcugaccuaccagaacaagguggugaagguccagcggcccacccccaccggcaccgugauggacaucaucagccgcaaggaccagcggggcuccggccaggugggcacguacgggcugaacaccuucaccaacauggaggcccagcucauccgccagauggagggcgaggggguccugagcaaggccgaccuggagaacccccaccucccggagaagaagaucacccaguggcuggagacgaagggcguggagcggcugaagcgcauggcgaucuccggcgacgacugcguggucaagcccaucgacgaccgguucgccaacgcccuccuggcccugaacgacauggggaagggccgcaaggacaucccccaguggcagcccagcaagggguggcacgacuggcagcaggucccguucugcucccaccacuuccacgagcucaucaugaaggacggccggaagcuggugguccccugccgcccccaggacgagcugaucgggcgggcccgcaucagccagggcgcgggcuggucccuccgggagaccgccugccuggggaaggccuacgcccagauguggagccugauguacuuccaccgccgcgaccuccggcuggcguccaacgccaucugcagcgccgugcccgugcacugggucccgaccucccgcaccacguggagcauccacgcccaccaccaguggaugaccaccgaggacaugcugaccguguggaaccggguguggaucgaggacaaccccuggauggaggacaagacgcccgucaccaccugggagaacgugcccuaccucggcaagcgcgaggaccaguggugcgggagccugaucggccugaccucccgggccacgugggcgcagaacaucccgaccgccauccagcagguccgcagccucaucgggaacgaggaguuccuggacuacaugcccuccaugaagcgguuccgcaaggaggaggagagcgagggcgccaucugguga

SEQ ID NO: 10143 - RNA, 9873 nt, Artificial Sequence
  derived and/or modified CDS sequence (opt1) from DENV-3__FJ182013__SS-prME
accagccugugccucaugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacgugggcaccucccucacccagaagguggucaucuucauccugcugaugcucgugacgcccagcaugaccaugcggugcgugggggucggcaaccgcgacuucguggagggccuguccggggccaccuggguggacgucgugcuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccguccugccggaggagcaggaccagaacuacgugugcaagcacaccuacguggaccggggguggggcaacgggugcggccucuucgggaagggcucccuggugaccugcgccaaguuccagugccuggagcccaucgagggcaagguggugcaguacgagaaccucaaguacaccgucaucaucacggugcacaccggggaccagcaccaggucggcaacgagacccagggggugaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggucaccuucaagaacgcccacgccaagaagcaggagguggugguccuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucgugcugaagaaggagguguccgagacccagcacgggaccauccucaucaaggucgaguacaagggcgaggacgugccgugcaagauccccuucagcaccgaggacgggcagggcaaggcgcacaacggccgccugaucacggccaaccccguggucaccaagaaggaggagcccgugaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgucggcggggugcucaacagccugggcaagauggugcaccagaucuucggguccgcguacacggcccuguucagcggcgucuccugggugaugaagaucggcaucggggugcuccugaccuggaucggccugaacagcaagaacaccuccaugagcuucuccugcaucgccaucgggaucaucacccucuaccugggcgccgucgugcaggccgacauggggugcgugaucaacuggaagggcaaggagcugaagugcggcagcgggaucuucgucacgaacgaggugcacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccgucguggugggggacaucaucggcguccucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgccucccgggcguggaacgugugggaggucgaggacuacggguucggcguguucaccaccaacaucuggcucaagcugcgcgagguguacacccagcugugcgaccaccggcucaugagcgccgccgucaaggacgagcgcgccgugcacgccgacaugggcuacuggaucgagagccagaagaacggguccuggaagcuggagaaggcgagccugaucgaggugaagaccugcacguggccgaagucccacacccucuggagcaacggcguccuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaaggucgacaacuucacgaugggcgugcugugccucgccauccuguucgaggaggugaugcgggggaaguucggcaagaagcacaugaucgcgggggucuucuucaccuucgugcugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgucggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccguggccuggcgcacggccacccugauccucgcgggggucagccugcugccggugugccaguccagcuccaugcggaagaccgacuggcuccccauggccguggccgccaugggcgugccgccccucccgcuguucaucuucagccucaaggacacccugaagcgccgcuccuggccccugaacgagggggugauggccgugggccucgucagcauccuggcguccagccugcuccggaacgacgugcccauggccggcccccugguggccgggggccugcucaucgccugcuacgucaucacggggaccuccgccgaccugaccguggagaaggcggccgacgugaccugggaggaggaggccgagcagacgggcgucagccacaaccugaugaucaccguggacgacgacgggaccaugcgcaucaaggacgacgagaccgagaacauccucaccgugcugcugaagacggcccuccugaucgucuccggcaucuucccguacagcauccccgccacccugcucguguggcacaccuggcagaagcagacccagcgguccggcgugcugugggacguccccagcccgcccgagacgcagaaggcggagcuggaggaggggguguaccgcaucaagcagcagggcaucuucgggaagacccaggugggcgucggggugcagaaggagggcguguuccacaccauguggcacgucacccggggcgccgugcucacguacaacgggaagcgccuggagcccaacugggccuccgugaagaaggaccugaucagcuacggcgggggcuggcggcucuccgcccaguggcagaagggggaggagguccaggugaucgcgguggagcccggcaagaaccccaagaacuuccagaccaugcccggcaccuuccagaccacgaccggggagaucggcgccaucgcccuggacuucaagcccgggaccagcggcagccccaucaucaaccgcgagggcaaggucguggggcuguacggcaacgggguggucaccaagaacggcggguacguguccggcaucgcccagacgaacgccgagccggacggccccacccccgagcuggaggaggagauguucaagaagcggaaccucaccaucauggaccugcaccccgggagcggcaagacccgcaaguaccugccggcgaucgugcgggaggccaucaagcgccggcuccgcacgcugauccuggcccccacccgggucguggccgccgagauggaggaggcgcucaaggggcugcccauccgcuaccagaccaccgccacgaaguccgagcacaccggccgggagaucguggaccugaugugccacgccaccuucaccaugcgccuccugagccccguccgggugccgaacuacaaccugaucaucauggacgaggcccacuucacggaccccgccuccaucgcggcccgcggguacaucagcacccgggugggcaugggcgaggccgccgcgaucuucaugaccgccacgccgcccgggacggccgacgccuucccgcaguccaacgcccccauccaggacgaggagcgcgacauccccgagcgcagcuggaacuccggcaacgaguggaucaccgacuucgcggggaagaccgucugguucgugcccagcaucaaggccggcaacgacaucgccaacugccuccggaagaacgggaagaaggugauccagcugucccgcaagaccuucgacacggaguaccagaagaccaagcugaacgacugggacuucgucgugaccaccgacaucagcgagaugggcgccaacuucaaggccgaccgggugaucgacccgcgccggugccucaagcccgucauccugacggacggccccgagcgcgugauccuggcggggcccaugccggugaccgccgccuccgccgcccagcggcgcggccgggucgggcgcaacccccagaaggagaacgaccaguacaucuucaccggccagccccucaacaacgacgaggaccacgcgcacuggaccgaggccaagaugcugcuggacaacaucaacacccccgaggggaucaucccggcccucuucgagcccgagcgggagaaguccgccgcgaucgacggcgaguaccgccugaagggcgagucccggaagacguucguggagcugaugcgccgcggggaccuccccgucuggcuggcccacaagguggccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcaccuacuccgacccgcuggcccucaaggaguucaaggacuucgcggccggccgcaagagcaucgcccuggaccuggucacggagaucgggcgggugcccucccaccucgcccaccgcacccggaacgcccuggacaaccuggugaugcuccacaccagcgagcacggcgggaaggcguaccgccacgccgucgaggagcugcccgagaccauggagacgcugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgcgagcgccaucgugcuggaguucuucaugaugguccuccugauccccgagcccgagaagcagcggacgccccaggacaaccagcuggccuacguggugaucgggauccucacgcuggccgccaucaucgcggccaacgagaugggccugcucgagaccaccaagcgcgaccugggcauguccaaggagccgggggucgugagccccaccuccuaccuggacguggaccuccaccccgccagcgccuggacgcuguacgcggucgccaccaccgugaucacccccaugcugcggcacacgaucgagaacuccaccgccaacgugagccucgccgccaucgcgaaccaggccgucgugcugaugggccuggacaagggguggccgaucuccaagauggaccucggcgugccccugcuggcccucgggugcuacagccaggucaacccccugacccugaccgccgccgugcuccugcugaucacgcacuacgcgaucaucggccccggccuccaggccaaggccacccgcgaggcccagaagcggaccgccgcggggaucaugaagaacccgaccguggacggcaucaugacgaucgaccuggaccccgucaucuacgacuccaaguucgagaagcagcugggccaggugaugcuccuggugcugugcgccguccagcuccugcugaugcgcaccagcugggcccucugcgaggcccugacccuggcgaccggccccaucacgacccucugggagggcucccccgggaaguucuggaacaccaccaucgccgugagcauggccaacaucuuccggggcuccuaccuggccggggccggccuggcguucagcaucaugaaguccguggggacgggcaagcgcggcaccgggagccagggcgagacccucggggagaaguggaagaagaagcugaaccagcugagccggaaggaguucgaccucuacaagaaguccggcaucaccgaggucgaccgcaccgaggccaaggaggggcugaagcggggcgagaucacgcaccacgccgugagccgcggcuccgccaagcugcagugguucguggagcggaacauggucaucccggaggggcgcgugaucgaccucggcugcgggcggggcggguggagcuacuacugcgccggccugaagaaggugaccgagguccgcggcuacaccaagggcgggcccgggcacgaggagcccgugcccauguccaccuacggcuggaacaucgugaagcugaugagcgggaaggacgucuucuaccucccgcccgagaagugcgacacgcugcugugcgacaucggcgaguccagccccucccccaccguggaggagagccggaccauccgcgugcugaagauggucgagccguggcucaagaacaaccaguucugcaucaaggugcugaaccccuacaugcccaccgugaucgagcaccuggagcgccuccagcggaagcacggcgggaugcugguccgcaacccccugucccggaacagcacgcacgagauguacuggaucuccaacggcaccgggaacaucguggcgagcgugaacauggucucccgccuccugcugaaccgguucaccaugacccaccgccggccgacgaucgagaaggacguggaccucggcgccggcacccgccacgugaacgccgagcccgagacccccaacauggacgucaucggggagcggaucaagcgcaucaaggaggagcacaacagcaccuggcacuacgacgacgagaacccguacaagacgugggccuaccacggcuccuacgaggugaaggccaccgggagcgcguccagcaugaucaacggcgucgugaagcugcugaccaagcccugggacgugguccccauggugacccagauggccaugacggacaccacccccuucgggcagcagcggguguucaaggagaaggucgacacccgcacgccgcggagcaugcccggcacccgccgggugaugggcaucaccgccgaguggcucuggcgcacccuggggcggaacaagaagccccgccugugcacgcgggaggaguucaccaagaaggugcgcaccaacgccgcgaugggcgccgucuucaccgaggagaaccagugggacuccgccaaggccgccguggaggacgaggacuucuggaagcucguggaccgcgagcgggagcugcacaagcuggggaagugcggcagcugcgucuacaacaugauggggaagcgcgagaagaagcucggcgaguucggcaaggcgaaggggucccgggccaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgcggacgacacggccgggugggacacccggaucaccgaggacgaccugcacaacgaggagaagaucacccagcagauggacccggagcaccgccagcucgccaacgccaucuucaagcugacguaccagaacaagguggucaaggugcagcggcccacccccaccggcaccgugauggacaucaucagccgcaaggaccagcggggcuccgggcaggucggcaccuacgggcugaacacguucaccaacauggaggcccagcucauccgccagauggagggcgagggggugcugagcaaggcggaccuggagaacccccaccucccggagaagaagaucacccaguggcuggagaccaagggcguggagcggcugaagcgcauggccaucuccggcgacgacugcgucgugaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcugguggugcccugccgcccccaggacgagcugaucggccgggcgcgcaucagccagggggccggcuggucccuccgggagacggccugccugggcaaggccuacgcgcagauguggagccugauguacuuccaccgccgcgaccuccggcuggccuccaacgccaucugcagcgccguccccgugcacugggugccgaccucccgcaccaccuggagcauccacgcccaccaccaguggaugacgaccgaggacaugcugaccgucuggaaccggguguggaucgaggacaaccccuggauggaggacaagacccccgugacgaccugggagaacguccccuaccucgggaagcgcgaggaccaguggugcggcagccugaucgggcugaccucccgggcgaccugggcccagaacaucccgacggccauccagcagguccgcagccucaucggcaacgaggaguuccuggacuacaugcccuccaugaagcgguuccgcaaggaggaggagagcgagggggccaucugguga

SEQ ID NO: 10144 - RNA, 9873 nt, Artificial Sequence
  derived and/or modified CDS sequence (opt1) from DENV-3__EU781136__SS-prME
accagccugugccucaugaugauccugcccgccgcccuggcguuccaccucaccagccgggacggggagccccggaugaucguggggaagaacgagcgcggcaagagccugcuguucaagacggccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcguggugaacuggaagggcaaggagcugaagugcggcagcgggaucuucgucacgaacgaggugcacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccgucguggugggggacaucaucggcguccucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgccucccgggcguggaacgugugggaggucgaggacuacggguucggcguguucaccaccaacaucuggcucaagcugcgcgagguguacacccagcugugcgaccaccggcucaugagcgccgccgucaaggacgagcgcgccgugcacgccgacaugggcuacuggaucgagagccagaagaacggguccuggaagcuggagaaggcgagccugaucgaggugaagaccugcacguggccgaagucccacacccucuggagcaacggcguccuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaaggucgacaacuucacgaugggcgugcugugccucgccauccuguucgaggaggugaugcgggggaaguucggcaagaagcacaugaucgcgggggucuucuucaccuucgugcugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgucggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccguggccuggcgcacggccacccugauccucgcgggggucagccugcugccggugugccaguccagcuccaugcggaagaccgacuggcuccccaugaccguggccgccaugggcgugccgccccucccgcuguucaucuucagccucaaggacacgcugaagcgccgcuccuggccccugaacgagggggugauggccgugggccucgucagcauccuggccuccagccugcuccggaacgacgugcccauggcgggcccccugguggccgggggccugcucaucgccugcuacgucaucaccgggaccuccgccgaccugaccguggagaaggccgcggacgugacgugggaggaggaggccgagcagaccggcgucagccacaaccugaugaucaccguggacgacgacgggaccaugcgcaucaaggacgacgagaccgagaacauccucacggugcugcugaagaccgcccuccugaucgucuccggcaucuucccguacagcauccccgccacccugcucguguggcacaccuggcagaagcagacgcagcgguccggcgugcugugggacguccccagcccgcccgagacccagaaggccgagcuggaggaggggguguaccgcaucaagcagcagggcaucuucgggaagacccaggugggcgucggggugcagaaggagggcguguuccacaccauguggcacgucacgcggggcgcggugcucaccuacaacgggaagcgccuggagcccaacugggccuccgugaagaaggaccugaucagcuacggcgggggcuggcggcucuccgcccaguggcagaagggggaggagguccaggugaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaaggucguggggcuguacggcaacgggguggucacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccgggucguggccgccgagauggaggaggcccucaaggggcugcccauccgcuaccagaccacggcgaccaaguccgagcacaccggccgggagaucguggaccugaugugccacgccaccuucacgaugcgccuccugagccccguccgggugccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgucugguucgugcccagcaucaaggcgggcaacgacaucgccaacugccuccggaagaacgggaagaaggugauccagcugucccgcaagacguucgacaccgaguaccagaagaccaagcugaacgacugggacuucgucgugaccacggacaucagcgagaugggcgccaacuucaaggccgaccgggugaucgacccgcgccggugccucaagcccgucauccugaccgacggccccgagcgcgugauccuggccgggcccaugccggugaccgcggccuccgccgcccagcggcgcggccgggucgggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcgcacaagguggccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggucaccgagaucgggcgggugcccucccaccucgcccaccgcacccggaacgcccuggacaaccuggugaugcuccacaccagcgagcacggcgggaaggccuaccgccacgcggucgaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucgugcuggaguucuucaugaugguccuccugauccccgagcccgagaagcagcggacgccccaggacaaccagcuggccuacguggugaucgggauccucacccuggccgccaucaucgccgcgaacgagaugggccugcucgagaccaccaagcgcgaccugggcauguccaaggagccgggggucgugagccccacguccuaccuggacguggaccuccaccccgccagcgccuggacccuguacgccgucgcgaccaccgugaucacgcccaugcugcggcacaccaucgagaacuccaccgccaacgugagccucgccgccaucgccaaccaggcggucgugcugaugggccuggacaagggguggccgaucuccaagauggaccucggcgugccccugcuggcccucgggugcuacagccaggucaacccccugacccugacggccgccgugcuccugcugaucacccacuacgccaucaucggccccggccuccaggcgaaggccacccgcgaggcccagaagcggaccgccgccgggaucaugaagaacccgacgguggacggcaucaugaccaucgaccuggaccccgucaucuacgacuccaaguucgagaagcagcugggccaggugaugcuccuggugcugugcgcgguccagcuccugcugaugcgcaccagcugggcccucugcgaggcccugacccuggccacgggccccaucaccacccucugggagggcucccccgggaaguucuggaacaccacgaucgcggugagcauggccaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggaguucgaccucuacaagaaguccggcaucaccgaggucgaccgcacggaggcgaaggaggggcugaagcggggcgagaucacccaccacgccgugagccgcggcuccgccaagcugcagugguucguggagcggaacauggucaucccggaggggcgcgugaucgaccucggcugcgggcggggcggguggagcuacuacugcgccggccugaagaaggugaccgagguccgcggcuacaccaagggcgggcccgggcacgaggagcccgugcccauguccacguacggcuggaacaucgugaagcugaugagcgggaaggacgucuucuaccucccgcccgagaagugcgacacccugcugugcgacaucggcgaguccagccccucccccaccguggaggagagccggaccauccgcgugcugaagauggucgagccguggcucaagaacaaccaguucugcaucaaggugcugaaccccuacaugcccacggugaucgagcaccuggagcgccuccagcggaagcacggcgggaugcugguccgcaacccccugucccggaacagcacccacgagauguacuggaucuccaacggcaccgggaacaucguggccagcgugaacauggucucccgccuccugcugaaccgguucaccaugacgcaccgccggccgaccaucgagaaggacguggaccucggcgcgggcacccgccacgugaacgccgagcccgagacccccaacauggacgucaucggggagcggaucaagcgcaucaaggaggagcacaacagcacguggcacuacgacgacgagaacccguacaagaccugggccuaccacggcuccuacgaggugaaggccaccgggagcgccuccagcaugaucaacggcgucgugaagcugcugaccaagcccugggacgugguccccauggugacgcagauggcgaugaccgacaccacccccuucgggcagcagcggguguucaaggagaaggucgacacgcgcaccccgcggagcaugcccggcacccgccgggugaugggcaucaccgccgaguggcucuggcgcacgcuggggcggaacaagaagccccgccugugcacccgggaggaguucaccaagaaggugcgcaccaacgccgccaugggcgcggucuucacggaggagaaccagugggacuccgccaaggccgccguggaggacgaggacuucuggaagcucguggaccgcgagcgggagcugcacaagcuggggaagugcggcagcugcgucuacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgccgacgacaccgcggggugggacacccggaucaccgaggacgaccugcacaacgaggagaagaucacgcagcagauggacccggagcaccgccagcucgccaacgccaucuucaagcugaccuaccagaacaagguggucaaggugcagcggcccacccccaccggcaccgugauggacaucaucagccgcaaggaccagcggggcuccgggcaggucggcacguacgggcugaacaccuucaccaacauggaggcccagcucauccgccagauggagggcgagggggugcugagcaaggccgaccuggagaacccccaccucccggagaagaagaucacccaguggcuggagacgaagggcguggagcggcugaagcgcauggcgaucuccggcgacgacugcgucgugaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcugguggugcccugccgcccccaggacgagcugaucggccgggcccgcaucagccagggggcgggcuggucccuccgggagaccgccugccugggcaaggccuacgcccagauguggagccugauguacuuccaccgccgcgaccuccggcuggcguccaacgccaucugcagcgccguccccgugcacugggugccgaccucccgcaccacguggagcauccacgcccaccaccaguggaugaccaccgaggacaugcugaccgucuggaaccggguguggaucgaggacaaccccuggauggaggacaagacgcccgugaccaccugggagaacguccccuaccucgggaagcgcgaggaccaguggugcggcagccugaucgggcugaccucccgggccacgugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10145 - RNA, 9873 nt, Artificial Sequence
  derived and/or modified CDS sequence (opt1) from DENV-3__EU781137__SS-prME
accagccucugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaaggucgagaccugggcccugcgccacccgggguucaccauccucgcgcuguuccuggcccacuacaucggcaccucccucacccagaagguggugaucuucacgcugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggcgacccuccggaagcugugcaucgagggcaagaucaccaacaucaccacggacagccgcugccccacccagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacacggugaucaucaccguccacaccggggaccagcaccaggugggcaacgagacccagggggucacggccgagaucacgccccaggccagcaccaccgaggcgauccugcccgaguacggcacccuggggcucgagugcuccccgcgcacgggccuggacuucaacgagaugauccugcucaccaugaagaacaaggccuggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgucccgugcaagauccccuucagcacggaggacgggcagggcaaggcgcacaacggccgccugaucaccgccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacacggccugggacuucggguccgugggcgggguccucaacagccugggcaagauggugcaccagaucuucggguccgcguacaccgcccuguucagcggcguguccugggucaugaagaucggcaucggggugcuccugaccuggaucggccugaacagcaagaacaccuccaugagcuucuccugcaucgccaucgggaucaucacgcucuaccugggcgccgugguccaggccgacauggggugcgugaucaacuggaagggcaaggagcugaagugcggcagcgggaucuucgugaccaacgagguccacaccuggaccgagcaguacaaguuccaggcggacucccccaagcgccucgccacggccaucgccggcgccugggagaacggggugugcggcauccgcagcaccacccggauggagaaccugcuguggaagcagaucgcgaacgagcucaacuacauccugugggagaacaacaucaagcugaccguggucgugggggacaucaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagacgugcaccuggccgaagucccacacccucuggagcaacggcgugcuggaguccgacaugaucauccccaagagccuggccgggcccaucucccagcacaacuaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgcggggguguucuucaccuucguccugcuccuguccggccagaucaccuggcgcgacauggcccacacgcugaucaugaucggcagcaacgccuccgaccggauggggaugggcgugaccuaccucgcccugaucgccaccuucaagauccagcccuuccuggcgcucggguucuuccugcgcaagcugaccagccgggagaaccuccugcugggcgugggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccaucuucacccugacggucgccuggcgcaccgccacccugauccucgcgggggugagccugcugccggucugccaguccagcuccaugcggaagaccgacuggcuccccaugacgguggccgccaugggcgugccgccccucccgcuguucaucuucagccucaaggacacccugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugacggucgagaaggccgcggacgugaccugggaggaggaggccgagcagaccggcgugagccacaaccugaugaucaccgucgacgacgacgggaccaugcgcaucaaggacgacgagacggagaacauccucaccgugcugcugaagaccgcccuccugaucguguccggcaucuucccguacagcauccccgccacccugcucgucuggcacacguggcagaagcagacccagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacacgauguggcacgugacccggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcacguuccagaccaccaccggggagaucggcgcgaucgcccuggacuucaagcccgggacgagcggcagccccaucaucaaccgcgagggcaagguggucgggcuguacggcaacgggguggugaccaagaacggcggguacgucuccggcaucgcccagaccaacgccgagccggacggccccacccccgagcuggaggaggagauguucaagaagcggaaccucacgaucauggaccugcaccccgggagcggcaagacccgcaaguaccugccggccaucgugcgggaggcgaucaagcgccggcuccgcacccugauccuggcccccacccggguggucgccgccgagauggaggaggcccucaaggggcugcccauccgcuaccagacgaccgcgaccaaguccgagcacaccggccgggagaucguggaccugaugugccacgccacguucaccaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugacggcgacgccgcccgggaccgccgacgccuucccgcaguccaacgcccccauccaggacgaggagcgcgacauccccgagcgcagcuggaacuccggcaacgaguggaucaccgacuucgccgggaagacggugugguucguccccagcaucaaggcgggcaacgacaucgccaacugccuccggaagaacgggaagaaggugauccagcugucccgcaagaccuucgacaccgaguaccagaagaccaagcugaacgacugggacuucguggucacgaccgacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggacggaggcgaagaugcugcuggacaacaucaacacccccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggacgaaggagggcgagaagaagaagcuccgcccccgguggcuggacgcccgcaccuacuccgacccgcuggcccucaaggaguucaaggacuucgccgcgggccgcaagagcaucgcccuggaccuggugaccgagaucgggcggguccccucccaccucgcccaccgcacccggaacgcccuggacaaccuggugaugcuccacacgagcgagcacggcgggaaggccuaccgccacgcgguggaggagcugcccgagaccauggagacccugcuccugcugggccucaugauccugcugaccgggggcgccaugcuguuccugaucagcggcaaggggaucggcaagacguccaucgggcugaucugcgucaucgccagcuccggcaugcucuggauggccgagaucccgcugcaguggaucgccagcgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccacgaagcgcgaccugggcauguccaaggagccggggguggucagccccaccuccuaccuggacguggaccuccaccccgccagcgccuggacccuguacgccguggcgaccacggucaucacccccaugcugcggcacaccaucgagaacuccaccgccaacgugagccucgccgccaucgccaaccaggcggugguccugaugggccuggacaagggguggccgaucuccaagauggaccucggcgugccccugcuggcccucgggugcuacagccaggugaacccccugacgcugaccgccgccguccuccugcugaucacccacuacgccaucaucggccccggccuccaggcgaaggccacccgcgaggcccagaagcggacggccgccgggaucaugaagaacccgaccguggacggcaucaugaccaucgaccuggaccccgugaucuacgacuccaaguucgagaagcagcuggggcaggucaugcuccuggugcugugcgcggugcagcuccugcugaugcgcaccagcugggcccucugcgaggcccugacgcuggccaccggccccaucaccacccucugggagggcucccccgggaaguucuggaacacgaccaucgcggucagcauggccaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggaguucgaccucuacaagaaguccggcaucacggagguggaccgcaccgaggcgaaggaggggcugaagcggggcgagaucacccaccacgccgucagccgcggcuccgccaagcugcagugguucguggagcggaacauggugaucccggaggggcgcgucaucgaccucggcugcgggcggggcggguggagcuacuacugcgccggccugaagaaggugaccgaggugcgcggcuacacgaagggcgggcccgggcacgaggagcccguccccauguccaccuacggcuggaacaucgugaagcugaugagcgggaaggacguguucuaccucccgcccgagaagugcgacacccugcugugcgacaucggcgaguccagccccucccccaccgucgaggagagccggacgauccgcgugcugaagaugguggagccguggcucaagaacaaccaguucugcaucaagguccugaaccccuacaugcccaccgugaucgagcaccuggagcgccuccagcggaagcacggcgggaugcuggugcgcaacccccugucccggaacagcacccacgagauguacuggaucuccaacggcaccgggaacaucgucgccagcgugaacauggugucccgccuccugcugaaccgguucacgaugacccaccgccggccgaccaucgagaaggacgucgaccucggcgcgggcacccgccacgugaacgccgagcccgagacgcccaacauggacgugaucggggagcggaucaagcgcaucaaggaggagcacaacagcaccuggcacuacgacgacgagaacccguacaagaccugggccuaccacggcuccuacgaggucaaggccaccgggagcgccuccagcaugaucaacggcguggucaagcugcugacgaagcccugggacguggugcccauggucacccagauggcgaugaccgacaccacgcccuucgggcagcagcggguguucaaggagaagguggacacccgcaccccgcggagcaugcccggcacccgccgggucaugggcaucacggccgaguggcucuggcgcacccuggggcggaacaagaagccccgccugugcacccgggaggaguucaccaagaaggugcgcacgaacgccgccaugggcgcgguguucaccgaggagaaccagugggacuccgccaaggccgccgucgaggacgaggacuucuggaagcucguggaccgcgagcgggagcugcacaagcuggggaagugcggcagcugcguguacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcgucgagggggagggccugcacaagcucggcuacauccugcgcgacaucuccaagauccccgggggcgccauguacgccgacgacaccgcggggugggacacccggaucacggaggacgaccugcacaacgaggagaagaucacccagcagauggacccggagcaccgccagcucgccaacgccaucuucaagcugaccuaccagaacaagguggugaagguccagcggcccacccccaccggcacggugauggacaucaucagccgcaaggaccagcggggcuccggccaggugggcaccuacgggcugaacaccuucaccaacauggaggcccagcucauccgccagauggagggcgaggggguccugagcaaggccgaccuggagaacccccaccucccggagaagaagaucacgcaguggcuggagaccaagggcguggagcggcugaagcgcauggcgaucuccggcgacgacugcguggucaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucgucaugaaggacgggcggaagcugguggugcccugccgcccccaggacgagcugaucggccgggcccgcaucagccagggggcgggcuggucccuccgggagaccgccugccugggcaaggccuacgcccagauguggagccugauguacuuccaccgccgcgaccuccggcuggcguccaacgccaucugcagcgccguccccgugcacugggugccgaccucccgcacgaccuggagcauccacgcccaccaccaguggaugaccaccgaggacaugcugacggucuggaaccggguguggaucgaggacaaccccuggauggaggacaagacccccgugaccaccugggagaacguccccuaccucgggaagcgcgaggaccaguggugcggcagccugaucgggcugacgucccgggccaccugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10146 - RNA, 9873 nt, Artificial Sequence
  derived and/or modified CDS sequence (opt1) from DENV-3__EU726773__SS-prME
accagccugugccucaugaugauccugcccgcggcgcuggcguuccaccucaccagccgcgacggcgagccccggaugaucguggggaagaacgagcgcggcaagagccugcuguucaagacggccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgugaucgggaucaucacccucuaccugggcgccgucgugcaggccgacauggggugcgugaucaacuggaagggcaaggagcugaagugcggcagcgggaucuucgucacgaacgaggugcacaccuggaccgagcaguacaaguuccaggccgacucccccaagcgccucgcgaccgccaucgccggcgccugggagaacggggugugcggcauccgcagcacgacccggauggagaaccugcuguggaagcagaucgccaacgagcucaacuacauccugugggagaacaacaucaagcugaccgucguggugggggacaucaucggcguccucgagcagggcaagcgcacccugacgccccagccgauggagcugaaguacuccuggaagaccugggggaaggcgaagaucgugaccgccgagacccagaacagcuccuucaucaucgacggccccaacacgcccgagugccccagcgccucccgggccuggaacgugugggaggucgaggacuacggguucggcguguucaccaccaacaucuggcucaagcugcgcgagguguacacccagcugugcgaccaccggcucaugagcgcggccgucaaggacgagcgcgccgugcacgccgacaugggcuacuggaucgagagccagaagaacggguccuggaagcuggagaaggccagccugaucgaggugaagaccugcacguggccgaagucccacacccucuggagcaacggcguccuggaguccgacaugaucauccccaagagccuggcggggcccaucucccagcacaacuaccggccgggcuaccacacccagaccgccgggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaaggucgacaacuucacgaugggcgugcugugccucgccauccuguucgaggaggugaugcgggggaaguucggcaagaagcacaugaucgccggggucuucuucaccuucgugcugcuccuguccggccagaucaccuggcgcgacauggcgcacacccugaucaugaucggcagcaacgccuccgaccggauggggaugggcgugacguaccucgcccugaucgccaccuucaagauccagcccuuccuggcccucggguucuuccugcgcaagcugaccagccgggagaaccuccugcugggcgucggccucgcgauggccaccacgcugcagcugcccgaggacaucgagcagauggccaacgggaucgcccucggccugauggcgcugaagcucaucacccaguucgagaccuaccagcuguggaccgcccugaucagccucacgugcuccaacaccaucuucacccugaccguggccuggcgcacggccacccugauccucgccggggucagccugcugccggugugccaguccagcuccaugcggaagaccgacuggcuccccaugaccguggcggccaugggcgugccgccccucccgcuguucaucuucagccucaaggacacgcugaagcgccgcuccuggccccugaacgagggggugauggccgugggccucgucagcauccuggccuccagccugcuccggaacgacgugcccauggccggcccccugguggccggcgggcugcucaucgccugcuacgucaucaccgggaccuccgccgaccugaccguggagaaggccgccgacgugacgugggaggaggaggcggagcagaccggggucagccacaaccugaugaucaccguggacgacgacgggaccaugcgcaucaaggacgacgagaccgagaacauccucacggugcugcugaagaccgcccuccugaucgucuccggcaucuucccguacagcauccccgccacccugcucguguggcacaccuggcagaagcagacgcagcgguccggcgugcugugggacguccccagcccgcccgagacccagaaggccgagcuggaggaggggguguaccgcaucaagcagcagggcaucuucgggaagacccaggugggcgucggggugcagaaggagggcguguuccacaccauguggcacgucacgcggggcgccgugcucaccuacaacgggaagcgccuggagcccaacugggcguccgugaagaaggaccugaucagcuacggcgggggcuggcggcucuccgcccaguggcagaagggggaggagguccaggugaucgccguggagcccggcaagaaccccaagaacuuccagaccaugcccggcaccuuccagacgaccaccggggagaucggcgccaucgcgcuggacuucaagcccgggaccagcggcagccccaucaucaaccgcgagggcaaggucguggggcuguacggcaacgggguggucacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggccaucaagcgccggcuccgcacccugauccuggcgcccacccgggucguggccgccgagauggaggaggcccucaaggggcugcccauccgcuaccagaccacggccaccaaguccgagcacaccggccgggagaucguggaccugaugugccacgcgaccuucacgaugcgccuccugagccccguccgggugccgaacuacaaccugaucaucauggacgaggcccacuucaccgaccccgccuccaucgccgcccgcggguacaucagcacccgggugggcaugggcgaggcggccgccaucuucaugaccgccacgccgcccgggaccgcggacgccuucccgcaguccaacgcccccauccaggacgaggagaaggacauccccgagcgcagcuggaacuccggcaacgaguggaucaccgacuucgccgggaagaccgucugguucgugcccagcaucaaggccggcaacgacaucgcgaacugccuccgcaagaacgggaagaaggugauccagcugucccggaagacguucgacaccgaguaccagaagaccaagcugaacgacugggacuucgucgugaccacggacaucagcgagaugggcgccaacuucaaggccgaccgcgugaucgacccgcggcgcugccucaagcccgucauccugaccgacggccccgagcgggugauccuggccgggcccaugccggugaccgccgcguccgccgcccagcgccggggccgcgucgggcggaacccccagaaggagaacgaccaguacaucuucaccggccagccccucaacaacgacgaggaccacgcccacuggaccgaggccaagaugcugcuggacaacaucaacacgcccgaggggaucaucccggcccucuucgagcccgagcgcgagaaguccgccgccaucgacggcgaguaccggcugaagggcgagucccgcaagaccuucguggagcugaugcggcgcggggaccuccccgucuggcuggcccacaagguggcgagcgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcccggacguacuccgacccgcuggcccucaaggaguucaaggacuucgccgccggccgcaagagcaucgcgcuggaccuggucaccgagaucgggcgcgugcccucccaccucgcccaccggacccgcaacgcccuggacaaccuggugaugcuccacaccagcgagcacggcgggaaggccuaccggcacgccgucgaggagcugcccgagacgauggagacccugcuccugcugggccucaugauccugcugaccgggggcgcgaugcuguuccugaucagcggcaaggggaucggcaagaccuccaucgggcugaucugcgugaucgccagcuccggcaugcucuggauggccgagaucccgcugcaguggaucgccagcgccaucgugcuggaguucuucaugaugguccuccugauccccgagcccgagaagcagcgcacgccccaggacaaccagcuggcguacguggugaucgggauccucacccuggccgccaucaucgccgccaacgagaugggccugcucgagaccaccaagcgggaccugggcauguccaaggagccgggggucgugagccccacguccuaccuggacguggaccuccaccccgcgagcgccuggacccuguacgccgucgccaccaccgugaucacgcccaugcugcgccacaccaucgagaacuccaccgcgaacgugagccucgccgccaucgccaaccaggccgucgugcugaugggccuggacaagggguggccgaucuccaagauggaccucggcgugccccugcuggcgcucgggugcuacagccaggucaacccccugacccugacggccgccgugcuccugcugaucacccacuacgccaucaucggccccggccuccaggccaaggcgacccgggaggcccagaagcgcaccgccgccgggaucaugaagaacccgacgguggacggcaucaugaccaucgaccuggaccccgucaucuacgacuccaaguucgagaagcagcugggccaggugaugcuccuggugcugugcgccguccagcuccugcugaugcggaccagcugggcgcucugcgaggcccugacccuggccacgggccccaucaccacccucugggagggcucccccgggaaguucuggaacaccacgaucgccgugagcauggcgaacaucuuccgcggcuccuaccuggccggggccggccuggccuucagcaucaugaaguccguggggaccggcaagcggggcaccgggagccagggcgagacccucggggagaaguggaagaagaagcugaaccagcugagccgcaaggaguucgaccucuacaagaaguccggcaucaccgaggucgaccggacggaggccaaggaggggcugaagcgcggcgagaucacccaccacgcggugagccggggcuccgccaagcugcagugguucguggagcgcaacauggucaucccggaggggcgggugaucgaccucggcugcgggcgcggcggguggagcuacuacugcgccggccugaagaaggugaccgagguccggggcuacaccaagggcgggcccgggcacgaggagcccgugcccauguccacguacggcuggaacaucgugaagcugaugagcgggaaggacgucuucuaccucccgcccgagaagugcgacacccugcugugcgacaucggcgaguccagccccucccccaccguggaggagagccgcaccauccgggugcugaagauggucgagccguggcucaagaacaaccaguucugcaucaaggugcugaaccccuacaugcccacggugaucgagcaccuggagcgccuccagcgcaagcacggcgggaugcugguccggaacccccugucccgcaacagcacccacgagauguacuggaucuccaacggcaccgggaacaucguggccagcgugaacauggucucccggcuccugcugaaccgcuucaccaugacgcaccggcgcccgaccaucgagaaggacguggaccucggcgccggcacccggcacgugaacgcggagcccgagacccccaacauggacgucaucggggagcgcaucaagcggaucaaggaggagcacaacagcacguggcacuacgacgacgagaacccguacaagaccugggccuaccacggcuccuacgaggugaaggccaccgggagcgccuccagcaugaucaacggcgucgugaagcugcugaccaagcccugggacgugguccccauggugacgcagauggccaugaccgacaccacccccuucgggcagcagcgcguguucaaggagaaggucgacacgcggaccccgcgcagcaugcccggcacccggcgcgugaugggcaucaccgcggaguggcucuggcggacgcuggggcgcaacaagaagccccggcugugcacccgcgaggaguucaccaagaaggugcggaccaacgccgccaugggcgccgucuucacggaggagaaccagugggacuccgcgaaggccgccguggaggacgaggacuucuggauccucguggaccgcgagcgcgagcugcacaagcuggggaagugcggcagcugcgucuacaacaugauggggaagcgggagaagaagcucggcgaguucggcaaggccaaggggucccgcgccaucugguacauguggcugggcgcgcgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgccgacgacaccgccgggugggacacccgcaucaccgaggacgaccugcacaacgaggagaagaucacgcagcagauggacccggagcaccggcagcucgcgaacgccaucuucaagcugaccuaccagaacaagguggucaaggugcagcgccccacccccaccggcaccgugauggacaucaucagccggaaggaccagcgcggcuccgggcaggucggcacguacgggcugaacaccuucaccaacauggaggcccagcucauccggcagauggagggcgagggggugcugagcaaggccgaccuggagaacccccaccucccggagaagaagaucacccaguggcuggagacgaagggcguggagcgccugaagcggauggccaucuccggcgacgacugcgucgugaagcccaucgacgaccgcuucgcgaacgcccuccuggcccugaacgacauggggaaggugcggaaggacaucccccaguggcagcccagcaagggcuggcacgacuggcagcaggucccguucugcucccaccacuuccacgagcucaucaugaaggacgggcgcaagcugguggugcccugccggccccaggacgagcugaucggccgcgcccggaucagccagggggccggcuggucccuccgcgagaccgcgugccugggcaaggccuacgcccagauguggagccugauguacuuccaccggcgcgaccuccgccuggccuccaacgcgaucugcagcgccguccccgugcacugggugccgaccucccggaccacguggagcauccacgcccaccaccaguggaugaccaccgaggacaugcugaccgucuggaaccgcguguggaucgaggacaaccccuggauggaggacaagacgcccgugaccaccugggagaacguccccuaccucgggaagcgggaggaccaguggugcggcagccugaucgggcugaccucccgcgccacgugggcccagaacaucccgaccgcgauccagcagguccggagccucaucggcaacgaggaguuccuggacuacaugcccuccaugaagcgcuuccggaaggaggaggagagcgagggggccaucugguga

SEQ ID NO: 10147 - RNA, 9873 nt, Artificial Sequence
  derived and/or modified CDS sequence (opt1) from DENV-3__EU726774__SS-prME
accagccucugccucaugaugauccugcccgccgcccuggcguuccaccucaccagccgggacggcgagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaccaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagacgugcaccuggccgaagucccacacccucuggagcaacggcgugcuggaguccgacaugaucauccccaagagccuggccgggcccaucucccagcacaacuaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgcggggguguucuucaccuucguccugcuccuguccggccagaucaccuggcgcgacauggcccacacgcugaucauggugggcagcaacgccuccgaccggauggggaugggcgugaccuaccucgcccugaucgccaccuucaagauccagcccuuccuggcgcucggguucuuccugcgcaagcugaccagccgggagaaccuccugcugggcgucggccucgccauggccacgacccugcagcugcccgaggacaucgagcagauggccaacgggaucgcgcucggccugauggcccugaagcucaccacccaguucgagacguaccagcuguggaccgcccugaucagccugaccugcuccaacaccaucuucacgcugaccguggccuggcgcaccgccacccugauccucgcgggggucagccugcugccggugugccaguccagcuccaugcggaagacggacuggcuccccaugaccguggccgccaugggcgugccgccccucccgcuguucaucuucagccucaaggacacccugaagcgccgcuccuggccccugaacgagggggugauggccgugggccucgucagcauccuggccuccagccugcuccggaacgacgugcccauggcgggcccccugguggccgggggccugcucaucgccugcuacgucaucaccgggacguccgccgaccugaccguggagaaggccgcggacgugaccugggaggaggaggccgagcagaccggcgucagccacaaccugaugaucaccguggacgacgacgggacgaugcgcaucaaggacgacgagaccgagaacauccucaccgugcugcugaagaccgcccuccugaucgucuccggcaucuucccguacagcauccccgccacgcugcucguguggcacaccuggcagaagcagacccagcgguccggcgugcugugggacguccccagcccgcccgagacccagaaggccgagcuggaggaggggguguaccgcaucaagcagcagggcaucuucgggaagacccaggugggcgucggggugcagaaggagggcguguuccacaccauguggcacgucacccggggcgcggugcucaccuacaacgggaagcgccuggagcccaacugggccuccgugaagaaggaccugaucagcuacggcgggggcuggcggcucuccgcccaguggcagaagggggaggagguccaggugaucgccguggagcccggcaagaaccccaagaacuuccagacgaugcccggcaccuuccagaccaccacgggggagaucggcgcgaucgcccuggacuucaagcccgggaccagcggcagccccaucaucaaccgcgagggcaaggucguggggcuguacggcaacgggguggucaccaagaacggcggguacguguccggcaucgcccagaccaacgccgagccggacggccccacgcccgagcuggaggaggagauguucaagaagcggaaccucaccaucauggaccugcaccccgggagcggcaagacccgcaaguaccugccggccaucgugcgggaggcgaucaagcgccggcuccgcacccugauccuggcccccacgcgggucguggccgccgagauggaggaggcccucaaggggcugcccauccgcuaccagaccaccgcgaccaaguccgagcacacgggccgggagaucguggaccugaugugccacgccaccuucaccaugcgccuccugagccccguccgggugccgaacuacaaccugaucaucauggacgaggcccacuucaccgaccccgccuccaucgccgcgcgcggguacaucagcacgcgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucacggacuucgccgggaagaccgucugguucgugcccagcaucaaggcgggcaacgacaucgccaacugccuccggaagaacgggaagaaggugauccagcugucccgcaagaccuucgacaccgaguaccagaagacgaagcugaacgacugggacuucgucgugaccaccgacaucagcgagaugggcgccaacuucaaggccgaccgggugaucgacccgcgccggugccucaagcccgucauccugaccgacggccccgagcgcgugauccuggccgggcccaugccggugaccgcggccuccgccgcccagcggcgcggccgggucgggcgcaacccccagaaggagaacgaccaguacaucuucacgggccagccccucaacaacgacgaggaccacgcccacuggaccgaggcgaagaugcugcuggacaacaucaacacccccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcgcacaagguggccagcgagggcaucaaguacacggaccgcaaguggugcuucgacgggcagcggaacaaccagauccuggaggagaacauggacguggagaucuggaccaaggagggcgagaagaagaagcuccgcccccgguggcuggacgcccgcaccuacuccgacccgcuggcccucaaggaguucaaggacuucgccgcgggccgcaagagcaucgcccuggaccuggucaccgagaucgggcgggugcccucccaccucgcccaccgcacgcggaacgcccuggacaaccuggugaugcuccacaccagcgagcacggcgggaaggccuaccgccacgcggucgaggagcugcccgagaccauggagacccugcuccugcugggccucaugauccugcugaccggcggggccaugcuguuccugaucagcgggaaggggaucggcaagaccuccaucgggcugaucugcgugaucgccagcuccggcaugcucuggauggccgagaucccgcugcaguggaucgccagcgcgaucgugcuggaguucuucaugaugguccuccugauccccgagcccgagaagcagcggacgccccaggacaaccagcuggccuacguggugaucgggauccucacccuggccgccaucaucgccgcgaacgagaugggccugcucgagacgaccaagcgcgaccugggcauguccaaggagccgggggucgugagccccaccuccuaccuggacguggaccuccaccccgccagcgccuggacccuguacgccgucgcgacgaccgugaucacccccaugcugcggcacaccaucgagaacuccacggccaacgugagccucgccgccaucgccaaccaggcggucgugcugaugggccuggacaagggguggccgaucuccaagauggaccucggcgugccccugcuggcccucgggugcuacagccaggucaacccccugacccugaccgccgccgugcuccugcugaucacccacuacgccaucaucggccccggccuccaggcgaaggccacgcgcgaggcccagaagcggaccgccgccgggaucaugaagaacccgaccguggacggcaucaugaccaucgaccuggaccccgucaucuacgacuccaaguucgagaagcagcugggccaggugaugcuccuggugcugugcgcgguccagcuccugcugaugcgcacgagcugggcccucugcgaggcccugacccuggccaccggccccaucaccacgcucugggagggcucccccgggaaguucuggaacaccaccaucgcggugagcauggccaacaucuuccggggcuccuaccuggccggggccggccuggccuucagcaucaugaaguccguggggaccggcaagcgcggcaccgggagccagggcgagacgcucggggagaaguggaagaagaagcugaaccagcugagccggaaggaguucgaccucuacaagaaguccggcaucaccgaggucgaccgcaccgaggcgaaggaggggcugaagcggggcgagaucacccaccacgccgugagccgcggcuccgccaagcugcagugguucguggagcggaacauggucaucccggaggggcgcgugaucgaccucggcugcgggcggggcggguggagcuacuacugcgccggccugaagaaggugacggagguccgcggcuacaccaagggcgggcccgggcacgaggagcccgugcccauguccaccuacggcuggaacaucgugaagcugaugagcgggaaggacgucuucuaccucccgcccgagaagugcgacacccugcugugcgacaucggcgaguccagccccucccccacgguggaggagagccggaccauccgcgugcugaagauggucgagccguggcucaagaacaaccaguucugcaucaaggugcugaaccccuacaugcccaccgugaucgagcaccuggagcgccuccagcggaagcacggcgggaugcugguccgcaacccccugucccggaacagcacccacgagauguacuggaucuccaacggcacggggaacaucguggccagcgugaacauggucucccgccuccugcugaaccgguucaccaugacccaccgccggccgaccaucgagaaggacguggaccucggcgcgggcacgcgccacgugaacgccgagcccgagacccccaacauggacgucaucggggagcggaucaagcgcaucaaggaggagcacaacagcaccuggcacuacgacgacgagaacccguacaagaccugggccuaccacggcuccuacgaggugaaggccacggggagcgccuccagcaugaucaacggcgucgugaagcugcugaccaagcccugggacgugguccccauggugacccagauggcgaugaccgacacgacccccuucgggcagcagcggguguucaaggagaaggucgacacccgcaccccgcggagcaugcccggcacgcgccgggugaugggcaucaccgccgaguggcucuggcgcacccuggggcggaacaagaagccccgccugugcacccgggaggaguucacgaagaaggugcgcaccaacgccgccaugggcgcggucuucaccgaggagaaccagugggacuccgccaaggccgccguggaggacgaggacuucuggaagcucguggaccgcgagcgggagcugcacaagcuggggaagugcggcagcugcgucuacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgccgacgacaccgcggggugggacacgcggaucaccgaggacgaccugcacaacgaggagaagaucacccagcagauggacccggagcaccgccagcucgccaacgccaucuucaagcugaccuaccagaacaagguggucaaggugcagcggcccacccccacgggcaccgugauggacaucaucagccgcaaggaccagcggggcuccgggcaggucggcaccuacgggcugaacaccuucacgaacauggaggcccagcucauccgccagauggagggcgagggggugcugagcaaggccgaccuggagaacccccaccucccggagaagaagaucacccaguggcuggagaccaagggcguggagcggcugaagcgcauggcgaucuccggcgacgacugcgucgugaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcugguggugcccugccgcccccaggacgagcugaucggccgggcccgcaucagccagggggcgggcuggucccuccgggagaccgccugccugggcaaggccuacgcccagauguggagccugauguacuuccaccgccgcgaccuccggcuggcguccaacgccaucugcagcgccguccccgugcacugggugccgacgucccgcaccaccuggagcauccacgcccaccaccaguggaugaccacggaggacaugcugaccgucuggaaccggguguggaucgaggacaaccccuggauggaggacaagacccccgugaccacgugggagaacguccccuaccucgggaagcgcgaggaccaguggugcggcagccugaucgggcugaccucccgggccaccugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10148 - RNA, 9873 nt, Artificial Sequence
  derived and/or modified CDS sequence (opt1) from DENV-3__EU687219__SS-prME
accagccucugccucaugaugauccugcccgccgcccuggccuuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucgccgagguggagcccgaggacaucgacugcuggugcaaccugaccagcaccugggugaccuacgggaccugcaaccaggccggcgagcaccggcgcgacaagcgguccguggcgcucgcgccccacgugggcauggggcuggacacccgcacccagaccuggaugagcgccgagggcgccuggcggcaggucgagaaggucgagaccugggcgcugcgccacccgggguucaccauccucgcccuguuccuggcccacuacaucggcaccucccucacccagaagguggugaucuucauccugcugaugcucgucacccccagcaugacgaugcggugcgugggggugggcaaccgcgacuucgucgagggccuguccggggccaccuggguggacgugguccuggagcacggcgggugcgugaccaccauggccaagaacaagcccacgcucgacaucgagcugcagaagaccgaggcgacccagcuggccacccuccggaagcugugcaucgagggcaagaucacgaacaucaccaccgacagccgcugccccacccagggcgaggccgugcugccggaggagcaggaccagaacuacgucugcaagcacacguacguggaccggggguggggcaacgggugcggccucuucgggaagggcucccuggugaccugcgccaaguuccagugccuggagcccaucgagggcaaggucgugcaguacgagaaccucaaguacaccgugaucaucaccguccacacgggggaccagcaccaggugggcaacgagacccagggggucaccgccgagaucacgccccaggcgagcacgaccgaggccauccugcccgaguacggcacccuggggcucgagugcuccccgcgcaccggccuggacuucaacgagaugauccugcucaccaugaagaacaaggccuggauggugcaccggcagugguucuucgaccugccccugcccuggacgagcggcgccaccaccgagacccccacguggaaccgcaaggagcuccuggugaccuucaagaacgcccacgcgaagaagcaggaggucguggugcuggggucccaggagggcgccaugcacaccgcccucaccggggccacggagauccagaacagcggcgggaccuccaucuucgccggccaccugaagugccggcugaagauggacaagcucgagcugaagggcaugagcuacgcgaugugcaccaacaccuucguccugaagaaggagguguccgagacgcagcacgggaccauccucaucaagguggaguacaagggcgaggacgucccgugcaagauccccuucagcaccgaggacgggcagggcaaggcccacaacggccgccugaucaccgccaaccccguggugacgaagaaggaggagcccgucaacaucgaggccgagccgcccuucggggagagcaacaucgugaucggcaucggggacaacgcgcugaagaucaacugguacaagaagggcuccagcaucgggaagauguucgaggccaccgcccggggcgcccgccggauggccauccugggcgacaccgcgugggacuucggguccgugggcgggguccucaacagccugggcaagauggugcaccagaucuucggguccgccuacaccgcccuguucagcggcguguccugggucaugaagaucggcaucggggugcuccugacguggaucggccugaacagcaagaacaccuccaugagcuucuccugcaucgccaucgggaucaucacccucuaccugggcgccgugguccaggcggacauggggugcgugaucaacuggaagggcaaggagcugaagugcggcagcgggaucuucgugaccaacgagguccacacguggaccgagcaguacaaguuccaggccgacucccccaagcgccucgccaccgccaucgccggcgcgugggagaacggggugugcggcauccgcagcaccacgcggauggagaaccugcuguggaagcagaucgccaacgagcucaacuacauccugugggagaacaacaucaagcugaccguggucgugggggacaucaucggcgugcucgagcagggcaagcgcacccugacgccccagccgauggagcugaaguacuccuggaagacgugggggaaggccaagaucgucaccgccgagacccagaacagcuccuucaucaucgacggccccaacacccccgagugccccagcgugucccgggcguggaacgugugggaggucgaggacuacggguucggcguguucacgaccaacaucuggcucaagcugcgcgagguguacacccagcugugcgaccaccggcucaugagcgccgccgucaaggacgagcgcgccgugcacgccgacaugggcuacuggaucgagagccagaagaacggguccuggaagcuggagaaggcgagccugaucgaggugaagaccugcaccuggccgaagucccacacgcucuggagcaacggcguccuggaguccgacaugaucauccccaagagccuggccgggcccaucucccagcacaacuaccggccgggcuaccacacccagaccgccgggcccuggcaccucggcaagcuggagcuggacuucaacuacugcgagggcaccacgguggugaucaccgagaacugcgggacccgcggccccagccuccggaccacgaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaaggucgacaacuucaccaugggcgugcugugccucgccauccuguucgaggaggugaugcgggggaaguucggcaagaagcacaugaucgcgggggucuucuucacguucgugcugcuccuguccggccagaucaccuggcgcgacauggcccacacccugaucaugaucggcagcaacgccuccgaccggauggggaugggcgugaccuaccucgcccugaucgccacguucaagauccagcccuuccuggcgcucggguucuuccugcgcaagcugaccagccgggagaaccuccugcugggcgucggccucgccauggccaccacccugcagcugcccgaggacaucgagcagauggccaacgggaucgcgcucggccugauggcccugaagcucaucacgcaguucgagaccuaccagcuguggaccgcccugaucagccugaccugcuccaacacgaucuucacccugaccguggccuggcgcaccgccacgcugauccucgcgggggucagccugcugccggugugccaguccagcuccaugcggaagaccgacuggcuccccaugaccguggccgccaugggcgugccgccccucccgcuguucaucuucagccucaaggacacccugaagcgccgcuccuggccccugaacgagggggugauggccgugggccucgucagcauccuggccuccagccugcuccggaacgacgugcccauggcgggcccccugguggccgggggccugcucaucgccugcuacgucaucacggggaccuccgccgaccugaccguggagaaggccgcggacgugaccugggaggaggaggccgagcagacgggcgucagccacaaccugaugaucaccguggacgacgacgggaccaugcgcaucaaggacgacgagaccgagaacauccucaccgugcugcugaagacggcccuccugaucgucuccggcaucuucccguacagcauccccgccacccugcucguguggcacaccuggcagaagcagacccagcgguccggcgugcugugggacguccccagcccgcccgagacgcagaaggccgagcuggaggaggggguguaccgcaucaagcagcagggcaucuucgggaagacccaggugggcgucggggugcagaaggagggcguguuccacaccauguggcacgucacccggggcgcggugcucacguacaacgggaagcgccuggagcccaacugggccuccgugaagaaggaccugaucagcuacggcgggggcuggcggcucuccgcccaguggcagaagggggaggagguccaggugaucgccguggagcccggcaagaaccccaagaacuuccagaccaugcccggcaccuuccagaccacgaccggggagaucggcgcgaucgcccuggacuucaagcccgggaccagcggcagccccaucaucaaccgcgagggcaaggucguggggcuguacggcaacggggugaucaccaagaacggcggguacgucuccggcaucgcccagacgaacgccgagccggacggccccacccccgagcuggaggaggagauguucaagaagcggaaccucaccaucauggaccugcaccccgggagcggcaagacccgcaaguaccugccggccaucgugcgggaggcgaucaagcgccggcuccgcacgcugauccuggcccccacccggguggucgccgccgagauggaggaggcccucaaggggcugcccauccgcuaccagaccaccgcgacgaaguccgagcacaccggccgggagaucguggaccugaugugccacgccaccuucaccaugcgccuccugagccccgugcgggucccgaacuacaaccugaucaucauggacgaggcccacuucacggaccccgccuccaucgccgcgcgcggguacaucagcacccgggugggcaugggcgaggccgccgccaucuucaugaccgcgacgccgcccgggacggccgacgccuucccgcaguccaacgcccccauccaggacgaggagcgcgacauccccgagcgcagcuggaacuccggcaacgaguggaucaccgacuucgccgggaagaccgugugguucguccccagcaucaaggcgggcaacgacaucgccaacugccuccggaagaacgggaagaaggugauccagcugucccgcaagaccuucgacacggaguaccagaagaccaagcugaacgacugggacuucguggucaccaccgacaucagcgagaugggcgccaacuucaaggccgaccgggugaucgacccgcgccggugccucaagcccgugauccugacggacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacccccgaggggaucaucccggcccucuucgagcccgagcgggagaaguccgccgccaucgacggcgaguaccgccugaagggcgagucccggaagacguucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcaccuacuccgacccgcuggcccucaaggaguucaaggacuucgccgcgggccgcaagagcaucgcccuggaccuggugacggagaucgggcggguccccucccaccucgcccaccgcacccggaacgcccuggacaaccuggugaugcuccacaccagcgagcacggcgggaaggccuaccgccacgcgguggaggagcugcccgagaccauggagacgcugcuccugcugggccucaugauccugcugaccgggggcgccaugcuguuccugaucagcggcaaggggaucggcaagaccuccaucgggcugaucugcgucaucgccagcuccggcaugcucuggauggccgagaucccgcugcaguggaucgccagcgcgaucgugcuggaguucuucaugauggugcuccugauccccgagcccgagaagcagcggacgccccaggacaaccagcuggccuacgucgugaucgggauccucacgcuggccgccaucaucgccgcgaacgagaugggccugcucgagaccaccaagcgcgaccugggcauguccaaggagccggggguggucagccccaccuccuaccuggacguggaccuccaccccgccagcgccuggacgcuguacgccguggcgaccaccgucaucacccccaugcugcggcacacgaucgagaacuccaccgccaacgugagccucgccgccaucgccaaccaggcggugguccugaugggccuggacaagggguggccgaucuccaagauggaccucggcgugccccugcuggcccucgggugcuacagccaggugaacccccugacccugaccgccgccguccuccugcugaucacgcacuacgccaucaucggccccggccuccaggcgaaggccacccgcgaggcccagaagcggaccgccgccgggaucaugaagaacccgaccguggacggcaucaugacgaucgaccuggaccccgugaucuacgacuccaaguucgagaagcagcuggggcaggucaugcuccuggugcugugcgcggugcagcuccugcugaugcgcaccagcugggcccucugcgaggcccugacccuggccaccggccccaucacgacccucugggagggcucccccgggaaguucuggaacaccaccaucgcggucagcauggccaacaucuuccggggcuccuaccuggccggggccggccuggccuucagcaucaugaaguccguggggacgggcaagcgcggcaccgggagccagggcgagacccucggggagaaguggaagaagaagcugaaccagcugagccggaaggaguucgaccucuacaagaaguccggcaucaccgagguggaccgcaccgaggcgaaggaggggcugaagcggggcgagaucacgcaccacgccgucagccgcggcuccgccaagcugcagugguucguggagcggaacauggugaucccggaggggcgcgucaucgaccucggcugcgggcggggcggguggagcuacuacugcgccggccugaagaaggugaccgaggugcgcggcuacaccaagggcgggcccgggcacgaggagcccguccccauguccaccuacggcuggaacaucgugaagcugaugagcgggaaggacguguucuaccucccgcccgagaagugcgacacgcugcugugcgacaucggcgaguccagccccucccccaccgucgaggagagccggaccauccgcgugcugaagaugguggagccguggcucaagaacaaccaguucugcaucaagguccugaaccccuacaugcccaccgugaucgagcaccuggagcgccuccagcggaagcacggcgggaugcuggugcgcaacccccugucccggaacagcacgcacgagauguacuggaucuccaacggcaccgggaacaucgucgccagcgugaacauggugucccgccuccugcugaaccgguucaccaugacccaccgccggccgacgaucgagaaggacgucgaccucggcgcgggcacccgccacgugaacgccgagcccgagacccccaacauggacgugaucggggagcggaucaagcgcaucaaggaggagcacaacagcaccuggcacuacgacgacgagaacccguacaagacgugggccuaccacggcuccuacgaggucaaggccaccgggagcgccuccagcaugaucaacggcguggucaagcugcugaccaagcccugggacguggugcccauggucacccagauggcgaugacggacaccacccccuucgggcagcagcggguguucaaggagaagguggacacccgcacgccgcggagcaugcccggcacccgccgggucaugggcaucaccgccgaguggcucuggcgcacccuggggcggaacaagaagccccgccugugcacgcgggaggaguucaccaagaaggugcgcaccaacgccgccaugggcgcgguguucaccgaggagaaccagugggacuccgccaaggccgccgucgaggacgaggacuucuggaagcucguggaccgcgagcgggagcugcacaagcuggggaagugcggcagcugcguguacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcgucgagggggagggccugcacaagcucggcuacauccugcgcgacaucuccaagauccccgggggcgccauguacgccgacgacacggcggggugggacacccggaucaccgaggacgaccugcacaacgaggagaagaucacccagcagauggacccggagcaccgccagcucgccaacgccaucuucaagcugacguaccagaacaagguggugaagguccagcggcccacccccaccggcaccgugauggacaucaucagccgcaaggaccagcggggcuccggccaggugggcaccuacgggcugaacacguucaccaacauggaggcccagcucauccgccagauggagggcgaggggguccugagcaaggccgaccuggagaacccccaccucccggagaagaagaucacccaguggcuggagaccaagggcguggagcggcugaagcgcauggcgaucuccggcgacgacugcguggucaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcuggucgugcccugccgcccccaggacgagcugaucggccgggcccgcaucagccagggggcgggcuggucccuccgggagacggccugccugggcaaggccuacgcccagauguggagccugauguacuuccaccgccgcgaccuccggcuggcguccaacgccaucugcagcgccgugcccguccacugggugccgaccucccgcaccaccuggagcauccacgcccaccaccaguggaugacgaccgaggacaugcugaccguguggaaccgggucuggaucgaggacaaccccuggauggaggacaagacccccgugacgaccugggagaacgugcccuaccucgggaagcgcgaggaccaguggugcggcagccugaucgggcugaccucccgggccaccugggcgcagaacaucccgacggccauccagcagguccgcagccucaucggcaacgaggaguuccuggacuacaugcccuccaugaagcgguuccgcaaggaggaggagagcgagggggccaucugguga

SEQ ID NO: 10149 - RNA, 9873 nt, Artificial Sequence
  derived and/or modified CDS sequence (opt1) from DENV-3__EU726768__SS-prME
accagccugugccucaugaugauccugcccgcggcgcuggcguuccaccucaccagccgggacggcgagccccggaugaucguggggaagaacgagcgcggcaagagccugcuguucaagacggccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgugaucgggaucaucacccucuaccugggcgccgucgugcaggccgacauggggugcgugaucaacuggaagggcaaggagcugaagugcggcagcgggaucuucgucacgaacgaggugcacaccuggaccgagcaguacaaguuccaggccgacucccccaagcgccucgcgaccgccaucgccggcgccugggagaacggggugugcggcauccgcagcacgacccggauggagaaccugcuguggaagcagaucgccaacgagcucaacuacauccugugggagaacaacaucaagcugaccgucguggugggggacaucaucggcguccucgagcagggcaagcgcacccugacgccccagccgauggagcugaaguacuccuggaagaccugggggaaggcgaagaucgugaccgccgagacccagaacagcuccuucaucaucgacggccccaacacgcccgagugccccagcgccucccgggccuggaacgugugggaggucgaggacuacggguucggcguguucaccaccaacaucuggcucaagcugcgcgagguguacacccagcugugcgaccaccggcucaugagcgcggccgucaaggacgagcgcgccgugcacgccgacaugggcuacuggaucgagagccagaagaacggguccuggaagcuggagaaggccagccugaucgaggugaagaccugcacguggccgaagucccacacccucuggagcaacggcguccuggaguccgacaugaucauccccaagagccuggcggggcccaucucccagcacaacuaccggccgggcuaccacacccagaccgccgggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaaggucgacaacuucacgaugggcgugcugugccucgccauccuguucgaggaggugaugcgggggaaguucggcaagaagcacaugaucgccggggucuucuucaccuucgugcugcuccuguccggccagaucaccuggcgcgacauggcgcacacccugaucaugaucggcagcaacgccuccgaccggauggggaugggcgugacguaccucgcccugaucgccaccuucaagauccagcccuuccuggcccucggguucuuccugcgcaagcugaccagccgggagaaccuccugcugggcgucggccucgcgauggccaccacgcugcagcugcccgaggacaucgagcagauggccaacgggaucgcccucggccugauggcgcugaagcucaucacccaguucgagaccuaccagcuguggaccgcccugaucagccucacgugcuccaacaccaucuucacccugaccguggccuggcgcacggccacccugauccucgccggggucagccugcugccggugugccaguccagcuccaugcggaagaccgacuggcuccccaugaccguggcggccaugggcgugccgccccucccgcuguucaucuucagccucaaggacacgcugaagcgccgcuccuggccccugaacgagggggugauggccgugggccucgucagcauccuggccuccagccugcuccggaacgacgugcccauggccggcccccugguggccggcgggcugcucaucgccugcuacgucaucaccgggaccuccgccgaccugaccguggagaaggccgccgacgugacgugggaggaggaggcggagcagaccggggucagccacaaccugaugaucaccguggacgacgacgggaccaugcgcaucaaggacgacgagaccgagaacauccucacggugcugcugaagaccgcccuccugaucgucuccggcaucuucccguacagcauccccgccacccugcucguguggcacaccuggcagaagcagacgcagcgguccggcgugcugugggacguccccagcccgcccgagacccagaaggccgagcuggaggaggggguguaccgcaucaagcagcagggcaucuucgggaagacccaggugggcgucggggugcagaaggagggcguguuccacaccauguggcacgucacgcggggcgccgugcucaccuacaacgggaagcgccuggagcccaacugggcguccgugaagaaggaccugaucagcuacggcgggggcuggcggcucuccgcccaguggcagaagggggaggagguccaggugaucgccguggagcccggcaagaaccccaagaacuuccagaccaugcccggcaccuuccagacgaccaccggggagaucggcgccaucgcgcuggacuucaagcccgggaccagcggcagccccaucaucaaccgcgagggcaaggucguggggcuguacggcaacgggguggucacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggccaucaagcgccggcuccgcacccugauccuggcgcccacccgggucguggccgccgagauggaggaggcccucaaggggcugcccauccgcuaccagaccacggccaccaaguccgagcacaccggccgggagaucguggaccugaugugccacgcgaccuucacgaugcgccuccugagccccguccgggugccgaacuacaaccugaucaucauggacgaggcccacuucaccgaccccgccuccaucgccgcccgcggguacaucagcacccgggugggcaugggcgaggcggccgccaucuucaugaccgccacgccgcccgggaccgcggacgccuucccgcaguccaacgcccccauccaggacgaggagcgcgacauccccgagcgcagcuggaacuccggcaacgaguggaucaccgacuucgccgggaagaccgucugguucgugcccagcaucaaggccggcaacgacaucgcgaacugccuccggaagaacgggaagaaggugauccagcugucccgcaagacguucgacaccgaguaccagaagaccaagcugaacgacugggacuucgucgugaccacggacaucagcgagaugggcgccaacuucaaggccgaccgggugaucgacccgcgccggugccucaagcccgucauccugaccgacggccccgagcgcgugauccuggccgggcccaugccggugaccgccgcguccgccgcccagcggcgcggccgggucgggcgcaacccccagaaggagaacgaccaguacaucuucaccggccagccccucaacaacgacgaggaccacgcccacuggaccgaggccaagaugcugcuggacaacaucaacacgcccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcccacaagguggcgagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgccggccgcaagagcaucgcgcuggaccuggucaccgagaucgggcgggugcccucccaccucgcccaccgcacccggaacgcccuggacaaccuggugaugcuccacaccagcgagcacggcgggaaggccuaccgccacgccgucgaggagcugcccgagacgauggagacccugcuccugcugggccucaugauccugcugaccgggggcgcgaugcuguuccugaucagcggcaaggggaucggcaagaccuccaucgggcugaucugcgugaucgccagcuccggcaugcucuggauggccgagaucccgcugcaguggaucgccagcgccaucgugcuggaguucuucaugaugguccuccugauccccgagcccgagaagcagcggacgccccaggacaaccagcuggcguacguggugaucgggauccucacccuggccgccaucaucgccgccaacgagaugggccugcucgagaccaccaagcgcgaccugggcauguccaaggagccgggggucgugagccccacguccuaccuggacguggaccuccaccccgcgagcgccuggacccuguacgccgucgccaccaccgugaucacgcccaugcugcggcacaccaucgagaacuccaccgcgaacgugagccucgccgccaucgccaaccaggccgucgugcugaugggccuggacaagggguggccgaucuccaagauggaccucggcgugccccugcuggcgcucgggugcuacagccaggucaacccccugacccugacggccgccgugcuccugcugaucacccacuacgccaucaucggccccggccuccaggccaaggcgacccgcgaggcccagaagcggaccgccgccgggaucaugaagaacccgacgguggacggcaucaugaccaucgaccuggaccccgucaucuacgacuccaaguucgagaagcagcugggccaggugaugcuccuggugcugugcgccguccagcuccugcugaugcgcaccagcugggcgcucugcgaggcccugacccuggccacgggccccaucaccacccucugggagggcucccccgggaaguucuggaacaccacgaucgccgugagcauggcgaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggaguucgaccucuacaagaaguccggcaucaccgaggucgaccgcacggaggccaaggaggggcugaagcggggcgagaucacccaccacgcggugagccgcggcuccgccaagcugcagugguucguggagcggaacauggucaucccggaggggcgcgugaucgaccucggcugcgggcggggcggguggagcuacuacugcgccggccugaagaaggugaccgagguccgcggcuacaccaagggcgggcccgggcacgaggagcccgugcccauguccacguacggcuggaacaucgugaagcugaugagcgggaaggacgucuucuaccucccgcccgagaagugcgacacccugcugugcgacaucggcgaguccagccccucccccaccguggaggagagccggaccauccgcgugcugaagauggucgagccguggcucaagaacaaccaguucugcaucaaggugcugaaccccuacaugcccacggugaucgagcaccuggagcgccuccagcggaagcacggcgggaugcugguccgcaacccccugucccggaacagcacccacgagauguacuggaucuccaacggcaccgggaacaucguggccagcgugaacauggucucccgccuccugcugaaccgguucaccaugacgcaccgccggccgaccaucgagaaggacguggaccucggcgccggcacccgccacgugaacgcggagcccgagacccccaacauggacgucaucggggagcggaucaagcgcaucaaggaggagcacaacagcacguggcacuacgacgacgagaacccguacaagaccugggccuaccacggcuccuacgaggugaaggccaccgggagcgccuccagcaugaucaacggcgucgugaagcugcugaccaagcccugggacgugguccccauggugacgcagauggccaugaccgacaccacccccuucgggcagcagcggguguucaaggagaaggucgacacgcgcaccccgcggagcaugcccggcacccgccgggugaugggcaucaccgcggaguggcucuggcgcacgcuggggcggaacaagaagccccgccugugcacccgggaggaguucaccaagaaggugcgcaccaacgccgccaugggcgccgucuucacggaggagaaccagugggacuccgcgaaggccgccguggaggacgaggacuucuggauccucguggaccgcgagcgggagcugcacaagcuggggaagugcggcagcugcgucuacaacaugauggggaagcgcgagaagaagcucggcgaguucggcaaggccaaggggucccgggccaucugguacauguggcugggcgcgcgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgccgacgacaccgccgggugggacacccggaucaccgaggacgaccugcacaacgaggagaagaucacgcagcagauggacccggagcaccgccagcucgcgaacgccaucuucaagcugaccuaccagaacaagguggucaaggugcagcggcccacccccaccggcaccgugauggacaucaucagccgcaaggaccagcggggcuccgggcaggucggcacguacgggcugaacaccuucaccaacauggaggcccagcucauccgccagauggagggcgagggggugcugagcaaggccgaccuggagaacccccaccucccggagaagaagaucacccaguggcuggagacgaagggcguggagcggcugaagcgcauggccaucuccggcgacgacugcgucgugaagcccaucgacgaccgguucgcgaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcugguggugcccugccgcccccaggacgagcugaucggccgggcccgcaucagccagggggccggcuggucccuccgggagaccgcgugccugggcaaggccuacgcccagauguggagccugauguacuuccaccgccgcgaccuccggcuggccuccaacgcgaucugcagcgccguccccgugcacugggugccgaccucccgcaccacguggagcauccacgcccaccaccaguggaugaccaccgaggacaugcugaccgucuggaaccggguguggaucgaggacaaccccuggauggaggacaagacgcccgugaccaccugggagaacguccccuaccucgggaagcgcgaggaccaguggugcggcagccugaucgggcugaccucccgggccacgugggcccagaacaucccgaccgcgauccagcagguccgcagccucaucggcaacgaggaguuccuggacuacaugcccuccaugaagcgguuccgcaaggaggaggagagcgagggggccaucugguga

SEQ ID NO: 10150 - RNA, 9873 nt, Artificial Sequence
  derived and/or modified CDS sequence (opt1) from DENV-3__EU687226__SS-prME
accagccugugccugaugaugauccugcccgccgcccuggcguuccaccucaccagccgggacggcgagccgcggaugaucguggggaagaacgagcgcggcaagagccugcuguucaagacggccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccgucuccgagaaggaggagaacauggucaagagccugguguccgccggcagcgggaaggucgacaacuucacgaugggcgugcugugccucgccauccuguucgaggaggugaugcgggggaaguucggcaagaagcacaugaucgcgggggucuucuucaccuucgugcugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgucggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccguggccuggcgcacggccacccugauccucgcgggggucagccugcugccggugugccaguccagcuccaugcggaagaccgacuggcuccccaugaccguggccgccaugggcgugccgccccugccgcuguucaucuucagccucaaggacacgcugaagcgccgcuccuggccccugaacgagggggugauggccgugggccucgucagcauccuggccuccagccugcuccggaacgacgugcccauggcgggcccccugguggccgggggccugcucaucgccugcuacgucaucaccgggaccuccgccgaccugaccguggagaaggccgcggacgugacgugggaggaggaggccgagcagaccggcgucagccacaaccugaugaucaccguggacgacgacgggaccaugcgcaucaaggacgacgagaccgagaacauccucacggugcugcugaagaccgcccuccugaucgucuccggcaucuucccguacagcauccccgccacccugcucguguggcacaccuggcacaagcagacgcagcgguccggcgugcccugggacguccccagcccgcccgagacccagaaggccgagcuggaggaggggguguaccgcaucaagcagcagggcaucuucgggaagacccaggugggcgucggggugcagaaggagggcguguuccacuccauguggcacgucacccggggcgcggugcugacguacaacgggaagcgccucgagcccaacugggccagcgugaagaaggaccugaucuccuacggcgggggcuggcggcugagcgcccaguggcagaagggggaggagguccaggugaucgccguggagcccggcaagaacccgaagaacuuccagaccaugcccggcaccuuccagaccacgaccggggagaucggcgcgaucgcccucgacuucaagcccgggaccagcggcuccccgaucaucaaccgcgagggcaaggucguggggcuguacggcaacgggguggucaccaagaacggcggguacgugagcggcaucgcccagacgaacgccgagcccgacggccccacccccgagcuggaggaggagauguucaagaagcggaaccugaccaucauggaccuccacccgggguccggcaagacccgcaaguaccugcccgccaucgugcgggaggcgaucaagcgccggcugcgcacgcucauccuggcccccacccgggucguggccgccgagauggaggaggcccugaaggggcuccccauccgcuaccagaccaccgcgaccaagagcgagcacaccggccgggagaucguggaccugaugugccacgccaccuucaccaugcgccugcucuccccgguccgggugcccaacuacaaccugaucaucauggacgaggcccacuucacggaccccgccagcaucgccgcgcgcggguacaucuccacccgggugggcaugggcgaggccgccgccaucuucaugaccgcgacgccgcccgggacggccgacgccuucccccagagcaacgcccccauccaggacgaggagcgcgacauccccgagcgcuccuggaacagcggcaacgaguggaucaccgacuucgccgggaagaccgucugguucgugcccuccaucaaggcgggcaacgacaucgccaacugccugcggaagaacgggaagaaggugauccagcucagccgcaagaccuucgacacggaguaccagaagaccaagcugaacgacugggacuucgucgugaccaccgacaucuccgagaugggcgccaacuucaaggccgaccgggugaucgacccccgccggugccugaagcccgucauccucacggacggccccgagcgcgugauccuggccgggccgaugcccgugaccgcggccagcgccgcccagcggcgcggccgggucgggcgcaacccccagaaggagaacgaccaguacaucuucaccggccagccccugaacaacgacgaggaccacgcccacuggaccgaggcgaagaugcuccuggacaacaucaacaccccggaggggaucauccccgcccuguucgagcccgagcgggagaaguccgccgccaucgacggcgaguaccgccucaagggcgagagccggaagacguucguggagcugaugcgccgcggggaccugcccgucuggcucgcgcacaagguggccuccgagggcaucaaguacaccgaccgcaaguggugcuucgacgggcagcggaacaaccagauccuggaggagaacauggacguggagaucuggaccaaggagggcgagaagaagaagcugcgcccgcgguggcucgacgcccgcaccuacagcgacccccuggcccugaaggaguucaaggacuucgccgcgggccgcaaguccaucgcccucgaccuggucacggagaucgggcgggugcccagccaccuggcccaccgcacccggaacgcccucgacaaccuggugaugcugcacaccagcgagcacggcgggaaggccuaccgccacgcggucgaggagcucccggagaccauggagacgcugcugcuccugggccugaugauccuccugaccgggggcgccaugcuguuccucaucuccggcaaggggaucggcaagaccagcaucgggcugaucugcgugaucgccuccagcggcaugcuguggauggccgagaucccccuccaguggaucgccuccgcgaucgugcuggaguucuucaugaugguccugcucauccccgagcccgagaagcagcggaccccgcaggacaaccagcuggccuacguggugaucgggauccugacgcucgccgccaucaucgccgcgaacgagaugggccugcuggagaccaccaagcgcgaccucggcaugagcaaggagcccggggucgugucccccaccagcuaccuggacguggaccugcaccccgccuccgccuggacgcucuacgccgucgcgaccaccgugaucaccccgaugcugcggcacacgaucgagaacagcaccgccaacgugucccuggccgccaucgccaaccaggcggucgugcucaugggccuggacaagggguggcccaucagcaagauggaccugggcgugccccuccuggcccuggggugcuacucccaggucaacccccucacccugaccgccgccgugcugcuccugaucacgcacuacgccaucaucggcccgggccugcaggcgaaggccacccgcgaggcccagaagcggaccgccgccgggaucaugaagaaccccaccguggacggcaucaugacgaucgaccucgaccccgucaucuacgacagcaaguucgagaagcagcugggccaggugaugcugcucgugcugugcgcgguccagcugcuccugaugcgcaccuccugggcccugugcgaggcccucacccuggccaccggccccaucacgacccugugggagggcagcccggggaaguucuggaacaccaccaucgcgguguccauggccaacaucuuccggggcagcuaccucgccggggccggccuggccuucuccaucaugaaguccguggggacgggcaagcgcggcaccgggagccagggcgagacccugggggagaaguggaagaagaagcucaaccagcugucccggaaggaguucgaccuguacaagaaguccggcaucaccgaggucgaccgcaccgaggcgaaggaggggcucaagcggggcgagaucacgcaccacgccgugucccgcggcagcgccaagcugcagugguucguggagcggaacauggucauccccgaggggcgcgugaucgaccugggcugcgggcggggcgggugguccuacuacugcgccggccucaagaaggugaccgagguccgcggcuacaccaagggcgggcccgggcacgaggagcccgugccgaugagcaccuacggcuggaacaucgugaagcugauguccgggaaggacgucuucuaccugccgcccgagaagugcgacacgcuccugugcgacaucggcgagagcucccccagcccgaccguggaggagucccggaccauccgcgugcugaagauggucgagcccuggcugaagaacaaccaguucugcaucaaggugcucaaccccuacaugcccaccgugaucgagcaccuggagcgccugcagcggaagcacggcgggaugcucguccgcaacccgcugagccggaacuccacgcacgagauguacuggaucagcaacggcaccgggaacaucguggccuccgugaacauggucagccgccugcuccugaaccgguucaccaugacccaccgccggcccacgaucgagaaggacguggaccugggcgcgggcacccgccacgugaacgccgagcccgagaccccgaacauggacgucaucggggagcggaucaagcgcaucaaggaggagcacaacuccaccuggcacuacgacgacgagaaccccuacaagacgugggccuaccacggcagcuacgaggugaaggccaccggguccgccagcagcaugaucaacggcgucgugaagcuccugaccaagcccugggacgugguccccauggugacccagauggcgaugacggacaccaccccguucgggcagcagcggguguucaaggagaaggucgacacccgcacgccccgguccaugcccggcacccgccgggugaugggcaucaccgccgaguggcuguggcgcacccucgggcggaacaagaagccccgccugugcacgcgggaggaguucaccaagaaggugcgcaccaacgccgccaugggcgcggucuucaccgaggagaaccagugggacagcgccaaggccgccguggaggacgaggacuucuggaagcugguggaccgcgagcgggagcuccacaagcuggggaagugcggcuccugcgucuacaacaugauggggaagcgcgagaagaagcugggcgaguucggcaaggccaaggggagccgggcgaucugguacauguggcucggcgcccgcuaccuggaguucgaggcccugggguuccucaacgaggaccacugguucucccgggagaacagcuacuccggcguggagggggagggccugcacaagcugggcuacauccuccgcgacaucagcaagauccccggcggggccauguacgccgacgacacggcggggugggacacccggaucaccgaggacgaccugcacaacgaggagaagaucacccagcagauggaccccgagcaccgccagcuggccaacgccaucuucaagcucacguaccagaacaagguggucaaggugcagcggcccacccccaccgggaccgugauggacaucaucucccgcaaggaccagcggggcagcgggcaggucggcaccuacgggcugaacacguucaccaacauggaggcccagcugauccgccagauggagggcgagggggugcucuccaaggccgaccuggagaacccgcaccuccccgagaagaagaucacccaguggcucgagaccaagggcguggagcggcugaagcgcauggcgaucagcggcgacgacugcgucgugaagcccaucgacgaccgguucgccaacgcccugcucgcccugaacgacauggggaaggugcgcaaggacaucccccaguggcagccguccaagggcuggcacgacuggcagcagguccccuucugcagccaccacuuccacgagcugaucaugaaggacgggcggaagcucguggugcccugccgcccccaggacgagcugaucggccgggcccgcaucucccagggggcgggcuggagccugcgggagacggccugccucggcaaggccuacgcccagauguggucccugauguacuuccaccgccgcgaccugcggcucgcgagcaacgccaucugcuccgccgucccggugcacugggugcccaccagccgcaccaccuggagcauccacgcccaccaccaguggaugacgaccgaggacaugcugaccgucuggaaccggguguggaucgaggacaaccccuggauggaggacaagacccccgugacgaccugggagaacgucccguaccuggggaagcgcgaggaccaguggugcggcucccucaucgggcugaccagccgggccaccugggcgcagaacauccccacggccauccagcagguccgcucccugaucggcaacgaggaguuccucgacuacaugcccagcaugaagcgguuccgcaaggaggaggaguccgagggggccaucugguga

SEQ ID NO: 10151 - RNA, 9876 nt, Artificial Sequence
  derived and/or modified CDS sequence (opt1) from DENV-3__EU687233__SS-prME
accagccugugccucaugaugauccugcccgccgcccuggccuuccaccucaccagccgggacggggagccccggaugaucguggggaagaacgagcgcggcaagagccugcuguucaagaccgccagcgggaucaacaugugcacccucaucgccauggaccugggcgagaugugcgacgacaccgugaccuacaagugcccccacaucgccgagguggagcccgaggacaucgacugcuggugcaaccugaccagcaccugggugaccuacgggaccugcaaccaggccggcgagcaccggcgcgacaagcgguccgucgcgcucgcgccccacgugggcauggggcuggacacgcgcacccagaccuggaugagcgccgagggcgccuggcgccagguggagaaggucgagaccugggcgcugcgccacccgggguucacgauccucgcccuguuccuggcccacuacaucggcaccucccucacccagaagguggugaucuucauccugcugaugcucgucacccccagcaugacgaugcggugcgugggggugggcaaccgcgacuucgucgagggccuguccggggccaccuggguggacgugguccuggagcacggcgggugcgugaccaccauggccaagaacaagcccacgcucgacaucgagcugcagaagaccgaggcgacccagcuggccacccuccggaagcugugcaucgagggcaagaucacgaacaucaccaccgacagccgcugccccacccagggcgaggccgugcugccggaggagcaggaccagaacuacgucugcaagcacacguacguggaccggggguggggcaacgggugcggccucuucgggaagggcucccuggugaccugcgccaaguuccagugccuggagcccaucgagggcaaggucgugcaguacgagaaccucaaguacaccgugaucaucaccguccacacgggggaccagcaccaggugggcaacgagacccagggggucaccgccgagaucacgccccaggcgagcacgaccgaggccauccugcccgaguacggcacccuggggcucgagugcuccccgcgcaccggccuggacuucaacgagaugauccugcucaccaugaagaacaaggccuggauggugcaccggcagugguucuucgaccugccccugcccuggacgagcggcgccaccaccgagacccccacguggaaccgcaaggagcuccuggugaccuucaagaacgcccacgcgaagaagcaggaggucguggugcuggggucccaggagggcgccaugcacaccgcccucaccggggccacggagauccagaacagcggcgggaccuccaucuucgccggccaccugaagugccggcugaagauggacaagcucgagcugaagggcaugagcuacgcgaugugcaccaacaccuucguccugaagaaggagguguccgagacgcagcacgggaccauccucaucaagguggaguacaagggcgaggacgucccgugcaagauccccuucagcaccgaggacgggcagggcaaggcccacaacggccgccugaucaccgccaaccccguggugacgaagaaggaggagcccgucaacaucgaggccgagccgcccuucggggagagcaacaucgugaucggcaucggggacaacgcgcugaagaucaacugguacaagaagggcuccagcaucgggaagauguucgaggccaccgcccggggcgcccgccggauggccauccugggcgacaccgcgugggacuucggguccgugggcgggguccucaacagccugggcaagauggugcaccagaucuucggguccgccuacaccgcccuguucagcggcguguccugggucaugaagaucggcaucggggugcuccugacguggaucggccugaacagcaagaacaccuccaugagcuucuccugcaucgccaucgggaucaucacccucuaccugggcgccgugguccaggcggacaccgggugcgugaucaacuggaagggcaaggagcugaagugcggcagcgggaucuucgugacgaacgagguccacaccuggaccgagcaguacaaguuccaggccgacucccccaagcgccucgccaccgccaucgccggcgcgugggagaacggggugugcggcauccgcagcacgacccggauggagaaccugcuguggaagcagaucgccaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgcgucccgggccuggaacgugugggagguggaggacuacggguucggcgucuucaccaccaacaucuggcucaagcugcgcgagguguacacccagcugugcgaccaccggcucaugagcgccgccgugaaggacgagcgcgccguccacgcggacaugggcuacuggaucgagagccagaagaacggguccuggaagcuggagaaggccagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgcgauccuguucgaggaggugaugcgggggaaguucggcaagaagcacaugaucgccgggguguucuucaccuucguccugcuccuguccggccagaucaccuggcgcgacauggcccacacccugaucaugaucggcagcaacgccuccgaccggauggggaugggcgugacguaccucgcccugaucgcgaccuucaagauccagcccuuccuggcccucggguucuuccugcgcaagcugaccagccgggagaaccuccugcugggcgugggccucgccauggccaccacgcugcagcugcccgaggacaucgagcagauggcgaacgggaucgcccucggccugauggcccugaagcucaucacccaguucgagaccuaccagcuguggaccgcccugaucagccucacgugcuccaacaccaucuucacccugaccgucgccuggcgcacggcgacccugauccucgccggggugagccugcugccggucugccaguccagcuccaugcggaaguccgacuggcuccccaugaccguggccgccaugggcgugccgccccucccgcuguucaucuucucccucaaggacacccugaagcgccgcagcuggccccugaacgagggggucauggccgugggccucguguccauccuggcgagcucccugcuccggaacgacguccccauggccggcccccugguggccgggggccugcucaucgccugcuacgugaucacggggaccagcgccgaccugaccgucgagaaggcggccgacgugaccugggaggaggaggccgagcagacgggcgugucccacaaccugaugaucaccgucgacgacgacgggaccaugcgcaucaaggacgacgagaccgagaacauccucaccgugcugcugaagacggcccuccugaucgugagcggcaucuucccguacuccauccccgccacccugcucgucuggcacaccuggcagaagcagacccggcgcagcggcgugcugugggacgugcccagcccgcccgagacgcagaaggcggagcuggaggagggggucuaccggaucaagcagcagggcaucuucgggaagacccaggugggcguggggguccagaaggagggcguguuccacaccauguggcacgugacccgcggcgccguccucacguacaacgggaagcggcuggagcccaacugggccagcgugaagaaggaccugaucuccuacggcgggggcuggcgccucagcgcccaguggcagaagggggaggaggugcaggucaucgcgguggagcccggcaagaaccccaagaacuuccagaccaugcccggcaccuuccagaccacgaccggggagaucggcgccaucgcccuggacuucaagcccgggaccagcggcucccccaucaucaaccgggagggcaagguggucgggcuguacggcaacgggguggugaccaagaacggcggguacgucagcggcaucgcccagacgaacgccgagccggacggccccacccccgagcuggaggaggagauguucaagaagcgcaaccucaccaucauggaccugcaccccggguccggcaagacccggaaguaccugccggcgaucgugcgcgaggccaucaagcggcgccuccggacgcugauccuggcccccacccgcguggucgccgccgagauggaggaggcgcucaaggggcugcccauccgguaccagaccaccgccaccaagagcgagcacaccggccgcgagaucguggaccugaugugccacgccaccuucaccaugcggcuccugucccccgugcgcgucccgaacuacaaccugaucaucauggacgaggcccacuucacggaccccgccagcaucgcggcccggggguacaucuccacccgcgugggcaugggcgaggccgccgcgaucuucaugaccgccacgccgcccgggacggccgacgccuucccgcagagcaacgcccccauccaggacgaggagcgcgacauccccgagcgguccuggaacagcggcaacgaguggaucaccgacuucgcggggaagaccgugugguucguccccuccaucaaggccggcaacgacaucgccaacugccuccgcaagaacgggaagaaggugauccagcugagccggaagaccuucgacacggaguaccagaagaccaagcugaacgacugggacuucguggucaccaccgacaucuccgagaugggcgccaacuucaaggccgaccgcgugaucgacccgcggcgcugccucaagcccgugauccugacggacggccccgagcgggucauccuggcggggcccaugccggugaccgccgccagcgccgcccagcgccggggccgcguggggcggaacccccagaaggagaacgaccaguacaucuucaccggccagccccucaacaacgacgaggaccacgcgcacuggaccgaggccaagaugcugcuggacaacaucaacacccccgaggggaucaucccggcccucuucgagcccgagcgcgagaaguccgccgcgaucgacggcgaguaccggcugaagggcgagagccgcaagacguucgucgagcugaugcggcgcggggaccuccccguguggcuggcccacaaggucgccuccgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcccgcaccuacagcgacccgcuggcccucaaggaguucaaggacuucgcggccggccggaaguccaucgcccuggaccuggugacggagaucgggcgcguccccagccaccucgcccaccggacccgcaacgcccuggacaaccuggugaugcuccacaccagcgagcacggcgggaaggcguaccggcacgccguggaggagcugcccgagaccauggagacgcugcuccugcugggccucaugauccugcugaccgggggcgccaugcuguuccugaucuccggcaaggggaucggcaagaccagcaucgggcugaucugcgucaucgccuccagcggcaugcucuggauggccgagaucccgcugcaguggaucgcguccgccaucgugcuggaguucuucaugauggugcuccugauccccgagcccgagaagcagcgcacgccccaggacaaccagcuggccuacgucgugaucgggauccucacgcuggccgccaucaucgcggccaacgagaugggccugcucgagaccaccaagcgggaccugggcaugagcaaggagccggggguggucucccccaccagcuaccuggacguggaccuccaccccgccuccgccuggacgcuguacgcgguggccaccaccgucaucacccccaugcugcgccacacgaucgagaacagcaccgccaacgugucccucgccgccaucgcgaaccaggccgugguccugaugggccuggacaagggguggccgaucagcaagauggaccucggcgugccccugcuggcccucgggugcuacucccaggugaacccccugacccugaccgccgccguccuccugcugaucacgcacuacgcgaucaucggccccggccuccaggccaaggccacccgggaggcccagaagcgcaccgccgcggggaucaugaagaacccgaccguggacggcaucaugacgaucgaccuggaccccgugaucuacgacagcaaguucgagaagcagcuggggcaggucaugcuccuggugcugugcgccgugcagcuccugcugaugcggaccuccugggcccucugcgaggcccugacccuggcgaccggccccaucacgacccucugggagggcagccccgggaaguucuggaacaccaccaucgccgucuccauggccaacaucuuccgcggcagcuaccuggccggggccggccuggcguucuccaucaugaaguccguggggacgggcaagcggggcaccgggagccagggcgagacccucggggagaaguggaagaagaagcugaaccagcugucccgcaaggaguucgaccucuacaagaaguccggcaucaccgagguggaccggaccgaggccaaggaggggcugaagcgcggcgagaucacgcaccacgccgucucccggggcagcgccaagcugcagugguucguggagcgcaacauggugaucccggaggggcgggucaucgaccucggcugcgggcgcggcgggugguccuacuacugcgccggccugaagaaggugaccgaggugcggggcuacaccaagggcgggcccgggcacgaggagcccguccccaugagcaccuacggcuggaacaucgugaagcugauguccgggaaggacguguucuaccucccgcccgagaagugcgacacgcugcugugcgacaucggcgagagcucccccagccccaccgucgaggagucccgcaccauccgcgugcugaagaugguggagccguggcucaagaacaaccaguucugcaucaagguccugaaccccuacaugcccaccgugaucgagcaccuggagcggcuccagcgcaagcacggcgggaugcuggugcggaacccccugagccgcaacuccacgcacgagauguacuggaucagcaacggcaccgggaacaucgucgcguccgugaacauggugagccggcuccugcugaaccgcuucaccaugacccaccggcgcccgacgaucgagaaggacgucgaccucggcgccggcacccggcacgugaacgccgagcccgagacccccaacauggacgugaucggggagcgcaucaagcggaucaaggaggagcacaacuccaccuggcacuacgacgacgagaacccguacaagacgugggccuaccacggcagcuacgaggucaaggccaccggguccgcgagcagcaugaucaacggcguggucaagcugcugaccaagcccugggacguggugcccauggucacccagauggccaugacggacaccacccccuucgggcagcagcgcguguucaaggagaagguggacacccggacgccgcgcuccaugcccggcacccggcgcgucaugggcaucaccgccgaguggcucuggcggacccuggggcgcaacaagaagccccggcugugcacgcgcgaggaguucaccaagaaggugcgcaccaacgccgcgaugggcgccguguucaccgaggagaaccagugggacagcgccaaggccgccgucgaggacgaggacuucuggaagcucguggaccgggagcgcgagcugcacaagcuggggaagugcggcuccugcguguacaacaugauggggaagcgggagaagaagcucggcgaguucggcaaggcgaaggggagccgcgccaucugguacauguggcugggcgcccgguaccuggaguucgaggcccucggguuccugaacgaggaccacugguucucccgcgagaacagcuacuccggcgucgagggggagggccugcacaagcucggcuacauccugcgggacaucagcaagauccccgggggcgccauguacgcggacgacacggccgggugggacacccgcaucaccgaggacgaccugcacaacgaggagaagaucacccagcagauggacccggagcaccggcagcucgccaacgccaucuucaagcugacguaccagaacaagguggugaagguccagcgccccacccccaccggcaccgugauggacaucaucucccggaaggaccagcgcggcagcggccaggugggcaccuacgggcugaacacgugccacuccaacauggaggcccagcucauccggcagauggagggcgaggggguccugagcaaggcggaccuggagaacccccaccucuccgagaagaagaucacccaguggcuggagaccaagggcguggagcgccugaagcggauggccaucagcggcgacgacugcguggucaagccgaucgacgaccgcuucgccaacgcccuccuggcccugaacgacauggggaaggugcggaaggacaucccccaguggcagcccuccaagggcuggcacgacuggcagcagguccccuucugcagccaccacuuccacgagcucaucaugaaggacgggcgcaagcuggucgugccgugccggccccaggacgagcugaucggccgcgcgcggaucucccagggggccggcuggagccuccgcgagaccgccugccugggcaaggccuacgcgcagauguggucccugauguacuuccaccgccgggaccuccgccuggccagcaacgccaucugcagcgccgugcccguccacugggugcccacgucccggaccaccuggagcauccacgcccaccaccaguggaugaccacggaggacaugcugaccguguggaaccgcgucuggaucgaggacaacccguggauggaggacaagacccccgugaccacgugggagaacgugcccuaccucgggaagcgggaggaccaguggugcggcucccugaucgggcugaccagccgcgcgaccugggcccagaacauccccaccgccauccagcagguccggucccucaucggcaacgaggaguuccuggacuacaugccgagcaugaagcgcuuccggaaggaggaggaguccgagggggccaucugguga

SEQ ID NO: 10152 - RNA, 9873 nt, Artificial Sequence
  derived and/or modified CDS sequence (opt1) from DENV-3__EU687234__SS-prME
accagccugugccucaugaugauccugcccgcggcgcuggcguuccaccucaccagccgggacggggagccgcggaugaucguggggaagaacgagcggggcaagagccugcuguucaagacggccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaaggugcccuucagcaccgaggacgggcagggcaaggcgcacagcggccgccugaucacggccaaccccguggucaccaagaaggaggagcccgugaacaucgaggccgagccgcccuucggggaguccaacaucgugaucggcaucggggacaacgcccugaagaucaacugguacaagaagggcagcuccaucgggaagauguucgaggcgaccgcccggggcgcccgccggauggccauccugggcgacaccgccugggacuucgggagcgucggcggggugcucaacucccugggcaagauggugcaccagaucuucgggagcgcguacacggcccuguucuccggcgucagcugggugaugaagaucggcaucggggugcuccugaccuggaucggccugaacuccaagaacaccagcauguccuucagcugcaucgucaucgggaucaucacccucuaccugggcgccguggugcaggccgacauggggugcgucaucaacuggaagggcaaggagcugaagugcggcuccgggaucuucgugacgaacgaggugcacaccuggaccgagcaguacaaguuccaggccgacagccccaagcgccucgcgaccgccaucgccggcgccugggagaacggggucugcggcauccgcuccacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacagcuggaagaccugggggaaggcgaagaucgugaccgccgagacccagaacuccagcuucaucaucgacggccccaacacgcccgagugccccuccgccagccgggccuggaacgucugggagguggaggacuacggguucggcguguucaccaccaacaucuggcucaagcugcgcgaggucuacacccagcugugcgaccaccggcucaugagcgcggccgugaaggacgagcgcgccgugcacgccgacaugggcuacuggaucgagucccagaagaacgggagcuggaagcuggagaaggccucccugaucgaggucaagaccugcacguggcccaagucccacacccucugguccaacggcgugcuggagagcgacaugaucauccccaagucccuggcggggcccaucagccagcacaacuaccggccgggcuaccacacccagaccgccgggcccuggcaccucggcaagcuggagcuggacuucaacuacugcgagggcacgaccguggucaucaccgagaacugcgggacccgcggccccucccuccggacgaccaccgugagcgggaagcugauccacgaguggugcugccgcuccugcacccugcccccgcuccgguacaugggcgaggacgggugcugguacggcauggagauccgccccaucagcgagaaggaggagaacauggugaagucccuggucagcgccggcuccgggaagguggacaacuucacgaugggcgugcugugccucgccauccuguucgaggaggucaugcgggggaaguucggcaagaagcacaugaucgccgggguguucuucaccuucgugcugcuccugagcggccagaucaccuggcgcgacauggcgcacacccugaucaugaucggcuccaacgccagcgaccggauggggaugggcgucacguaccucgcccugaucgccaccuucaagauccagcccuuccuggcccucggguucuuccugcgcaagcugaccagccgggagaaccuccugcugggcgugggccucgcgauggccaccacgcugcagcugcccgaggacaucgagcagauggccaacgggaucgcccucggccugauggcgcugaagcucaucacccaguucgagaccuaccagcuguggaccgcccugaucucccucacgugcagcaacaccaucuucacccugaccgucgccuggcgcacggccacccugauccucgccggggugucccugcugccggugugccagagcuccagcaugcggaagaccgacuggcuccccaugaccgucgcggccaugggcgugccgccccucccgcuguucaucuucucccucaaggacacgcugaagcgccgcagcuggccccugaacgagggggugauggccgucggccucguguccauccuggccagcucccugcuccggaacgacgugcccauggccggcccccuggucgccggcgggcugcucaucgccugcuacgugaucaccgggaccagcgccgaccugaccguggagaaggccgccgacgucacgugggaggaggaggcggagcagaccggggugucccacaaccugaugaucaccguggacgacgacgggaccaugcgcaucaaggacgacgagaccgagaacauccucacgguccugcugaagaccgcccuccugaucgugagcggcaucuucccguacuccauccccgccacccugcucguguggcacaccuggcagaagcagacgcagcggagcggcguccugugggacgugcccagcccgcccgagacccagaaggccgagcuggaggaggggguguaccgcaucaagcagcagggcaucuucgggaagacccaggucggcgugggggugcagaaggagggcgucuuccacaccauguggcacgugacgcggggcgccgugcucaccuacaacgggaagcgccuggagcccaacugggcgagcgucaagaaggaccugaucuccuacggcgggggcuggcggcucagcgcccaguggcagaagggggaggagguccaggugaucgccgucgagcccggcaagaaccccaagaacuuccagaccaugcccggcaccuuccagacgaccaccggggagaucggcgccaucgcgcuggacuucaagcccgggaccagcggcucccccaucaucaaccgcgagggcaaggugguggggcuguacggcaacggggucgugacgaagaacggcggguacgugagcggcaucgcccagaccaacgccgagccggacggccccacccccgagcuggaggaggagauguucaagaagcggaaccucaccaucauggaccugcaccccggguccggcaagacgcgcaaguaccugccggccaucguccgggaggccaucaagcgccggcuccgcacccugauccuggcgcccacccgggugguggccgccgagauggaggaggcccucaaggggcugcccauccgcuaccagaccacggccaccaagagcgagcacaccggccgggagaucgucgaccugaugugccacgcgaccuucacgaugcgccuccugucccccgugcgggugccgaacuacaaccugaucaucauggacgaggcccacuucaccgaccccgccagcaucgccgcccgcggguacaucuccacccgggucggcaugggcgaggcggccgccaucuucaugaccgccacgccgcccgggaccgcggacgccuucccgcagagcaacgcccccauccaggacgaggagcgcgacauccccgagcgcuccuggaacagcggcaacgaguggaucaccgacuucgccgggaagaccgugugguucgugcccuccaucaaggccggcaacgacaucgcgaacugccuccggaagaacgggaagaaggucauccagcugagccgcaagacguucgacaccgaguaccagaagaccaagcugaacgacugggacuucguggugaccacggacaucuccgagaugggcgccaacuucaaggccgaccgggucaucgacccgcgccggugccucaagcccgugauccugaccgacggccccgagcgcgugauccuggccgggcccaugccggucaccgccgcgagcgccgcccagcggcgcggccggguggggcgcaacccccagaaggagaacgaccaguacaucuucaccggccagccccucaacaacgacgaggaccacgcccacuggaccgaggccaagaugcugcuggacaacaucaacacgcccgaggggaucaucccggcccucuucgagcccgagcgggagaaguccgccgccaucgacggcgaguaccgccugaagggcgagagccggaagaccuucgucgagcugaugcgccgcggggaccuccccguguggcuggcccacaagguggcguccgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcacguacagcgacccgcuggcccucaaggaguucaaggacuucgccgccggccgcaaguccaucgcgcuggaccuggugaccgagaucgggcgggugcccagccaccucgcccaccgcacccggaacgcccuggacaaccuggucaugcuccacaccagcgagcacggcgggcgcgccuaccggcacgccguggaggagcugcccgagacgauggagacccugcuccugcugggccucaugauccugcugaccgggggcgcgaugcuguuccugaucuccggcaaggggaucggcaagaccagcaucgggcugaucugcgugaucgccuccagcggcaugcucuggauggccgagaucccgcugcaguggaucgccuccgccaucguccuggaguucuucaugauggugcuccugauccccgagcccgagaagcagcgcacgccccaggacaaccagcuggcguacguggucaucgggauccucacccuggccgccaucaucgccgccaacgagaugggccugcucgagaccaccaagcgggaccugggcaugagcaaggagccggggguggugucccccacgagcuaccuggacgucgaccuccaccccgcguccgccuggacccuguacgccguggccaccaccgugaucacgcccaugcugcgccacaccaucgagaacagcaccgcgaacgucucccucgccgccaucgccaaccaggccguggugcugaugggccuggacaagggguggccgaucagcaagauggaccucggcgucccccugcuggcgcucgggugcuacucccaggugaacccccugacccugacggccgccgugcuccugcugaucacccacuacgccaucaucggccccggccuccaggccaaggcgacccgggaggcccagaagcgcaccgccgccgggaucaugaagaacccgacggucgacggcaucaugaccaucgaccuggaccccgugaucuacgacagcaaguucgagaagcagcugggccaggugaugcuccugguccugugcgccgugcagcuccugcugaugcggaccuccugggcgcucugcgaggcccugacccuggccacgggccccaucaccacccucugggagggcagccccgggaaguucuggaacaccacgaucgccguguccauggcgaacaucuuccgcggcagcuaccuggccggggccggccuggccuucuccaucaugaaguccgucgggaccggcaagcggggcaccgggagccagggcgagacccucggggagaaguggaagaagaagcugaaccagcugucccgcaaggaguucgaccucuacaagaaguccggcaucaccgagguggaccggacggaggccaaggaggggcugaagcgcggcgagaucacccaccacgcggugucccggggcagcgccaagcugcagugguucgucgagcgcaacauggugaucccggaggggcgggugaucgaccucggcugcgggcgcggcgggugguccuacuacugcgccggccugaagaaggucaccgaggugcggggcuacaccaagggcgggcccgggcacgaggagcccgugcccaugagcacguacggcuggaacaucgucaagcugauguccgggaaggacguguucuaccucccgcccgagaagugcgacacccugcugugcgacaucggcgagagcucccccagccccaccguggaggagucccgcaccauccgcguccugaagaugguggagccguggcucaagaacaaccaguucugcaucaaggugcugaaccccuacaugcccacggucaucgagcaccuggagcggcuccagcgcaagcacggcgggaugcuggugcggaacccccugagccgcaacuccacccacgagauguacuggaucagcaacggcaccgggaacaucguggccuccgucaacauggugagccggcuccugcugaaccgcuucaccaugacgcaccggcgcccgaccaucgagaaggacguggaccucggcgccggcacccggcacgucaacgcggagcccgagacccccaacauggacgugaucggggagcgcaucaagcggaucaaggaggagcacaacuccacguggcacuacgacgacgagaacccguacaagaccugggccuaccacggcagcuacgaggucaaggccaccggguccgccagcagcaugaucaacggcguggugaagcugcugaccaagcccugggacgucgugcccauggugacgcagauggccaugaccgacaccacccccuucgggcagcagcgcgucuucaaggagaagguggacacgcggaccccgcgcuccaugcccggcacccggcgcgugaugggcaucaccgcggaguggcucuggcggacgcuggggcgcaacaagaagccccggcugugcacccgcgaggaguucaccaagaagguccgcaccaacgccgccaugggcgccguguucacggaggagaaccagugggacagcgcgaaggccgccguggaggacgaggacuucuggauccucgucgaccgggagcgcgagcugcacaagcuggggaagugcggcuccugcguguacaacaugauggggaagcgggagaagaagcucggcgaguucggcaaggccaaggggagccgcgccaucugguacauguggcugggcgcgcgguaccuggaguucgaggcccucggguuccugaacgaggaccacugguucucccgcgagaacagcuacuccggcguggagggggagggccugcacaagcucggcuacauccugcgggacaucagcaagauccccgggggcgccauguacgccgacgacaccgccgggugggacacccgcaucaccgaggacgaccugcacaacgaggagaagaucacgcagcagauggacccggagcaccggcagcucgcguccgccaucuucaagcugaccuaccagaacaaggucgugaaggugcagcgccccacccccaccggcaccgucauggacaucaucagccggaaggaccagcgcggcuccggccaggugggcacguacgggcugaacaccuucaccaacauggaggcccagcucauccggcagauggagggcgagggggugcugagcaaggccgaccuggagaacccccaccucccggagaagaagaucacccaguggcuggagacgaagggcgucgagcgccugaagcggauggccaucuccggcgacgacugcguggugaagcccaucgacgaccgcuucgcgaacgcccuccuggcccugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcccggaucagccagggggccggcuggucccuccgcgagaccgcgugccugggcaaggccuacgcccagauguggagccugauguacuuccaccgccgggaccuccgccuggccuccaacgcgaucugcagcgccgugcccgugcacugggucccgaccagccggaccacgugguccauccacgcccaccaccaguggaugaccaccgaggacaugcugaccguguggaaccgcguguggaucgaggacaaccccuggauggaggacaagacgcccgucaccaccugggagaacgugcccuaccucgggaagcgggaggaccaguggugcggcagccugaucgggcugaccucccgcgccacgugggcccagaacaucccgaccgcgauccagcagguccggagccucaucggcaacgaggaguuccuggacuacaugcccuccaugaagcgcuuccggaaggaggaggagagcgagggggccaucugguga

SEQ ID NO: 10153 - RNA, 9873 nt, Artificial Sequence
  derived and/or modified CDS sequence (opt1) from DENV-3__EU687196__SS-prME
accagccucugccucaugaugauccugcccgccgcccuggcguuccaccucaccagccgggacggggagccccggaugaucguggggaagaacgagcgcggcaagagccugcuguucaagacggccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaccaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagacgugcaccuggccgaagucccacacccucuggagcaacggcgugcuggaguccgacaugaucauccccaagagccuggccgggcccaucucccagcacaacuaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgcgggggugaucuucaccuucguccugcuccuguccggccagaucaccuggcgcgacguggcccacacgcugaucaugaucggcagcaacgccuccgaccggauggggaugggcgugaccuaccucgcccugaucgccaccuucaagauccagcccuuccuggcgcucggguucuuccugcgcaagcugaccagccgggagaaccuccugcugggcgucggccucgccauggccacgacccugcagcugcccgaggacaucgagcagauggccaacgggaucgcgcucggccugauggcccugaagcucaccacccaguucgagacguaccagcuguggaccgcccugaucagccugaccugcuccaacaccaucuucacgcugaccguggccuggcgcaccgccacccugauccucgcgggggucagccugcugccggugugccaguccagcuccaugcggaagacggacuggcuccccaugaccguggccgccaugggcgugccgccccucccgcuguucaucuucagccucaaggacacccugaagcgccgcuccuggccccugaacgagggggugauggccgugggccucgucagcauccuggccuccagccugcuccggaacgacgugcccauggcgggcccccugguggccgggggccugcucaucgccugcuacgucaucaccgggacguccgccgaccugaccguggagaaggccgcggacgugaccugggaggaggaggccgagcagaccggcgucagccacaaccugaugaucaccguggacgacgacgggacgaugcgcaucaaggacgacgagaccgagaacauccucaccgugcugcugaagaccgcccuccugaucgucuccggcaucuucccguacagcauccccgccacgcugcucguguggcacaccuggcagaagcagacccagcgguccggcgugcugugggacguccccagcccgcccgagacccagaaggccgagcuggaggaggggguguaccgcaucaagcagcagggcaucuucgggaagacccaggugggcgucggggugcagaaggagggcguguuccacaccauguggcacgucacccggggcgcggugcucaccuacaacgggaagcgccuggagcccaacugggccuccgugaagaaggaccugaucagcuacggcgggggcuggcggcucuccgcccaguggcagaagggggaggagguccaggugaucgccguggagcccggcaagaaccccaagaacuuccagacgaugcccggcaucuuccagaccaccaccggggagaucggcgcgaucgcccuggacuucaagcccgggacgagcggcagccccaucaucaaccgcgagggcaaggucguggggcuguacggcaacgggguggucaccaagaacggcggguacguguccggcaucgcccagaccaacgccgagccggacggccccacccccgagcuggaggaggagauguucaagaagcggaaccucacgaucauggaccugcaccccgggagcggcaagacccgcaaguaccugccggccaucgugcgggaggcgaucaagcgccggcuccgcacccugauccuggcccccacccgggucguggccgccgagauggaggaggcccucaaggggcugcccauccgcuaccagacgaccgcgaccaaguccgagcacaccggccgggagaucguggaccugaugugccacgccacguucaccaugcgccuccugagccccguccgggugccgaacuacaaccugaucaucauggacgaggcccacuucaccgaccccgccuccaucgccgcgcgcggguacaucagcacccgggugggcaugggcgaggccgccgccaucuucaugacggcgacgccgcccgggaccgccgacgccuucccgcaguccaacgcccccauccaggacgaggagcgcgacauccccgagcgcagcuggaacuccggcaacgaguggaucaccgacuucgccgggaagacggucugguucgugcccagcaucaaggcgggcaacgacaucgccaacugccuccggaagaacgggaagaaggugauccagcugucccgcaagaccuucgacaccgaguaccagaagaccaagcugaacgacugggacuucgucgugacgaccgacaucagcgagaugggcgccaacuucaaggccgaccgggugaucgacccgcgccggugccucaagcccgucauccugaccgacggccccgagcgcgugauccuggccgggcccaugccggugaccgcggccuccgccgcccagcggcgcggccgggucgggcgcaacccccagaaggagaacgaccaguacaucuucaccggccagccccucaacaacgacgaggaccacgcccacuggacggaggcgaagaugcugcuggacaacaucaacacccccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcgcacaagguggccagcgagggcaucaaguacaccgaccgcaaguggugcuucgacgggcagcggaacaaccagauccuggaggagaacauggacguggagaucuggacgaaggagggcgagaagaagaagcuccgcccccgguggcuggacgcccgcaccuacuccgacccgcuggcccucaaggaguucaaggacuucgccgcgggccgcaagagcaucgcccuggaccuggucaccgagaucgggcgggugcccucccaccucgcccaccgcacccggaacgcccuggacaaccuggugaugcuccacaugagcgagcacggcgggaaggccuaccgccacgcggucgaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucgugcuggaguucuucaugaugguccuccugauccccgagcccgagaagcagcggacgccccaggacaaccagcuggccuacguggugaucgggauccucacccuggccgccaucaucgccgcgaacgagaugggccugcucgagaccaccaagcgcgaccugggcauguccaaggagccgggggucgugagccccacguccuaccuggacguggaccuccaccccgccagcgccuggacccuguacgccgucgcgaccaccgugaucacgcccaugcugcggcacaccaucgagaacuccaccgccaacgugagccucgccgccaucgccaaccaggcggucgugcugaugggccuggacaagggguggccgaucuccaagauggaccucggcgugccccugcuggcccucgggugcuacagccaggucaacccccugacccugacggccgccgugcuccugcugaucacccacuacgccaucaucggccccggccuccaggcgaaggccacccgcgaggcccagaagcggaccgccgccgggaucaugaagaacccgacgguggacggcaucaugaccaucgaccuggaccccgucaucuacgacuccaaguucgagaagcagcugggccaggugaugcuccuggugcugugcgcgguccagcuccugcugaugcgcaccagcugggcccucugcgaggcccugacccuggccacgggccccaucaccacccucugggagggcucccccgggaaguucuggaacaccacgaucgcggugagcauggccaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggaguucgaccucuacaagaaguccggcaucaccgaggucgaccgcacggaggcgaaggaggggcugaagcggggcgagaucacccaccacgccgugagccgcggcuccgccaagcugcagugguucguggagcggaacauggucaucccggaggggcgcgugaucgaccucggcugcgggcggggcggguggagcuacuacugcgccggccugaagaaggugaccgagguccgcggcuacaccaagggcgggcccgggcacgaggagcccgugcccauguccacguacggcuggaacaucgugaagcugaugagcgggaaggacgucuucuaccucccgcccgagaagugcgacacccugcugugcgacaucggcgaguccagccccucccccaccguggaggagagccggaccgugcgcguccugaagaugguggagccguggcucaagaacaaccaguucugcaucaaggugcugaaccccuacaugcccacggucaucgagcaccuggagcgccuccagcggaagcacggcgggaugcuggugcgcaacccccugucccggaacagcacccacgagauguacuggaucuccaacggcaccgggaacaucguggccagcgucaacauggugucccgccuccugcugaaccgguucaccaugacgcaccgccggccgaccaucgagaaggacguggaccucggcgcgggcacccgccacgucaacgccgagcccgagacccccaacauggacgugaucggggagcggaucaagcgcaucaaggaggagcacaucagcacguggcacuacgacgacgagaacccguacaagaccugggccuaccacggcuccuacgaggucaaggccaccgggagcgccuccagcaugaucaacggcguggugaagcugcugaccaagcccugggacgucgugcccauggugacgcagauggcgaugaccgacaccacccccuucgggcagcagcgggucuucaaggagaagguggacacgcgcaccccgcggagcaugcccggcacccgccgggugaugggcaucaccgccgaguggcucuggcgcacgcuggggcggaacaagaagccccgccugugcacccgggaggaguucaccaagaagguccgcaccaacgccgccaugggcgcgguguucacggaggagaaccagugggacuccgccaaggccgccguggaggacgaggacuucuggaagcucgucgaccgcgagcgggagcugcacaagcuggggaagugcggcagcugcguguacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgccgacgacaccgcggggugggacacccggaucaccgaggacgaccugcacaacgaggagaagaucacgcagcagauggacccggagcaccgccagcucgccaacgccaucuucaagcugaccuaccagaacaaggucgugaaggugcagcggcccacccccaccggcaccgucauggacaucaucagccgcaaggaccagcggggcuccggccaggugggcacguacgggcugaacaccuucaccaacauggaggcccagcucauccgccagauggagggcgagggggugcugagcaaggccgaccuggagaacccccaccucccggagaagaagaucacccaguggcuggagacgaagggcgucgagcggcugaagcgcauggcgaucuccggcgacgacugcguggugaagcccaucgacgaccgguucgccaacgcccuccuggcccugaacgacauggggaagguccgcaaggacaucccccaguggcagcccagcaagggcuggcacgacuggcagcaggucccguucugcucccaccacuuccacgagcucaucaugaaggacgggcggaagcuggugguccccugccgcccccaggacgagcugaucggccgggcccgcaucagccagggggcgggcugguccuuccgggagaccgccugccucggcaaggccuacgcccagauguggagccugauguacuuccaccgccgcgaccugcggcucgcguccaacgccaucugcagcgccgugcccgugcacugggucccgaccucccgcaccacguggagcauccacgcccaccaccaguggaugaccaccgaggacaugcugaccguguggaaccggguguggaucgaggacaaccccuggauggaggacaagacgcccgucaccaccugggagaacgugcccuaccuggggaagcgcgaggaccaguggugcggcagccucaucgggcugaccucccgggccacgugggcgcagaacaucccgaccgccauccagcagguccgcagccugaucggcaacgaggaguuccucgacuacaugcccuccaugaagcgguuccgcaaggaggaggagagcgagggggccaucugguga

SEQ ID NO: 10154 - RNA, 9873 nt, Artificial Sequence
  derived and/or modified CDS sequence (opt1) from DENV-3__EU854298__SS-prME
accagccugugccucaugaugauccugcccgccgcccuggcguuccaccucaccagccgggacggggagccgcggaugaucguggggaagaacgagcggggcaagagccugcuguucaagaccgccagcgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccaacgccagccgggcguggaacgugugggagguggaggacuacggguucggcgucuucaccaccaacaucuggcucaagcugcgcgaggugcacacccagcugugcgaccaccggcucauguccgccgccgugaaggacgagcgcgccguccacgccgacaugggcuacuggaucgagagccagaagaacgggagcuggaagcuggagaaggcgucccugaucgaggugaagaccugcacguggcccaagucccacacccucugguccaacggcgugcuggagagcgacaugaucauccccaagucccuggccgggcccaucagccagcacaacuaccggccgggcuaccacacccagaccgccgggcccuggcaccucggcaagcuggagcuggacuucaacuacugcgagggcacgaccgucgugaucaccgagaacugcgggacccgcggccccucccuccggacgaccaccgugagcgggaagcugauccacgaguggugcugccgcuccugcacccugcccccgcuccgguacaugggcgaggacgggugcugguacggcauggagauccgccccaucagcgagaaggaggagaacauggucaagucccuggugagcgccggcuccgggaagguggacaacuucacgaugggcguccugugccucgccauccuguucgaggaggugaugcgggggaaguucggcaagaagcacaugaucgcggggguguucuucaccuucguccugcuccugagcggccagaucaccuggcgcgacauggcccacacccugaucaugaucggcuccaacgccagcgaccggauggggaugggcgugacguaccucgcccugaucgccaccuucaagauccagcccuuccuggcgcucggguucuuccugcgcaagcugaccucccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcagcaacaccaucuucacccugaccgucgccuggcgcacggccacccugauccucgcgggggugucccugcugccggucugccagagcuccagcaugcggaagaccgacuggcuccccaugaccguggccgccaugggcgugccgccccucccgcuguucaucuucucccucaaggacacgcugaagcgccgcagcuggccccugaacgagggggucauggccgugggccucguguccauccuggccagcucccugcuccggaacgacguccccauggcgggcccccugguggccgggggccugcucaucgccugcuacgugaucaccgggaccagcgccgaccugaccgucgagaaggccgcggacgugacgugggaggaggaggccgagcagaccggcgugucccacaaccugaugaucaccgucgacgacgacgggaccaugcgcaucaaggacgacgagaccgagaacauccucacggugcugcugaagaccgcccuccugaucgugagcggcaucuucccguacuccauccccgccacccugcucgucuggcacaccuggcagaagcagacgcagcggagcggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucgccuacaacgggaagcgccuggagcccaacugggccagcgugaagaaggaccugaucuccuacggcgggggcuggcggcucagcgcccaguggcagaagggggaggaggugcaggucaucgcgguggagcccggcaagaaccccaagaacuuccagaccauccccggcaccuuccagaccacgaccggggagaucggcgccaucgcccuggacuucaagcccgggaccuccggcagccccaucaucaaccgcgagggcaagguggucgggcuguacggcaacgggguggugaccaagaacggcggguacgucagcggcaucgcccagacgaacgccgagccggacggccccacccccgagcuggaggaggagauguucaagaagcggaaccucaccaucauggaccugcaccccggguccggcaagacccgcaaguaccugccggcgaucgugcgggaggccaucaagcgccggcuccgcacgcugauccuggcccccacccggguggucgccgccgagauggaggaggcgcucaaggggcugcccauccgcuaccagaccaccgccaccaagagcgagcacaccggccgggagaucguggaccugaugugccacgccaccuucaccaugcgccuccugucccccgugcgggucccgaacuacaaccugaucaucauggacgaggcccacuucacggaccccgccagcaucgcggcccgcggguacaucuccacccgggugggcaugggcgaggccgccgcgaucuucaugaccgccacgccgcccgggacggccgacgccuucccgcagagcaacgcccccauccaggacgaggagcgcgacauccccgagcgcuccuggaacagcggcaacgaguggaucaccgacuucgcggggaagaccgugugguucguccccuccaucaaggccggcaacgacaucgccaacugccuccggaagaacgggaagaaggugauccagcugagccgcaagaccuucgacacggaguaccagaagaccaagcugaacgacugggacuucguggucaccaccgacaucuccgagaugggcgccaacuucaaggccgaccgggugaucgacccgcgccggugccucaagcccgugauccugacggacggccccgagcgcgucauccuggcggggcccaugccggugaccgccgccagcgccgcccagcggcgcggccggguggggcgcaacccccagaaggagaacgaccaguacaucuucaccggccagccccucaacaacgacgaggaccacgcgcacuggaccgaggccaagaugcugcuggacaacaucaacacccccgaggggaucaucccggcccucuucgagcccgagcgggagaaguccgccgcgaucgacggcgaguaccgccugaagggcgagagccggaagacguucgucgagcugaugcgccgcggggaccuccccguguggcuggcccacaaggucgccuccgagggcaucaaguacaccgaccgcaaguggugcuucgacgggcagcggaacaaccagauccuggaggagaacauggacguggagaucuggaccaaggagggcgagcgcaagaagcuccggccccgcuggcuggacgcccgcaccuacagcgacccgcuggcccucaaggaguucaaggacuucgcggccggccggaaguccaucgcccuggaccuggugacggagaucgggcgcguccccagccaccucgcccaccggacccgcaacgcccuggacaaccuggugaugcuccacaccuccgagcacggcgggaaggcguaccggcacgccguggaggagcugcccgagaccauggagacgcugcuccugcugggccucaugauccugcugaccgggggcgccaugcuguuccugaucagcggcaaggggaucggcaagaccagcaucgggcugaucugcgucaucgccuccagcggcaugcucuggauggccgagaucccgcugcaguggaucgcguccgccaucgugcuggaguucuucaugauggugcuccugauccccgagcccgagaagcagcgcacgccccaggacaaccagcuggccuacgucgugaucgggauccucacgcuggccgccaucaucgcggccaacgagaugggccugcucgagaccaccaagcgggaccugggcaugagcaaggagccggggguggucucccccaccagcuaccuggacguggaccuccaccccgccuccgccuggacgcuguacgcgguggccaccaccgucaucacccccaugcugcgccacacgaucgagaacagcaccgccaacgugucccucgccgccaucgcgaaccaggccgugguccugaugggccuggacaagggguggccgaucagcaagauggaccucggcgugccccugcuggcccucgggugcuacucccaggugaacccccugacccugaccgccgccguccuccugcugaucacgcacuacgcgaucaucggccccggccuccaggccaaggccacccgggaggcccagaagcgcaccgccgcggggaucaugaagaacccgaccguggacggcaucaugacgaucgaccuggaccccgugaucuacgacagcaaguucgagaagcagcuggggcaggucaugcuccuggugcugugcgccgugcagcuccugcugaugcggaccuccugggcccucugcgaggcccugacccuggcgaccggccccaucacgacccucugggagggcagccccgggaaguucuggaacaccaccaucgccgucuccauggccaacaucuuccgcggcagcuaccuggccggggccggccuggcguucuccaucaugaaguccguggggacgggcaagcggggcaccgggucccagggcgagacccucggggagaaguggaagaagaagcugaaccagcugagccgcaaggaguucgaccucuacaagaaguccggcaucaccgagguggaccggaccgaggccaaggaggggcugaagcgcggcgagaucacgcaccacgccgucucccggggcagcgccaagcugcagugguucguggagcgcaacauggugaucccggaggggcgggucaucgaccucggcugcgggcgcggcgggugguccuacuacugcgccggccugaagaaggugaccgaggugcggggcuacaccaagggcgggcccgggcacgaggagcccguccccaugagcaccuacggcuggaacaucgugaagcugauguccgggaaggacguguucuaccucccgcccgagaagugcgacacgcugcugugcgacaucggcgagagcucccccagccccaccgucgaggagucccgcaccauccgcgugcugaagaugguggagccguggcucaagaacaaccaguucugcaucaagguccugaaccccuacaugcccaccgugaucgagcaccuggagcggcuccagcgcaagcacggcgggaugcuggugcggaacccccugagccgcaacuccacgcacgagauguacuggaucagcaacggcaccgggaacaucgucgcguccgugaacauggugagccggcuccugcugaaccgcuucaccaugacccaccggcgcccgacgaucgagaaggacgucgaccucggcgccggcacccggcacgugaacgccgagcccgagacccccaacauggacgugaucggggagcgcaucaagcggaucaaggaggagcacaacuccaccuggcacuacgacgacgagaacccguacaagacgugggccuaccacggcagcuacgaggucaaggccaccggguccgcgagcuccaugaucaacggcguggucaagcugcugaccaagcccugggacguggugcccauggucacccagauggccaugacggacaccacccccuucgggcagcagcgcguguucaaggagaagguggacacccggacgccgcgcagcaugcccggcacccggcgcgucaugggcaucaccgccgaguggcucuggcggacccuggggcgcaacaagaagccccggcugugcacgcgcgaggaguucaccaagaaggugcgcaccaacgccgcgaugggcgccguguucaccgaggagaaccagugggacagcgccaaggccgccgucgaggacgaggacuucuggaagcucguggaccgggagcgcgagcugcacaagcuggggaagugcggcuccugcguguacaacaugauggggaagcgggagaagaagcucggcgaguucggcaaggcgaaggggagccgcgccaucugguacauguggcugggcgcccgguaccuggaguucgaggcccucggguuccugaacgaggaccacugguucucccgcgagaacagcuacuccggcgucgagggggagggccugcacaagcucggcuacauccugcgggacaucagcaagauccccgggggcgccauguacgcggacgacacggccgggugggacacccgcaucaccgaggacgaccugcacaacgaggagaagaucacccagcagauggacccggagcaccggcagcucgccaacgccaucuucaagcugacguaccagaacaagguggugaagguccagcgccccacccccaccggcaccgugauggacaucaucucccggaaggaccagcgcggcagcggccaggugggcaccuacgggcugaacacguucaccaacauggagguccagcucauccggcagauggagggcgagggggugcuguccaaggccgaccuggagaacccccaccucccggagaagaagaucacccaguggcuggagaccaagggcguggagcgccugaagcggauggcgaucagcggcgacgacugcgucgugaagcccaucgacgaccgcuucgccaacgcccuccuggcccugaacgacauggggaaggugcggaaggacaucccccaguggcagcccuccaagggcuggcacgacuggcagcaggucccguucugcagccaccacuuccacgagcucaucaugaaggacgggcgcaagcugguggugcccugccggccccaggacgagcugaucggccgcgcccggaucucccagggggcgggcuggagccuccgcgagacggccugccugggcaaggccuacgcccagauguggucccugauguacuuccaccgccgggaccuccgccuggcgagcaacgccaucugcuccgccguccccgugcacugggugccgaccagccggaccaccugguccauccacgcccaccaccaguggaugacgaccgaggacaugcugaccgucuggaaccgcguguggaucgaggacaaccccuggauggaggacaagacccccgugacgaccugggagaacguccccuaccucgggaagcgggaggaccaguggugcggcagccugaucgggcugaccagccgcgccaccugggcgcagaacaucccgacggccauccaccaggugcggucccucaucggcaacgaggaguuccuggacuacaugcccagcaugaagcgcuuccggaaggaggaggagcuggagggggccaucugguga

SEQ ID NO: 10155 - RNA, 9873 nt, Artificial Sequence
  derived and/or modified CDS sequence (opt1) from DENV-3__FJ373306__SS-prME
accagccucugccucaugaugauccugcccgcggcgcuggcguuccaccucaccagccgggacggcgagccgcggaugaucguggggaagaacgagcgcggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacgugggcaccucccucacccagaagguggucaucuucauccugcugaugcucgugacgcccagcaugaccaugcggugcgugggggucggcaaccgcgacuucguggagggccuguccggggccaccuggguggacgucgugcuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccguccugccggaggagcaggaccagaacuacgugugcaagcacaccuacguggaccggggguggggcaacgggugcggccucuucgggaagggcucccuggugaccugcgccaaguuccagugccuggagcccaucgagggcaagguggugcaguacgagaaccucaaguacaccgucaucaucacggugcacaccggggaccagcaccaggucggcaacgagacccagggggugaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggucaccuucaagaacgcccacgccaagaagcaggagguggugguccuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucgugcugaagaaggagguguccgagacccagcacgggaccauccucaucaaggucgaguacaagggcgaggacgugccgugcaaggugcccuucagcaccgaggacgggcagggcaaggcgcacaacggccgccugaucacggccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacaccgccugggacuucggguccgugggcggggugcucaacagccugggcaagaugguccaccagaucuucggguccgcguacacggcccuguucagcggcguguccugggugaugaagaucggcaucgggguccuccugaccuggaucggccugaacagcaagaacaccuccaugagcuucuccugcaucgugaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggccgacucccccaagcgccucgcgaccgccaucgccggcgccugggagaacggggugugcggcauccgcagcacgacccggauggagaaccugcuguggaagcagaucgccaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggcgaagaucgucaccgccgagacccagaacagcuccuucaucaucgacggccccaacacgcccgagugccccagcgccucccgggccuggaacgugugggagguggaggacuacggguucggcgucuucagcaccaacaucuggcucaagcugcgcgagguguacacccagcugugcgaccaccggcucaugagcgcggccgugaaggacgagcgcgccguccacgccgacaugggcuacuggaucgagucccagaagaacgggagcuggaagcuggagaaggccucccugaucgaggugaagaccugcaccuggcccaagucccacacgcucugguccaacggcgugcuggagagcgacaugaucauccccaagucccuggcggggcccaucagccagcacaacuaccggccgggcuaccacacccagaccgccgggcccuggcaccucggcaagcuggagcuggacuucaacuacugcgagggcaccacggucgugaucaccgagaacugcgggacccgcggccccucccuccggaccacgaccgugagcgggaagcugauccacgaguggugcugccgcuccugcacccugcccccgcuccgguacaugggcgaggacgggugcugguacggcauggagauccgccccaucagcgagaaggaggagaacauggucaagucccuggugagcgccggcuccgggaagguggacaacuucaccaugggcguccugugccucgccauccuguucgaggaggugaugcgggggaaguucggcaagaagcacaugaucgccgggguguucuucacguucguccugcuccugagcggccagaucaccuggcgcgacauggcgcacacccugaucaugaucggcuccaacgccagcgaccggauggggaugggcgugaccuaccucgcccugaucgccacguucaagauccagcccuuccuggcccucggguucuuccugcgcaagcugaccagccgggagaaccuccugcugggcgucggccucgcgauggccaccacccugcagcugcccgaggacaucgagcagauggccaacgggaucgcccucggccugauggcgcugaagcucaucacgcaguucgagaccuaccagcuguggaccgcccugaucucccugaccugcagcaacacgaucuucacccugaccguggccuggcgcaccgccacgcugauccucgccggggugucccugcugccggucugccagagcuccagcaugcggaagaccgacuggcuccccaugaccguggcggccaugggcgugccgccccucccgcuguucaucuucucccucaaggacacccugaagcgccgcagcuggccccugaacgagggggucauggccgugggccucguguccauccuggccagcucccugcuccggaacgacguccccauggccggcccccugguggccggcgggcugcucaucgccugcuacgugaucacggggaccagcgccgaccugaccgucgagaaggccgccgacgugaccugggaggaggaggcggagcagacgggggugucccacaaccugaugaucaccgucgacgacgacgggaccaugcgcaucaaggacgacgagaccgagaacauccucaccgugcugcugaagacggcccuccugaucgugagcggcaucuucccguacuccauccccgccacccugcucgucuggcacaccuggcagaagcagacccagcggagcggcgugcugugggacgugcccagcccgcccgagacgcagaaggccgagcuggaggagggggucuaccgcaucaagcagcagggcaucuucgggaagacccaggugggcguggggguccagaaggagggcguguuccacaccauguggcacgugacccggggcgccguccucacguacaacgggaagcgccuggagcccaacugggcgagcgugaagaaggaccugaucuccuacggcgggggcuggcggcucagcgcccaguggcagaagggggaggaggugcaggucaucgccguggagcccggcaagaaccccaagaacuuccagaccaugcccggcaccuuccagaccacgaccggggagaucggcgccaucgcgcuggacuucaagcccgggaccagcggcucccccaucaucaaccgcgagggcaagguggucgggcuguacggcaacgggguggugaccaagaacggcggguacgucagcggcaucgcccagacgaacgccgagccggacggccccacccccgagcuggaggaggagauguucaagaagcggaaccucaccaucauggaccugcaccccggguccggcaagacccgcaaguaccugccggccaucgugcgggaggccaucaagcgccggcuccgcacgcugauccuggcgcccacccggguggucgccgccgagauggaggaggcccucaaggggcugcccauccgcuaccagaccaccgccaccaagagcgagcacaccggccgggagaucguggaccugaugugccacgcgaccuucaccaugcgccuccugucccccgugcgggucccgaacuacaaccugaucaucauggacgaggcccacuucacggaccccgccagcaucgccgcccgcggguacaucuccacccgggugggcaugggcgaggcggccgccaucuucaugaccgccacgccgcccgggacggcggacgccuucccgcagagcaacgcccccauccaggacgaggagcgcgacauccccgagcgcuccuggaacagcggcaacgaguggaucaccgacuucgccgggaagaccgugugguucguccccuccaucaaggccggcaacgacaucgcgaacugccuccggaagaacgggaagaaggugauccagcugagccgcaagaccuucgacacggaguaccagaagaccaagcugaacgacugggacuucguggucaccaccgacaucuccgagaugggcgccaacuucaaggccgaccgggugaucgacccgcgccggugccucaagcccgugauccugacggacggccccgagcgcgucauccuggccgggcccaugccggugaccgccgcgagcgccgcccagcggcgcggccgggucgggcgcaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgggagaaguccgccgccaucgacggcgaguaccgccugaagggcgagagccggaagacguucguggagcugaugcgccgcggggaccuccccguguggcuggcccacaaggucgcguccgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcaccuacagcgacccgcuggcccucaaggaguucaaggacuucgccgccggccgcaaguccaucgcgcuggaccuggugacggagaucgggcggguccccagccaccucgcccaccgcacccggaacgcccuggacaaccuggugaugcuccacaccagcgagcacggcgggaaggccuaccgccacgccguggaggagcugcccgagaccauggagacgcugcuccugcugggccucaugauccugcugaccgggggcgcgaugcuguuccugaucuccggcaaggggaucggcaagaccagcaucgggcugaucugcgucaucgccuccagcggcaugcucuggauggccgagaucccgcugcaguggaucgccuccgccaucgugcuggaguucuucaugauggugcuccugauccccgagcccgagaagcagcggacgccccaggacaaccagcuggcguacgucgugaucgggauccucacgcuggccgccaucaucgccgccaacgagaugggccugcucgagaccaccaagcgcgaccugggcaugagcaaggagccggggguggucucccccaccagcuaccuggacguggaccuccaccccgcguccgccuggacgcuguacgccguggccaccaccgucaucacccccaugcugcggcacacgaucgagaacagcaccgcgaacgugucccucgccgccaucgccaaccaggccgugguccugaugggccuggacaagggguggccgaucagcaagauggaccucggcgugccccugcuggcgcucgggugcuacucccaggugaacccccugacccugaccgccgccguccuccugcugaucacgcacuacgccaucaucggccccggccuccaggccaaggcgacccgcgaggcccagaagcggaccgccgccgggaucaugaagaacccgaccguggacggcaucaugacgaucgaccuggaccccgugaucuacgacagcaaguucgagaagcagcuggggcaggucaugcuccuggugcugugcgccgugcagcuccugcugaugcgcaccuccugggcgcucugcgaggcccugacccuggccaccggccccaucacgacccucugggagggcagccccgggaaguucuggaacaccaccaucgccgucuccauggcgaacaucuuccggggcagcuaccuggccggggccggccuggccuucuccaucaugaaguccguggggacgggcaagcgcggcaccgggagccagggcgagacccucggggagaaguggaagaagaagcugaaccagcugucccggaaggaguucgaccucuacaagaaguccggcaucaccgagguggaccgcaccgaggccaaggaggggcugaagcggggcgagaucacgcaccacgcggucucccgcggcagcgccaagcugcagugguucguggagcggaacauggugaucccggaggggcgcgucaucgaccucggcugcgggcggggcgggugguccuacuacugcgccggccugaagaaggugaccgaggugcgcggcuacaccaagggcgggcccgggcacgaggagcccguccccaugagcaccuacggcuggaacaucgugaagcugauguccgggaaggacguguucuaccucccgcccgagaagugcgacacgcugcugugcgacaucggcgagagcucccccagccccaccgucgaggagucccggaccauccgcgugcugaagaugguggagccguggcucaagaacaaccaguucugcaucaagguccugaaccccuacaugcccaccgugaucgagcaccuggagcgccuccagcggaagcacggcgggaugcuggugcgcaacccccugagccggaacuccacgcacgagauguacuggaucagcaacggcaccgggaacaucgucgccuccgugaacauggugagccgccuccugcugaaccgguucaccaugacccaccgccggccgacgaucgagaaggacgucgaccucggcgccggcacccgccacgugaacgcggagcccgagacccccaacauggacgucaucggggagcggaucaagcgcaucaaggaggagcacaacuccaccuggcacuacgacgacgagaacccguacaagacgugggccuaccacggcagcuacgaggugaaggccaccggguccgccagcagcaugaucaacggcguggucaagcugcugaccaagcccugggacguggugcccauggucacccagauggccaugacggacaccacccccuucgggcagcagcggguguucaaggagaagguggacacccgcacgccgcgguccaugcccggcacccgccgggucaugggcaucaccgcggaguggcucuggcgcacccuggggcggaacaagaagccccgccugugcacgcgggaggaguucaccaagaaggugcgcaccaacgccgccaugggcgccguguucaccgaggagaaccagugggacagcgcgaaggccgccgucgaggacgaggacuucuggauccucguggaccgcgagcgggagcugcacaagcuggggaagugcggcuccugcguguacaacaugauggggaagcgcgagaagaagcucggcgaguucggcaaggccaaggggagccgggccaucugguacauguggcugggcgcgcgcuaccuggaguucgaggcccucggguuccugaacgaggaccacugguucucccgggagaacagcuacuccggcgucgagggggagggccugcacaagcucggcuacauccugcgcgacaucagcaagauccccgggggcgccauguacgccgacgacacggccgggugggacacccggaucaccgaggacgaccugcacaacgaggagaagaucacccagcagauggacccggagcaccgccagcucgcgaacgccaucuucaagcugacguaccagaacaagguggugaagguccagcggcccacccccaccggcaccgugauggacaucaucucccgcaaggaccagcggggcagcggccaggugggcaccuacgggcugaacacguucaccaacauggaggcccagcucauccgccagauggagggcgaggggguccuguccaaggccgaccuggagaacccccaccucccggagaagaagaucacccaguggcuggagaccaagggcguggagcggcugaagcgcauggccaucagcggcgacgacugcguggucaagcccaucgacgaccgguucgcgaacgcccuccuggcccugaacgacauggggaaggugcgcaaggacaucccccaguggcagcccuccaagggcuggcacgacuggcagcaggucccguucugcagccaccacuuccacgagcucaucaugaaggacgggcggaagcuggucgugcccugccgcccccaggacgagcugaucggccgggcccgcaucucccagggggccggcuggagccuccgggagacggcgugccugggcaaggccuacgcccagauguggucccugauguacuuccaccgccgcgaccuccggcuggccagcaacgcgaucugcuccgccgugcccguccacugggugccgaccagccgcaccaccuggagcauccacgcccaccaccaguggaugacgaccgaggacaugcugaccguguggaaccgggucuggaucgaggacaaccccuggauggaggacaagacccccgugacgaccugggagaacgugcccuaccucgggaagcgcgaggaccaguggugcggcucccugaucgggcugaccagccgggccaccugggcccagaacaucccgacggcgauccagcagguccgcucccucaucggcaacgaggaguuccuggacuacaugcccagcaugaagcgguuccgcaaggaggaggaguccgagggggccaucugguga

SEQ ID NO: 10156 - RNA, 9873 nt, Artificial Sequence
  derived and/or modified CDS sequence (opt1) from DENV-3__EU687197__SS-prME
accagccugugccucaugaugauccugcccgccgcccuggcguuccaccucaccagccgcgacggggagccgcggaugaucguggggaagaacgagcgcggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcguggugaacuggaagggcaaggagcugaagugcggcagcgggaucuucgucacgaacgaggugcacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccgucguggugggggacaucaucggcguccucgagcagggcaagcgcacccugacgccccagccgauggagcugaaguacuccuggaagaccugggggaaggccaagaucgugaccgccgagacccagaacagcuccuucaucaucgacggccccaacacgcccgagugccccaacgccagccgggcguggaacgugugggaggucgaggacuacggguucggcguguucaccaccaacaucuggcucaagcugcgcgagguguacacccagcugugcgaccaccggcucauguccgccgccgucaaggacgagcgcgccgugcacgccgacaugggcuacuggaucgagagccagaagaacgggagcuggaagcuggagaaggcgucccugaucgaggugaagaccugcacguggcccaagucccacacccucugguccaacggcguccuggagagcgacaugaucauccccaagucccuggccgggcccaucagccagcacaacuaccggccgggcuaccacacccagaccgccgggcccuggcaccucggcaagcuggagcuggacuucaacuacugcgagggcacgaccguggugaucaccgagaacugcgggacccgcggccccucccuccggacgaccaccgucagcgggaagcugauccacgaguggugcugccgcuccugcacccugcccccgcuccgguacaugggcgaggacgggugcugguacggcauggagauccgccccaucagcgagaaggaggagaacauggugaagucccuggugagcgccggcuccgggaaggucgacaacuucacgaugggcgugcugugccucgccauccuguucgaggaggugaugcgggggaaguucggcaagaagcacaugaucgcgggggucuucuucaccuucgugcugcuccugagcggccagaucaccuggcgcgacauggcccacacccugaucaugaucggcuccaacgccagcgaccggauggggaugggcgugacguaccucgcccugaucgccaccuucaagauccagcccuuccuggcgcucggguucuuccugcgcaagcugaccucccgggagaaccuccugcugggcgucggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcagcaacaccaucuucacccugaccguggccuggcgcacggccacccugauccucgcgggggucucccugcugccggugugccagagcuccagcaugcggaagaccgacuggcuccccaugaccguggccgccaugggcgugccgccccucccgcuguucaucuucucccucaaggacacgcugaagcgccgcagcuggccccugaacgagggggugauggccgugggccucgucuccauccuggccagcucccugcuccggaacgacgugcccauggcgggcccccugguggccgggggccugcucaucgccugcuacgucaucaccgggaccagcgccgaccugaccguggagaaggccgcggacgugacgugggaggaggaggccgagcagaccggcgucucccacaaccugaugaucaccguggacgacgacgggaccaugcgcaucaaggacgacgagaccgagaacauccucacggugcugcugaagaccgcccuccugaucgucagcggcaucuucccguacuccauccccgccacccugcucguguggcacaccuggcagaagcagacgcagcggagcggcgugcugugggacguccccagcccgcccgagacccagaaggccgagcuggaggaggggguguaccgcaucaagcagcagggcaucuucgggaagacccaggugggcgucggggugcagaaggagggcguguuccacaccauguggcacgucacgcggggcgcggugcucgccuacaacgggaagcgccuggagcccaacugggccagcgugaagaaggaccugaucuccuacggcgggggcuggcggcucagcgcccaguggcagaagggggaggagguccaggugaucgcgguggagcccggcaagaaccccaagaacuuccagaccaugcccggcaccuuccagaccacgaccggggagaucggcgccaucgcccuggacuucaagcccgggaccuccggcagccccaucaucaaccgcgagggcaaggucguggggcuguacggcaacgggguggucaccaagaacggcggguacgugagcggcaucgcccagacgaacgccgagccggacggccccacccccgagcuggaggaggagauguucaagaagcggaaccucaccaucauggaccugcaccccggguccggcaagacccgcaaguaccugccggcgaucgugcgggaggccaucaagcgccggcuccgcacgcugauccuggcccccacccgggucguggccgccgagauggaggaggcgcucaaggggcugcccauccgcuaccagaccaccgccaccaagagcgagcacaccggccgggagaucguggaccugaugugccacgccaccuucaccaugcgccuccugucccccguccgggugccgaacuacaaccugaucaucauggacgaggcccacuucacggaccccgccagcaucgcggcccgcggguacaucuccacccgggugggcaugggcgaggccgccgcgaucuucaugaccgccacgccgcccgggacggccgacgccuucccgcagagcaacgcccccauccaggacgaggagcgcgacauccccgagcgcuccuggaacagcggcaacgaguggaucaccgacuucgcggggcggaccgucugguucgugcccuccaucaaggccggcaacgacaucgccaacugccuccgcaagaacgggaagaaggugauccagcugagccggaagaccuucgacacggaguaccagaagaccaagcugaacgacugggacuucgucgugaccaccgacaucuccgagaugggcgccaacuucaaggccgaccgcgugaucgacccgcggcgcugccucaagcccgucauccugacggacggccccgagcgggugauccuggcggggcccaugccggugaccgccgccagcgccgcccagcgccggggccgcgucgggcggaacccccagaaggagaacgaccaguacaucuucaccggccagccccucaacaacgacgaggaccacgcgcacuggaccgaggccaagaugcugcuggacaacaucaacacccccgaggggaucaucccggcccucuucgagcccgagcgcgagaaguccgccgcgaucgacggcgaguaccggcugaagggcgagagccgcaagacguucguggagcugaugcggcgcggggaccuccccgucuggcuggcccacaagguggccuccgagggcaucaaguacaccgaccggaaguggugcuucgacgggcagcgcaacaaccagauccuggaggagaacauggacguggagaucuggaccaaggagggcgagcggaagaagcuccgcccccgcuggcuggacgcccggaccuacagcgacccgcuggcccucaaggaguucaaggacuucgcggccggccgcaaguccaucgcccuggaccuggucacggagaucgggcgggugcccagccaccucgcccaccgcacccggaacgcccuggacaaccuggugaugcuccacaccuccgagcacggcgggaaggcguaccgccacgccgucgaggagcugcccgagaccauggagacgcugcuccugcugggccucaugauccugcugaccgggggcgccaugcuguuccugaucagcggcaaggggaucggcaagaccagcaucgggcugaucugcgugaucgccuccagcggcaugcucuggauggccgagaucccgcugcaguggaucgcguccgccaucgugcuggaguucuucaugaugguccuccugauccccgagcccgagaagcagcggacgccccaggacaaccagcuggccuacguggugaucgggauccucacgcuggccgccaucaucgcggccaacgagaugggccugcucgagaccaccaagcgcgaccugggcaugagcaaggagccgggggucgugucccccaccagcuaccuggacguggaccuccaccccgccuccgccuggacgcuguacgcggucgccaccaccgugaucacccccaugcugcggcacacgaucgagaacagcaccgccaacgugucccucgccgccaucgcgaaccaggccgucgugcugaugggccuggacaagggguggccgaucagcaagauggaccucggcgugccccugcuggcccucgggugcuacucccaggucaacccccugacccugaccgccgccgugcuccugcugaucacgcacuacgcgaucaucggccccggccuccaggccaaggccacccgcgaggcccagaagcggaccgccgcggggaucaugaagaacccgaccguggacggcaucaugacgaucgaccuggaccccgucaucuacgacagcaaguucgagaagcagcugggccaggugaugcuccuggugcugugcgccguccagcuccugcugaugcgcaccuccugggcccucugcgaggcccugacccuggcgaccggccccaucacgacccucugggagggcagccccgggaaguucuggaacaccaccaucgccguguccauggccaacaucuuccggggcagcuaccuggccggggccggccuggcguucuccaucaugaaguccguggggacgggcaagcgcggcaccgggucccagggcgagacccucggggagaaguggaagaagaagcugaaccagcugagccggaaggaguucgaccucuacaagaaguccggcaucaccgaggucgaccgcaccgaggccaaggaggggcugaagcggggcgagaucacgcaccacgccgugucccgcggcagcgccaagcugcagugguucguggagcggaacauggucaucccggaggggcgcgugaucgaccucggcugcgggcggggcgggugguccuacuacugcgccggccugaagaaggugaccgagguccgcggcuacaccaagggcgggcccgggcacgaggagcccgugcccaugagcaccuacggcuggaacaucgugaagcugauguccgggaaggacgucuucuaccucccgcccgagaagugcgacacgcugcugugcgacaucggcgagagcucccccagccccaccguggaggagucccgcaccauccgggugcugaagauggucgagccguggcucaagaacaaccaguucugcaucaaggugcugaaccccuacaugcccaccgugaucgagcaccuggagcgccuccagcggaagcacggcgggaugcugguccgcaacccccugagccggaacuccacgcacgagauguacuggaucagcaacggcaccgggaacaucguggcguccgugaacauggucagccgccuccugcugaaccgguucaccaugacccaccgccggccgacgaucgagaaggacguggaccucggcgccggcacccgccacgugaacgccgagcccgagacccccaacauggacgucaucggggagcggaucaagcgcaucaaggaggagcacaacuccaccuggcacuacgacgacgagaacccguacaagacgugggccuaccacggcagcuacgaggugaaggccaccggguccgcgagcuccaugaucaacggcgucgugaagcugcugaccaagcccugggacgugguccccauggugacccagauggccaugacggacaccacccccuucgggcagcagcggguguucaaggagaaggucgacacccgcacgccgcggagcaugcccggcacccgccgggugaugggcaucaccgccgaguggcucuggcgcacccuggggcggaacaagaagccccgccugugcacgcgcgaggaguucaccaagaaggugcggaccaacgccgcgaugggcgccgucuucaccgaggagaaccagugggacagcgccaaggccgccguggaggacgaggacuucuggaagcucguggaccgcgagcgggagcugcacaagcuggggaagugcggcuccugcgucuacaacaugauggggaagcgcgagaagaagcucggcgaguucggcaaggcgaaggggagccgggccaucugguacauguggcugggcgcccgcuaccuggaguucgaggcccucggguuccugaacgaggaccacugguucucccgggagaacagcuacuccggcguggagggggagggccugcacaagcucggcuacauccugcgcgacaucagcaagauccccgggggcgccauguacgcggacgacacggccgggugggacacccggaucaccgaggacgaccugcacaacgaggagaagaucacccagcagauggacccggagcaccgccagcucgccaacgccaucuucaagcugacguaccagaacaagguggucaaggugcagcggcccacccccaccggcaccgugauggacaucaucucccgcaaggaccagcggggcagcgggcaggucggcaccuacgggcugaacacguucaccaacauggaggugcagcucauccgccagauggagggcgagggggugcuguccaaggccgaccuggagaacccccaccucccggagaagaagaucacccaguggcuggagaccaagggcgucgagcggcugaagcgcauggcgaucagcggcgacgacugcguggugaagcccaucgacgaccgguucgccaacgcccuccuggcccugaacgacauggggaagguccgcaaggacaucccccaguggcagcccuccaagggcuggcacgacuggcagcaggucccguucugcagccaccacuuccacgagcucaucaugaaggacgggcggaagcuggugguccccugccgcccccaggacgagcugaucggccgggcccgcaucucccagggggcgggcuggagccuccgcgagacggccugccugggcaaggccuacgcccagauguggucccugauguacuuccaccggcgcgaccuccggcuggcgagcaacgccaucugcuccgccgugcccgugcacugggucccgaccagccgcaccaccugguccauccacgcccaccaccaguggaugacgaccgaggacaugcugaccguguggaaccggguguggaucgaggacaaccccuggauggaggacaagacccccgucacgaccugggagaacgugcccuaccucgggaagcgcgaggaccaguggugcggcagccugaucgggcugaccagccgggccaccugggcgcagaacaucccgacggccauccaccaggugcgcucccucaucggcaacgaggaguuccuggacuacaugcccagcaugaagcgguuccgcaaggaggaggagcuggagggggccaucugguga

SEQ ID NO: 10157 - RNA, 9873 nt, Artificial Sequence
  derived and/or modified CDS sequence (opt1) from DENV-3__EU687198__SS-prME
accagccugugccucaugaugauccugcccgccgcccuggccuuccaccucaccagccgggacggggagccccggaugaucguggggaagaacgagcgcggcaagagccugcuguucaagaccgccagcgggaucaacaugugcacccucaucgccauggaccugggcgagaugugcgacgacaccgugaccuacaagugcccccacaucgccgagguggagcccgaggacaucgacugcuggugcaaccugaccagcaccugggugaccuacgggaccugcaaccaggccggcgagcaccggcgcgacaagcgguccguggcgcucgcgccccacgugggcauggggcuggacacgcgcacccagaccuggaugagcgccgagggcgccuggcggcaggucgagaaggucgagaccugggcgcugcgccacccgggguucacgauccucgcccuguuccuggcccacuacaucggcaccucccucacccagaagguggugaucuucauccugcugaugcucgucacccccagcaugacgaugcggugcgugggggugggcaaccgcgacuucgucgagggccuguccggggccaccuggguggacgugguccuggagcacggcgggugcgugaccaccauggccaagaacaagcccacgcucgacaucgagcugcagaagaccgaggcgacccagcuggccacccuccggaagcugugcaucgagggcaagaucacgaacaucaccaccgacagccgcugccccacccagggcgaggccgugcugccggaggagcaggaccagaacuacgucugcaagcacacguacguggaccggggguggggcaacgggugcggccucuucgggaagggcucccuggugaccugcgccaaguuccagugccuggagcccaucgagggcaaggucgugcaguacgagaaccucaaguacaccgugaucaucaccguccacacgggggaccagcaccaggugggcaacgagacccagggggucaccgccgagaucacgccccaggcgagcacgaccgaggccauccugcccgaguacggcacccuggggcucgagugcuccccgcgcaccggccuggacuucaacgagaugauccugcucaccaugaagaacaaggccuggauggugcaccggcagugguucuucgaccugccccugcccuggacgagcggcgccaccaccgagacccccacguggaaccgcaaggagcuccuggugaccuucaagaacgcccacgcgaagaagcaggaggucguggugcuggggucccaggagggcgccaugcacaccgcccucaccggggccacggagauccagaacagcggcgggaccuccaucuucgccggccaccugaagugccggcugaagauggacaagcucgagcugaagggcaugagcuacgcgaugugcaccaacaccuucguccugaagaaggagguguccgagacgcagcacgggaccauccucaucaagguggaguacaagggcgaggacgucccgugcaagauccccuucagcaccgaggacgggcagggcaaggcccacaacggccgccugaucaccgccaaccccguggugacgaagaaggaggagcccgucaacaucgaggccgagccgcccuucggggagagcaacaucgugaucggcgugggggacaacgcgcugaagaucaacugguacaagaagggcuccagcaucgggaagauguucgaggccaccgcccggggcgcccgccggauggccauccugggcgacaccgcgugggacuucggguccgucggcggggugcucaacagccugggcaagauggugcaccagaucuucggguccgccuacaccgcccuguucagcggcgucuccugggugaugaagaucggcaucggggugcuccugacguggaucggccugaacagcaagaacaccuccaugagcuucuccugcaucgccaucgggaucaucacccucuaccugggcgccgucgugcaggcggacaccgggugcgugaucaacuggaagggcaaggagcugaagugcggcagcgggaucuucgucacgaacgaggugcacaccuggaccgagcaguacaaguuccaggccgacucccccaagcgccucgccaccgccaucgccggcgcgugggagaacggggugugcggcauccgcagcacgacccggauggagaaccugcuguggaagcagaucgccaacgagcucaacuacauccugugggagaacaacaucaagcugaccgucguggugggggacaucaucggcguccucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgcgucccgggccuggaacgugugggaggucgaggacuacggguucggcguguucaccaccaacaucuggcucaagcugcgcgagguguacacccagcugugcgaccaccggcucaugagcgccgccgucaaggacgagcgcgccgugcacgcggacaugggcuacuggaucgagagccagaagaacggguccuggaagcuggagaaggccagccugaucgaggugaagaccugcacguggccgaagucccacacccucuggagcaacggcguccuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaaggucgacaacuucacgaugggcgugcugugccucgcgauccuguucgaggaggugaugcgggggaaguucggcaagaagcacaugaucgccggggucuucuucaccuucgugcugcuccuguccggccagaucaccuggcgcgacauggcccacacccugaucaugaucggcagcaacgccuccgaccggauggggaugggcgugacguaccucgcccugaucgcgaccuucaagauccagcccuuccuggcccucggguucuuccugcgcaagcugaccagccgggagaaccuccugcugggcgucggccucgccauggccaccacgcugcagcugcccgaggacaucgagcagauggcgaacgggaucgcccucggccugauggcccugaagcucaucacccaguucgagaccuaccagcuguggaccgcccugaucagccucacgugcuccaacaccaucuucacccugaccguggccuggcgcacggcgacccugauccucgccggggucagccugcugccggugugccaguccagcuccaugcggaaguccgacuggcuccccaugaccguggccgccaugggcgugccgccccucccgcuguucaucuucucccucaaggacacccugaagcgccgcagcuggccccugaacgagggggugauggccgugggccucgucuccauccuggcgagcucccugcuccggaacgacgugcccauggccggcccccugguggccgggggccugcucaucgccugcuacgucaucacggggaccagcgccgaccugaccguggagaaggcggccgacgugaccugggaggaggaggccgagcagacgggcgucucccacaaccugaugaucaccguggacgacgacgggaccaugcgcaucaaggacgacgagaccgagaacauccucaccgugcugcugaagacggcccuccugaucgucagcggcaucuucccguacuccauccccgccacccugcucguguggcacaccuggcagaagcagacccggcgcagcggcgugcugugggacguccccagcccgcccgagacgcagaaggcggagcuggaggaggggguguaccggaucaagcagcagggcaucuucgggaagacccaggugggcgucggggugcagaaggagggcguguuccacaccauguggcacgucacccgcggcgccgugcucacguacaacgggaagcggcuggagcccaacugggccagcgugaagaaggaccugaucuccuacggcgggggcuggcgccucagcgcccaguggcagaagggggaggagguccaggugaucgcgguggagcccggcaagaaccccaagaacuuccagaccaugcccggcaccuuccagaccacgaccggggagaucggcgccaucgcccuggacuucaagcccgggaccagcggcucccccaucaucaaccgggagggcaaggucguggggcuguacggcaacgggguggucaccaagaacggcggguacgugagcggcaucgcccagacgaacgccgagccggacggccccacccccgagcuggaggaggagauguucaagaagcgcaaccucaccaucauggaccugcaccccggguccggcaagacccggaaguaccugccggcgaucgugcgcgaggccaucaagcggcgccuccggacgcugauccuggcccccacccgcgucguggccgccgagauggaggaggcgcucaaggggcugcccauccgguaccagaccaccgccaccaagagcgagcacaccggccgcgagaucguggaccugaugugccacgccaccuucaccaugcggcuccugucccccguccgcgugccgaacuacaaccugaucaucauggacgaggcccacuucacggaccccgccagcaucgcggcccggggguacaucuccacccgcgugggcaugggcgaggccgccgcgaucuucaugaccgccacgccgcccgggacggccgacgccuucccgcagagcaacgcccccauccaggacgaggagcgcgacauccccgagcgguccuggaacagcggcaacgaguggaucaccgacuucgcggggaagaccgucugguucgugcccuccaucaaggccggcaacgacaucgccaacugccuccgcaagaacgggaagaaggugauccagcugagccggaagaccuucgacacggaguaccagaagacccgccugaacgacugggacuucgucgugaccaccgacaucuccgagaugggcgccaacuucaaggccgaccgggugaucgacccgcgccggugccucaagcccgucauccugacggacggccccgagcgcgugauccuggcggggcccaugccggugaccgccgccagcgccgcccagcggcgcggccgggucgggcgcaacccccagaaggagaacgaccaguacaucuucaccggccagccccucaacaacgacgaggaccacgcgcacuggaccgaggccaagaugcugcuggacaacaucaacacccccgaggggaucaucccggcccucuucgagcccgagcgggagaaguccgccgcgaucgacggcgaguaccgccugaagggcgagagccggaagacguucguggagcugaugcgccgcggggaccuccccgucuggcuggcccacaagguggccuccgagggcaucaaguacaccgaccgcaaguggugcuucgacgggcagcggaacaaccagauccuggaggagaacauggacguggagaucuggaccaaggagggcgagaagaagaagcuccgcccccgcuggcuggacgcccggaccuacagcgacccgcuggcccucaaggaguucaaggacuucgcggccggccgcaaguccaucgcccuggaccuggucacggagaucgggcgggugcccagccaccucgcccaccgcacccggaacgcccuggacaaccuggugaugcuccacaccagcgagcacggcgggaaggcguaccgccacgccgucgaggagcugcccgagaccauggagacgcugcuccugcugggccucaugauccugcugaccgggggcgccaugcuguuccugaucuccggcaaggggaucggcaagaccagcaucgggcugaucugcgugaucgccuccagcggcaugcucuggauggccgagaucccgcugcaguggaucgcguccgccaucgugcuggaguucuucaugaugguccuccugauccccgagcccgagaagcagcggacgccccaggacaaccagcuggccuacguggugaucgggauccucacgcuggccgccaucaucgcggccaacgagaugggccugcucgagaccaccaagcgcgaccugggcaugagcaaggagccgggggucgugucccccaccagcuaccuggacguggaccuccaccccgccuccgccuggacgcuguacgcggucgccaccaccgugaucacccccaugcugcggcacacgaucgagaacagcaccgccaacgugucccucgccgccaucgcgaaccaggccgucgugcugaugggccuggacaagggguggccgaucagcaagauggaccucggcgugccccugcuggcccucgggugcuacucccaggucaacccccugacccugaccgccgccgugcuccugcugaucacgcacuacgcgaucaucggccccggccuccaggccaaggccacccgcgaggcccagaagcggaccgccgcggggaucaugaagaacccgaccguggacggcaucaugacgaucgaccuggaccccgucaucuacgacagcaaguucgagaagcagcugggccaggugaugcuccuggugcugugcgccguccagcuccugcugaugcgcaccuccugggcccucugcgaggcccugacccuggcgaccggccccaucacgacccucugggagggcagccccgggaaguucuggaacaccaccaucgccguguccauggccaacaucuuccggggcagcuaccuggccggggccggccuggcguucuccaucaugaaguccguggggacgggcaagcgcggcaccgggagccagggcgagacccucggggagaaguggaagaagaagcugaaccagcugucccggaaggaguucgaccucuacaagaaguccggcaucaccgaggucgaccgcaccgaggccaaggaggggcugaagcggggcgagaucacgcaccacgccgugucccgcggcagcgccaagcugcagugguucguggagcggaacauggucaucccggaggggcgcgugaucgaccucggcugcgggcggggcgggugguccuacuacugcgccggccugaagaaggugaccgagguccgcggcuacaccaagggcgggcccgggcacgaggagcccgugcccaugagcaccuacggcuggaacaucgugaagcugauguccgggaaggacgucuucuaccucccgcccgagaagugcgacacgcugcugugcgacaucggcgagagcucccccagccccaccguggaggagucccgcaccauccgggugcugaagauggucgagccguggcucaagaacaaccaguucugcaucaaggugcugaaccccuacaugcccaccgugaucgagcaccuggagcgccuccagcggaagcacggcgggaugcugguccgcaacccccugagccggaacuccacgcacgagauguacuggaucagcaacggcaccgggaacaucguggcguccgugaacauggucagccgccuccugcugaaccgguucaccaugacccaccgccggccgacgaucgagaaggacguggaccucggcgccggcacccgccacgugaacgccgagcccgagacccccaacauggacgucaucggggagcggaucaagcgcaucaaggaggagcacaacuccaccuggcacuacgacgacgagaacccguacaagacgugggccuaccacggcagcuacgaggugaaggccaccggguccgcgagcagcaugaucaacggcgucgugaagcugcugaccaagcccugggacgugguccccauggugacccagauggccaugacggacaccacccccuucgggcagcagcggguguucaaggagaaggucgacacccgcacgccgcgguccaugcccggcacccgccgggugaugggcaucaccgccgaguggcucuggcgcacccuggggcggaacaagaagccccgccugugcacgcgcgaggaguucaccaagaaggugcggaccaacgccgcgaugggcgccgucuucaccgaggagaaccagugggacagcgccaaggccgccguggaggacgaggacuucuggaagcucguggaccgcgagcgggagcugcacaagcuggggaagugcggcuccugcgucuacaacaugauggggaagcgcgagaagaagcucggcgaguucggcaaggcgaaggggagccgggccaucugguacauguggcugggcgcccgcuaccuggaguucgaggcccucggguuccugaacgaggaccacugguucucccgggagaacagcuacuccggcguggagggggagggccugcacaagcucggcuacauccugcgcgacaucagcaagauccccgggggcgccauguacgcggacgacacggccgggugggacacccggaucaccgaggacgaccugcacaacgaggagaagaucacccagcagauggacccggagcaccgccagcucgccaacgccaucuucaagcugacguaccagaacaagguggucaaggugcagcggcccacccccaccggcaccgugauggacaucaucucccgcaaggaccagcggggcagcgggcaggucggcaccuacgggcugaacacguucaccaacauggaggcccagcucauccgccagauggagggcgagggggugcuguccaaggcggaccuggagaacccccaccucagcgagaagaagaucacccaguggcuggagaccaagggcguggagcggcugaagcgcauggccaucuccggcgacgacugcgucgugaagccgaucgacgaccgguucgccaacgcccuccuggcccugaacgacauggggaaggugcgcaaggacaucccccaguggcagcccagcaagggcuggcacgacuggcagcagguccccuucugcucccaccacuuccacgagcucaucaugaaggacgggcggaagcugguggugccgugccgcccccaggacgagcugaucggccgggcgcgcaucagccagggggccggcuggucccuccgcgagacggccugccugggcaaggccuacgcgcagauguggagccugauguacuuccaccggcgcgaccuccggcuggccuccaacgccaucugcagcgccguccccgugcacugggugcccaccagccgcaccaccugguccauccacgcccaccaccaguggaugacgaccgaggacaugcugaccgucuggaaccggguguggaucgaggacaacccguggauggaggacaagacccccgugacgaccugggagaacguccccuaccucgggaagcgcgaggaccaguggugcggcagccugaucgggcugaccucccgggcgaccugggcccagaacauccccacggccauccagcagguccgcagccucaucggcaacgaggaguuccuggacuacaugccguccaugaagcgguuccgcaaggaggaggagagcgagggggccaucugguga

SEQ ID NO: 10158 - RNA, 9873 nt, Artificial Sequence
  derived and/or modified CDS sequence (opt1) from DENV-3__EU726769__SS-prME
accagccugugccucaugaugauccugcccgcggcgcuggcguuccaccucaccagccgggacggcgagccgcggaugaucguggggaagaacgagcggggcaagagccugcuguucaagacggccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgugaucgggaucaucacccucuaccugggcgccgucgugcaggccgacauggggugcgugaucaacuggaagggcaaggagcugaagugcggcagcgggaucuucgucacgaacgaggugcacaccuggaccgagcaguacaaguuccaggccgacucccccaagcgccucgcgaccgccaucgccggcgccugggagaacggggugugcggcauccgcagcacgacccggauggagaaccugcuguggaagcagaucgccaacgagcucaacuacauccugugggagaacaacaucaagcugaccgucguggugggggacaucaucggcguccucgagcagggcaagcgcacccugacgccccagccgauggagcugaaguacuccuggaagaccugggggaaggcgaagaucgugaccgccgagacccagaacagcuccuucaucaucgacggccccaacacgcccgagugccccagcgccucccgggccuggaacgugugggaggucgaggacuacggguucggcguguucaccaccaacaucuggcucaagcugcgcgagguguacacccagcugugcgaccaccggcucaugagcgcggccgucaaggacgagcgcgccgugcacgccgacaugggcuacuggaucgagagccagaagaacggguccuggaagcuggagaaggccagccugaucgaggugaagaccugcacguggccgaagucccacacccucuggagcaacggcguccuggaguccgacaugaucauccccaagagccuggcggggcccaucucccagcacaacuaccggccgggcuaccacacccagaccgccgggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaaggucgacaacuucacgaugggcgugcugugccucgccauccuguucgaggaggugaugcgggggaaguucggcaagaagcacauggucgccgggguguucuucaccuucgugcugcuccuguccggccagaucaccuggcgcgacauggcgcacacccugaucauggucggcagcaacgccuccgaccggauggggaugggcgugacguaccucgcccugaucgccaccuucaagauccagcccuuccuggcccucggguucuuccugcgcaagcugaccagccgggagaaccuccugcugggcgucggccucgcgauggccaccacgcugcagcugcccgaggacaucgagcagauggccaacgggaucgcccucggccugauggcgcugaagcucaucacccaguucgagaccuaccagcuguggaccgcccugaucagccucacgugcuccaacaccaucuucacccugaccguggccuggcgcacggccacccugauccucgccggggugagccugcugccggucugccaguccagcuccaugcggaagaccgacuggcuccccaugaccguggcggccaugggcgugccgccccucccgcuguucaucuucagccucaaggacacgcugaagcgccgcuccuggccccugaacgagggggucauggccgugggccucgugagcauccuggccuccagccugcuccggaacgacguccccauggccggcccccugguggccggcgggcugcucaucgccugcuacgugaucaccgggaccuccgccgaccugaccgucgagaaggccgccgacgugacgugggaggaggaggcggagcagaccggggugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgccguccucaccuacaacgggaagcgccuggagcccaacugggcguccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgccaucgcgcuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggccaucaagcgccggcuccgcacccugauccuggcgcccacccggguggucgccgccgagauggaggaggcccucaaggggcugcccauccgcuaccagaccacggccaccaaguccgagcacaccggccgggagaucguggaccugaugugccacgcgaccuucacgaugcgccuccugagccccgugcgggucccgaacuacaaccugaucaucauggacgaggcccacuucaccgaccccgccuccaucgccgcccgcggguacaucagcacccgggugggcaugggcgaggcggccgccaucuucaugaccgccacgccgcccgggaccgcggacgccuucccgcaguccaacgcccccauccaggacgaggagcgcgacauccccgagcgcagcuggaacuccggcaacgaguggaucaccgacuucgccgggaagaccgugugguucguccccagcaucaaggccggcaacgacaucgcgaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggccgggcccaugccggugaccgccgcguccgccgcccagcggcgcggccgggucgggcgcaacccccagaaggagaacgaccaguacaucuucaccggccagccccucaacaacgacgaggaccacgcccacuggaccgaggccaagaugcugcuggacaacaucaacacgcccgaggggaucaucccggcccucuucgagcccgagcgggagaaguccgccgccaucgacggcgaguaccgccugaagggcgagucccggaagaccuucguggagcugaugcgccgcggggaccuccccguguggcuggcccacaaggucgcgagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgccggccgcaagagcaucgcgcuggaccuggugaccgagaucgggcggguccccucccaccucgcccaccgcacccggaacgcccuggacaaccuggugaugcuccacaccagcgagcacggcgggaaggccuaccgccacgccguggaggagcugcccgagacgauggagacccugcuccugcugggccucaugauccugcugaccgggggcgcgaugcuguuccugaucagcggcaaggggaucggcaagaccuccaucgggcugaucugcgucaucgccagcuccggcaugcucuggaucgccgagaucccgcugcaguggaucgccagcgccaucgugcuggaguucuucaugauggugcuccugauccccgagcccgagaagcagcggacgccccaggacaaccagcuggcguacgucgugaucgggauccucacccuggccgccaucaucgccgccaacgagaugggccugcucgagaccaccaagcgcgaccugggcauguccaaggagccggggguggucagccccacguccuaccuggacguggaccuccaccccgcgagcgccuggacccuguacgccguggccaccaccgucaucacgcccaugcugcggcacaccaucgagaacuccaccgcgaacgugagccucgccgccaucgccaaccaggccgugguccugaugggccuggacaagggguggccgaucuccaagauggaccucggcgugccccugcuggcgcucgggugcuacagccaggugaacccccugacccugacggccgccguccuccugcugaucacccacuacgccaucaucggccccggccuccaggccaaggcgacccgcgaggcccagaagcggaccgccgccgggaucaugaagaacccgacgguggacggcaucaugaccaucgaccuggaccccgugaucuacgacuccaaguucgagaagcagcuggggcaggucaugcuccuggugcugugcgccgugcagcuccugcugaugcgcaccagcugggcgcucugcgaggcccugacccuggccacgggccccaucaccacccucugggagggcucccccgggaaguucuggaacaccacgaucgccgucagcauggcgaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggaguucgaccucuacaagaaguccggcaucaccgagguggaccgcacggaggccaaggaggggcugaagcggggcgagaucacccaccacgcggucagccgcggcuccgccaagcugcagugguucguggagcggaacauggugaucccggaggggcgcgucaucgaccucggcugcgggcggggcggguggagcuacuacugcgccggccugaagaaggugaccgaggugcgcggcuacaccaagggcggccccgggcacgaggagcccguccccauguccacguacggcuggaacaucgugaagcugaugagcgggaaggacguguucuaccucccgcccgagaagugcgacacccugcugugcgacaucggcgaguccagccccucccccaccgucgaggagagccggaccauccgcgugcugaagaugguggagccguggcucaagaacaaccaguucugcaucaagguccugaaccccuacaugcccacggugaucgagcaccuggagcgccuccagcggaagcacggcgggaugcuggugcgcaacccccugucccggaacagcacccacgagauguacuggaucuccaacggcaccgggaacaucgucgccagcgugaacauggugucccgccuccugcugaaccgguucaccaugacguaccgccggccgaccaucgagaaggacgucgaccucggcgccggcacccgccacgugaacgcggagcccgagacccccaacauggacgucaucggggagcggaucaagcgcaucaaggaggagcacaacagcacguggcacuacgacgacgagaacccguacaagaccugggccuaccacggcuccuacgaggugaaggccaccgggagcgccuccagcaugaucaacggcguggucaagcugcugaccaagcccugggacguggugcccauggucacgcagauggccaugaccgacaccacccccuucgggcagcagcggguguucaaggagaagguggacacgcgcaccccgcggagcaugcccggcacccgccgggucaugggcaucaccgcggaguggcucuggcgcacgcuggggcggaacaagaagccccgccugugcacccgggaggaguucaccaagaaggugcgcaccaacgccgccaugggcgccguguucacggaggagaaccagugggacuccgcgaaggccgccgucgaggacgaggacuucuggauccucguggaccgcgagcgggagcugcacaagguggggaagugcggcagcugcgucuacaacaugauggggaagcgcgagaagaagcugggcgaguucggcaaggccaaggggucccgggccaucugguacauguggcucggcgcgcgcuaccuggaguucgaggcccugggguuccucaacgaggaccacugguucagccgggagaacuccuacagcggcguggagggggagggccugcacaagcugggcuacauccuccgcgacaucuccaagauccccgggggcgccauguacgccgacgacaccgccgggugggacacccggaucaccgaggacgaccugcacaacgaggagaagaucacgcagcagauggacccggagcaccgccagcuggcgaacgccaucuucaagcucaccuaccagaacaagguggucaaggugcagcggcccacccccaccggcaccgugauggacaucaucagccgcaaggaccagcggggcuccgggcaggucggcacguacgggcugaacaccuucaccaacauggaggcccagcugauccgccagauggagggcgagggggugcucagcaaggccgaccuggagaacccccaccuccccgagaagaagaucacccaguggcuggagacgaagggcguggagcggcugaagcgcauggccaucuccggcgacgacugcgucgugaagcccaucgacgaccgguucgcgaacgcccugcucgcccugaacgacauggggaaggugcgcaaggacaucccccaguggcagcccagcaagggcuggcacgacuggcagcaggucccguucugcucccaccacuuccacgagcugaucaugaaggacgggcggaagcucguggugcccugccgcccccaggacgagcugaucggccgggcccgcaucagccagggggccggcuggucccugcgggagaccgcgugccucggcaaggccuacgcccagauguggagccugauguacuuccaccgccgcgaccugcggcucgccuccaacgcgaucugcagcgccguccccgugcacugggugccgaccucccgcaccacguggagcauccacgcccaccaccaguggaugaccaccgaggacaugcugaccgucuggaaccggguguggaucgaggacaaccccuggauggaggacaagacgcccgugaccaccugggagaacguccccuaccuggggaagcgcgaggaccaguggugcggcagccucaucgggcugaccucccgggccacgugggcccagaacaucccgaccgcgauccagcagguccgcagccugaucggcaacgaggaguuccucgacuacaugcccuccaugaagcgguuccgcaaggaggaggagagcgagggggccaucugguga

SEQ ID NO: 10159 - RNA, 9873 nt, Artificial Sequence
  derived and/or modified CDS sequence (opt1) from DENV-3__EU687239__SS-prME
accagccugugccucaugaugauccugcccgccgcccuggccuuccaccucaccagccgcgacggggagccccggaugaucguggggaagaacgagcgcggcaagagccugcuguucaagaccgccagcgggaucaacaugugcacccucaucgccauggaccugggggagaugugcgacgacaccgugaccuacaagugcccccacaucgccgagguggagcccgaggacaucgacugcuggugcaaccugaccagcaccugggugaccuacgggaccugcaaccaggccggcgagcaccggcgcgacaagcgguccguggcgcucgcgccccacgugggcauggggcuggacacgcgcacccagaccuggaugagcgccgagggcgccuggcggcaggucgagaagguggagaccugggcgcugcgccacccgggguucacgauccucgcccuguuccuggcccacuacaucggcaccucccucacccagaagguggugaucuucauccugcugaugcucgucacccccagcaugacgaugcggugcgugggggugggcaaccgcgacuucgucgagggccuguccggggccaccuggguggacgugguccuggagcacggcgggugcgugaccaccauggccaagaacaagcccacgcucgacaucgagcugcagaagaccgaggcgacccagcuggccacccuccggaagcugugcaucgagggcaagaucacgaacaucaccaccgacagccgcugccccacccagggcgaggccgugcugccggaggagcaggaccagaacuacgucugcaagcacacguacguggaccggggguggggcaacgggugcggccucuucgggaagggcucccuggugaccugcgccaaguuccagugccuggagcccaucgagggcaaggucgugcaguacgagaaccucaaguacaccgugaucaucaccguccacacgggggaccagcaccaggugggcaacgagacccagggggucaccgccgagaucacgccccaggcgagcacgaccgaggccauccugcccgaguacggcacccuggggcucgagugcuccccgcgcaccggccuggacuucaacgagaugauccugcucaccaugaagaacaaggccuggauggugcaccggcagugguucuucgaccugccccugcccuggacgagcggcgccaccaccgagacccccacguggaaccgcaaggagcuccuggugaccuucaagaacgcccacgcgaagaagcaggaggucguggugcuggggucccaggagggcgccaugcacaccgcccucaccggggccacggagauccagaacagcggcgggaccuccaucuucgccggccaccugaagugccggcugaagauggacaagcucgagcugaagggcaugagcuacgcgaugugcaccaacaccuucguccugaagaaggagguguccgagacgcagcacgggaccauccucaucaagguggaguacaagggcgaggacgucccgugcaagauccccuucagcaccgaggacgggcagggcaaggcccacaacggccgccugaucaccgccaaccccguggugacgaagaaggaggagcccgucaacaucgaggccgagccgcccuucggggagagcaacaucgugaucggcgugggggacaacgcgcugaagaucaacugguacaagaagggcuccagcaucgggaagauguucgaggccaccgcccggggcgcccgccggauggccauccugggcgacaccgcgugggacuucggguccgucggcggggugcucaacagccugggcaagauggugcaccagaucuucggguccgccuacaccgcccuguucagcggcgucuccugggugaugaagaucggcaucggggugcuccugacguggaucggccugaacagcaagaacaccuccaugagcuucuccugcaucgccaucgggaucaucacccucuaccugggcgccgucgugcaggcggacaccgggugcgugaucaacuggaagggcaaggagcugaagugcggcagcgggaucuucgucacgaacgaggugcacaccuggaccgagcaguacaaguuccaggccgacucccccaagcgccucgccaccgccaucgccggcgcgugggagaacggggugugcggcauccgcagcacgacccggauggagaaccugcuguggaagcagaucgccaacgagcucaacuacauccugugggagaacaacaucaagcugaccgucguggugggggacaucaucggcguccucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgcgucccgggccuggaacgugugggaggucgaggacuacggguucggcguguucaccaccaacaucuggcucaagcugcgcgagguguacacccagcugugcgaccaccggcucaugagcgccgccgucaaggacgagcgcgccgugcacgcggacaugggcuacuggaucgagagccagaagaacggguccuggaagcuggagaaggccagccugaucgaggugaagaccugcacguggccgaagucccacacccucuggagcaacggcguccuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaaggucgacaacuucacgaugggcgugcugugccucgcgauccuguucgaggaggugaugcgggggaaguucggcaagaagcacaugaucgccggggucuucuucaccuucgugcugcuccuguccggccagaucaccuggcgcgacauggcccacacccugaucaugaucggcagcaacgccuccgaccggauggggaugggcgugacguaccucgcccugaucgcgaccuucaagauccagcccuuccuggcccucggguucuuccugcgcaagcugaccagccgggagaaccuccugcugggcgucggccucgccauggccaccacgcugcagcugcccgaggacaucgagcagauggcgaacgggaucgcccucggccugauggcccugaagcucaucacccaguucgagaccuaccagcuguggaccgcccugaucagccucacgugcuccaacaccaucuucacccugaccguggccuggcgcacggcgacccugauccucgccggggucagccugcugccggugugccaguccagcuccaugcggaaguccgacuggcuccccaugaccguggccgccaugggcgugccgccccucccgcuguucaucuucucccucaaggacacccugaagcgccgcagcuggccccugaacgagggggugauggccgugggccucgucuccauccuggcgagcucccugcuccggaacgacgugcccauggccggcccccugguggccgggggccugcucaucgccugcuacgucaucacggggaccagcgccgaccugaccguggagaaggcggccgacgugaccugggaggaggaggccgagcagacgggcgucucccacaaccugaugaucaccguggacgacgacgggaccaugcgcaucaaggacgacgagaccgagaacauccucaccgugcugcugaagacggcccuccugaucgucagcggcaucuucccguacuccauccccgccacccugcucguguggcacaccuggcagaagcagacccggcgcagcggcgugcugugggacguccccagcccgcccgagacgcagaaggcggagcuggaggaggggguguaccggaucaagcagcagggcaucuucgggaagacccaggugggcgucggggugcagaaggagggcguguuccacaccauguggcacgucacccgcggcgccgugcucacguacaacgggaagcggcuggagcccaacugggccagcgugaagaaggaccugaucuccuacggcgggggcuggcgccucagcgcccaguggcagaagggggaggagguccaggugaucgcgguggagcccggcaagaaccccaagaacuuccagaccaugcccggcaccuuccagaccacgaccggggagaucggcgccgucgcccuggacuucaagcccgggaccagcggcucccccaucaucaaccgggagggcaaggugguggggcuguacggcaacggggucgugaccaagaacggcggguacgugagcggcaucgcccagacgaacgccgagccggacggccccacccccgagcuggaggaggagauguucaagaagcgcaaccucaccaucauggaccugcaccccggguccggcaagacccggaaguaccugccggcgaucguccgcgaggccaucaagcggcgccuccggacgcugauccuggcccccacccgcgugguggccgccgagauggaggaggcgcucaaggggcugcccauccgguaccagaccaccgccaccaagagcgagcacaccggccgcgagaucgucgaccugaugugccacgccaccuucaccaugcggcuccugucccccgugcgcgugccgaacuacaaccugaucaucauggacgaggcccacuucacggaccccgccagcaucgcggcccggggguacaucuccacccgcgucggcaugggcgaggccgccgcgaucuucaugaccgccacgccgcccgggacggccgacgccuucccgcagagcaacgcccccauccaggacgaggagcgcgacauccccgagcgguccuggaacagcggcaacgaguggaucaccgacuucgcggggaagaccgugugguucgugcccuccaucaaggccggcaacgacaucgccaacugccuccgcaagaacgggaagaaggucauccagcugagccggaagaccuucgacacggaguaccagaagaccaagcugaacgacugggacuucguggugaccaccgacaucuccgagaugggcgccaacuucaaggccgaccgcgucaucgacccgcggcgcugccucaagcccgugauccugacggacggccccgagcgggugauccuggcggggcccaugccggucaccgccgccagcgccgcccagcgccggggccgcguggggcggaacccccagaaggagaacgaccaguacaucuucaccggccagccccucaacaacgacgaggaccacgcgcacuggaccgaggccaagaugcugcuggacaacaucaacacccccgaggggaucaucccggcccucuucgagcccgagcgcgagaaguccgccgcgaucgacggcgaguaccggcugaagggcgagagccgcaagacguucgucgagcugaugcggcgcggggaccuccccguguggcuggcccacaagguggccuccgagggcaucaaguacaccgaccggaaguggugcuucgacgggcagcgcaacaaccagauccuggaggagaacauggacgucgagaucuggaccaaggagggcgagaagaagaagcuccggccccgcuggcuggacgcccgcaccuacagcgacccgcuggcccucaaggaguucaaggacuucgcggccggccggaaguccaucgcccuggaccuggugacggagaucgggcgcgugcccagccaccucgcccaccggacccgcaacgcccuggacaaccuggucaugcuccacaccagcgagcacggcgggaaggcguaccggcacgccguggaggagcugcccgagaccauggagacgcugcuccugcugggccucaugauccugcugaccgggggcgccaugcuguuccugaucuccggcaaggggaucggcaagaccagcaucgggcugaucugcgugaucgccuccagcggcaugcucuggauggccgagaucccgcugcaguggaucgcguccgccaucguccuggaguucuucaugauggugcuccugauccccgagcccgagaagcagcgcacgccccaggacaaccagcuggccuacguggucaucgggauccucacgcuggccgccaucaucgcggccaacgagaugggccugcucgagaccaccaagcgggaccugggcaugagcaaggagccggggguggugucccccaccagcuaccuggacgucgaccuccaccccgccuccgccuggacgcuguacgcgguggccaccaccgugaucacccccaugcugcgccacacgaucgagaacagcaccgccaacgucucccucgccgccaucgcgaaccaggccguggugcugaugggccuggacaagggguggccgaucagcaagauggaccucggcgucccccugcuggcccucgggugcuacucccaggugaacccccugacccugaccgccgccgugcuccugcugaucacgcacuacgcgaucaucggccccggccuccaggccaaggccacccgggaggcccagaagcgcaccgccgcggggaucaugaagaacccgaccgucgacggcaucaugacgaucgaccuggaccccgugaucuacgacagcaaguucgagaagcagcugggccaggugaugcuccugguccugugcgccgugcagcuccugcugaugcggaccuccugggcccucugcgaggcccugacccuggcgaccggccccaucacgacccucugggagggcagccccgggaaguucuggaacaccaccaucgccguguccauggccaacaucuuccgcggcagcuaccuggccggggccggccuggcguucuccaucaugaaguccgucgggacgggcaagcggggcaccgggagccagggcgagacccucggggagaaguggaagaagaagcugaaccagcugucccgcaaggaguucgaccucuacaagaaguccggcaucaccgagguggaccggaccgaggccaaggaggggcugaagcgcggcgagaucacgcaccacgccgugucccggggcagcgccaagcugcagugguucgucgagcgcaacauggugaucccggaggggcgggugaucgaccucggcugcgggcgcggcgggugguccuacuacugcgccggccugaagaaggucaccgaggugcggggcuacaccaagggcgggcccgggcacgaggagcccgugcccaugagcaccuacggcuggaacaucgucaagcugauguccgggaaggacguguucuaccucccgcccgagaagugcgacacgcugcugugcgacaucggcgagagcucccccagccccaccguggaggagucccgcaccauccgcguccugaagaugguggagccguggcucaagaacaaccaguucugcaucaaggugcugaaccccuacaugcccaccgucaucgagcaccuggagcggcuccagcgcaagcacggcgggaugcuggugcggaacccccugagccgcaacuccacgcacgagauguacuggaucagcaacggcaccgggaacaucguggcguccgucaacauggugagccggcuccugcugaaccgcuucaccaugacccaccggcgcccgacgaucgagaaggacguggaccucggcgccggcacccggcacgucaacgccgagcccgagacccccaacauggacgugaucggggagcgcaucaagcggaucaaggaggagcacaacuccaccuggcacuacgacgacgagaacccguacaagacgugggccuaccacggcagcuacgaggucaaggccaccggguccgcgagcagcaugaucaacggcguggugaagcugcugaccaagcccugggacgucgugcccauggugacccagauggccaugacggacaccacccccuucgggcagcagcgcgucuucaaggagaagguggacacccggacgccgcgcuccaugcccggcacccggcgcgugaugggcaucaccgccgaguggcucuggcggacccuggggcgcaacaagaagccccggcugugcacgcgcgaggaguucaccaagaagguccgcaccaacgccgcgaugggcgccguguucaccgaggagaaccagugggacagcgccaaggccgccguggaggacgaggacuucuggaagcucgucgaccgggagcgcgagcugcacaagcuggggaagugcggcuccugcguguacaacaugauggggaagcgggagaagaagcucggcgaguucggcaaggcgaaggggagccgcgccaucugguacauguggcugggcgcccgguaccuggaguucgaggcccucggguuccugaacgaggaccacugguucucccgcgagaacagcuacuccggcguggagggggagggccugcacaagcucggcuacauccugcgggacaucagcaagauccccgggggcgccauguacgcggacgacacggccgggugggacacccgcaucaccgaggacgaccugcacaacgaggagaagaucacccagcagauggacccggagcaccggcagcucgccaacgccaucuucaagcugacguaccagaacaaggucgugaaggugcagcgccccacccccaccggcaccgucauggacaucaucucccggaaggaccagcgcggcagcggccaggugggcaccuacgggcugaacacguucaccaacauggaggcccagcucauccggcagauggagggcgagggggugcuguccaaggcggaccuggagaacccccaccucagcgagaagaagaucacccaguggcuggagaccaagggcgucgagcgccugaagcggauggccaucuccggcgacgacugcguggugaagccgaucgacgaccgcuucgccaacgcccuccuggcccugaacgacauggggaagguccggaaggacaucccccaguggcagcccagcaagggcuggcacgacuggcagcagguccccuucugcucccaccacuuccacgagcucaucaugaaggacgggcgcaagcugguggucccgugccggccccaggacgagcugaucggccgcgcgcggaucagccagggggccggcuggucccuccgcgagacggccugccugggcaaggccuacgcgcagauguggagccugauguacuuccaccgccgggaccuccgccuggccuccaacgccaucugcagcgccgugcccgugcacuggguccccaccagccggaccaccugguccauccacgcccaccaccaguggaugacgaccgaggacaugcugaccguguggaaccgcguguggaucgaggacaacccguggauggaggacaagacccccgucacgaccugggagaacgugcccuaccucgggaagcgggaggaccaguggugcggcagccugaucgggcugaccucccgcgcgaccugggcccagaacauccccacggccauccagcagguccggagccucaucggcaacgaggaguuccuggacuacaugccguccaugaagcgcuuccggaaggaggaggagagcgagggggucaucugguga

SEQ ID NO: 10160 - RNA, 9873 nt, Artificial Sequence
  derived and/or modified CDS sequence (opt1) from DENV-3__FJ182004__SS-prME
accagccugugccucaugaugauccugcccgccgcccuggccuuccaccucaccagccgggacggggagccccggaugaucguggggaagaacgagcgcggcaagagccugcuguucaagaccgccagcgggaucaacaugugcacccucaucgccauggaccugggcgagaugugcgacgacaccgugaccuacaagugcccccacaucgccgagguggagcccgaggacaucgacugcuggugcaaccugaccagcaccugggugaccuacgggaccugcaaccaggccggcgagcaccggcgcgacaagcgguccguggcgcucgcgccccacgugggcauggggcuggacacgcgcacccagaccuggaugagcgccgagggcgccuggcgccagguggagaaggucgagaccugggcgcugcgccacccgggguucacgauccucgcccuguuccuggcccacuacaucggcaccucccucacccagaagguggugaucuucauccugcugaugcucgucacccccagcaugacgaugcggugcgugggggugggcaaccgcgacuucgucgagggccuguccggggccaccuggguggacgugguccuggagcacggcgggugcgugaccaccauggccaagaacaagcccacgcucgacaucgagcugcagaagaccgaggcgacccagcuggccacccuccggaagcugugcaucgagggcaagaucacgaacaucaccaccgacagccgcugccccacccagggcgaggccgugcugccggaggagcaggaccagaacuacgucugcaagcacacguacguggaccggggguggggcaacgggugcggccucuucgggaagggcucccuggugaccugcgccaaguuccagugccuggagcccaucgagggcaaggucgugcaguacgagaaccucaaguacaccgugaucaucaccguccacacgggggaccagcaccaggugggcaacgagacccagggggucaccgccgagaucacgccccaggcgagcacgaccgaggccauccugcccgaguacggcacccuggggcucgagugcuccccgcgcaccggccuggacuucaacgagaugauccugcucaccaugaagaacaaggccuggauggugcaccggcagugguucuucgaccugccccugcccuggacgagcggcgccaccaccgagacccccacguggaaccgcaaggagcuccuggugaccuucaagaacgcccacgcgaagaagcaggaggucguggugcuggggucccaggagggcgccaugcacaccgcccucaccggggccacggagauccagaacagcggcgggaccuccaucuucgccggccaccugaagugccggcugaagauggacaagcucgagcugaagggcaugagcuacgcgaugugcaccaacaccuucguccugaagaaggagguguccgagacgcagcacgggaccauccucaucaagguggaguacaagggcgaggacgccccgugcaagauccccuucagcaccgaggacgggcagggcaaggcccacaacggccgccugaucaccgccaaccccgucgugacgaagaaggaggagcccgugaacaucgaggcggagccgcccuucggggagagcaacaucgucaucggcaucggggacaacgcccugaagaucaacugguacaagaagggcuccagcaucgggaagauguucgaggccaccgcccggggcgcccgccggauggcgauccugggcgacaccgccugggacuucggguccgugggcggggugcucaacagccugggcaagaugguccaccagaucuucggguccgccuacaccgcccuguucagcggcguguccugggugaugaagaucggcaucgggguccuccugacguggaucggccugaacagcaagaacaccuccaugagcuucuccugcaucgccaucgggaucaucacccucuaccugggcgcgguggugcaggccgacaccgggugcgucaucaacuggaagggcaaggagcugaagugcggcagcgggaucuucgugacgaacgaggugcacaccuggaccgagcaguacaaguuccaggccgacucccccaagcgccucgccaccgccaucgcgggcgccugggagaacggggucugcggcauccgcagcacgacccggauggagaaccugcuguggaagcaggucgccaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgcggagacccagaacagcuccuucaucaucgacggccccaacacgcccgagugccccagcgccucccgggccuggaacgugugggagguggaggacuacggguucggcgucuucaccaccaacaucuggcucaagcugcgcgagguguacacccagcugugcgaccaccggcucaugagcgccgccgugaaggacgagcgcgcgguccacgccgacaugggcuacuggaucgagagccagaagaacggguccuggaagcuggagaaggccagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgcgggcagcgggaagguggacaacuucacgaugggcguccugugccucgccauccuguucgaggaggugaugcgggggaaguucggcaagaagcacaugaucgccgggguguucuucaccuucguccugcuccuguccggccagaucaccuggcgcgacauggcccacacccugaucaugaucggcagcaacgccuccgaccggauggggaugggcgugacguaccucgcgcugaucgccaccuucaagauccagcccuuccuggcccucggguucuuccugcgcaagcugaccagccgggagaaccuccugcugggcgugggccucgccauggcgaccacgcugcagcugcccgaggacaucgagcagauggccaacgggaucgcccucggccugauggcccugaagcucaucacccaguucgagaccuaccagcuguggaccgcccugaucagccucacgugcuccaacaccaucuucacccugaccgucgcguggcgcacggccacccugauccucgccggggugagccugcugccggucugccaguccagcuccaugcggaaguccgacuggcuccccaugaccguggccgccaugggcgugccgccccucccgcuguucaucuucucccucaaggacacccugaagcgccgcagcuggccccugaacgagggggucauggcggugggccucguguccauccuggccagcucccugcuccggaacgacguccccauggccggcccccugguggccgggggccugcucaucgccugcuacgugaucacggggaccagcgcggaccugaccgucgagaaggccgccgacgugaccugggaggaggaggccgagcagacgggcgugucccacaaccugaugaucaccgucgacgacgacgggaccaugcgcaucaaggacgacgagaccgagaacauccucaccgugcugcugaagacggcccuccugaucgugagcggcaucuucccguacuccauccccgcgacccugcucgucuggcacaccuggcagaagcagacccggcgcagcggcgugcugugggacgugcccagcccgcccgagacgcagaaggccgagcuggaggagggggucuaccggaucaagcagcagggcaucuucgggaagacccaggugggcguggggguccagaaggagggcguguuccacaccauguggcacgugacccgcggcgccguccucacguacaacgggaagcggcuggagcccaacugggccagcgugaagaaggaccugaucuccuacggcgggggcuggcgccucagcgcgcaguggcagaagggggaggaggugcaggucaucgccguggagcccggcaagaaccccaagaacuuccagaccaugcccggcaccuuccagaccacgaccggggagaucggcgccaucgcccuggacuucaagcccgggaccagcggcucccccaucaucaaccgggagggcaagguggucgggcuguacggcaacgggguggugaccaagaacggcggguacgucagcggcaucgcccagacgaacgcggagccggacggccccacccccgagcuggaggaggagauguucaagaagcgcaaccucaccaucauggaccugcaccccggguccggcaagacccggaaguaccugccggccaucgugcgcgaggccaucaagcggcgccuccggacgcugauccuggcccccacccgcguggucgccgcggagauggaggaggcccucaaggggcugcccauccgguaccagaccaccgccaccaagagcgagcacaccggccgcgagaucguggaccugaugugccacgccaccuucaccaugcggcuccugucccccgugcgcgucccgaacuacaaccugaucaucauggacgaggcccacuucacggaccccgcgagcaucgccgcccggggguacaucuccacccgcgugggcaugggcgaggccgcggccaucuucaugaccgccacgccgcccgggacggccgacgccuucccgcagagcaacgcgcccauccaggacgaggagcgcgacauccccgagcgguccuggaacagcggcaacgaguggaucaccgacuucgccgggaagaccgugugguucguccccuccaucaaggccggcaacgacaucgccaacugccuccgcaagaacgggaagaaggugauccagcugagccggaagaccuucgacacggaguaccagaagaccaagcugaacgacugggacuucguggucaccaccgacaucuccgagaugggcgccaacuucaaggcggaccgcgugaucgacccgcggcgcugccucaagcccgugauccugacggacggccccgagcgggucauccuggccgggcccaugccggugaccgccgccagcgccgcgcagcgccggggccgcguggggcggaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgcgagaaguccgcggccaucgacggcgaguaccggcugaagggcgagagccgcaagacguucgucgagcugaugcggcgcggggaccuccccguguggcuggcccacaaggucgccuccgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcccgcaccuacagcgacccgcuggcgcucaaggaguucaaggacuucgccgccggccggaaguccaucgcccuggaccuggugacggagaucgggcgcguccccagccaccucgcccaccggacccgcaacgcgcuggacaaccuggugaugcuccacaccagcgagcacggcgggaaggccuaccggcacgccguggaggagcugcccgagaccauggagacgcugcuccugcugggccucaugauccugcugaccgggggcgccaugcuguuccugaucuccggcaaggggaucggcaagaccagcaucgggcugaucugcgucaucgccuccagcggcaugcucuggauggcggagaucccgcugcaguggaucgccuccgccaucgugcuggaguucuucaugauggugcuccugauccccgagcccgagaagcagcgcacgccccaggacaaccagcuggccuacgucgugaucgggauccucacgcuggccgcgaucaucgccgccaacgagaugggccugcucgagaccaccaagcgggaccugggcaugagcaaggagccggggguggucucccccaccagcuaccuggacguggaccuccaccccgccuccgcguggacgcuguacgccguggccaccaccgucaucacccccaugcugcgccacacgaucgagaacagcaccgccaacgugucccucgccgcgaucgccaaccaggccgugguccugaugggccuggacaagggguggccgaucagcaagauggaccucggcgugccccugcuggcccucgggugcuacucccaggugaacccccugacccugaccgccgcgguccuccugcugaucacgcacuacgccaucaucggccccggccuccaggccaaggccacccgggaggcccagaagcgcaccgcggccgggaucaugaagaacccgaccguggacggcaucaugacgaucgaccuggaccccgugaucuacgacagcaaguucgagaagcagcuggggcaggucaugcuccuggugcugugcgccgugcagcuccugcugaugcggaccuccugggcccucugcgaggcgcugacccuggccaccggccccaucacgacccucugggagggcagccccgggaaguucuggaacaccaccaucgccgucuccauggccaacaucuuccgcggcagcuaccuggccggggcgggccuggccuucuccaucaugaaguccguggggacgggcaagcggggcaccgggagccagggcgagacccucggggagaaguggaagaagaagcugaaccagcugucccgcaaggaguucgaccucuacaagaaguccggcaucaccgagguggaccggaccgaggccaaggaggggcugaagcgcggcgagaucacgcaccacgccgucucccggggcagcgccaagcugcagugguucguggagcgcaacauggugaucccggaggggcgggucaucgaccucggcugcgggcgcggcgggugguccuacuacugcgcgggccugaagaaggugaccgaggugcggggcuacaccaagggcgggcccgggcacgaggagcccguccccaugagcaccuacggcuggaacaucgugaagcugauguccgggaaggacguguucuaccucccgcccgagaagugcgacacgcugcugugcgacaucggcgagagcucccccagccccaccgucgaggagucccgcaccauccgcgugcugaagaugguggagccguggcucaagaacaaccaguucugcaucaagguccugaaccccuacaugcccaccgugaucgagcaccuggagcggcuccagcgcaagcacggcgggaugcuggugcggaacccccugagccgcaacuccacgcacgagauguacuggaucagcaacggcaccgggaacaucgucgccuccgugaacauggugagccggcuccugcugaaccgcuucaccaugacccaccggcgcccgacgaucgagaaggacgucgaccucggcgccggcacccggcacgugaacgccgagcccgagacccccaacauggacgugaucggggagcgcaucaagcggaucaaggaggagcacaacuccaccuggcacuacgacgacgagaacccguacaagacgugggccuaccacggcagcuacgaggucaaggcgaccggguccgccagcagcaugaucaacggcguggucaagcugcugaccaagcccugggacguggugcccauggucacccagauggccaugacggacaccacccccuucgggcagcagcgcguguucaaggagaagguggacacccggacgccgcgcuccaugcccggcacccggcgcgucaugggcaucaccgccgaguggcucuggcggacccuggggcgcaacaagaagccccggcugugcacgcgcgaggaguucaccaagaaggugcgcaccaacgcggccaugggcgccguguucaccgaggagaaccagugggacagcgccaaggccgcggucgaggacgaggacuucuggaagcucguggaccgggagcgcgagcugcacaagcuggggaagugcggcuccugcguguacaacaugauggggaagcgggagaagaagcucggcgaguucggcaaggccaaggggagccgcgccaucugguacauguggcugggcgcccgguaccuggaguucgaggcccucggguuccugaacgaggaccacugguucucccgcgagaacagcuacuccggcgucgagggggagggccugcacaagcucggcuacauccugcgggacaucagcaagauccccgggggcgcgauguacgccgacgacacggccgggugggacacccgcaucaccgaggacgaccugcacaacgaggagaagaucacccagcagauggacccggagcaccggcagcucgccaacgccaucuucaagcugacguaccagaacaagguggugaagguccagcgccccacccccaccggcaccgugauggacaucaucucccggaaggaccagcgcggcagcggccaggugggcaccuacgggcugaacacguucaccaacauggaggcgcagcucauccggcagauggagggcgaggggguccugaccaaggccgaccuggagaacccccaccucuccgagaagaagaucacccaguggcuggagacgaagggcguggagcgccugaagcggauggccaucagcggcgacgacugcguggucaagccgaucgacgaccgcuucgccaacgcccuccuggcgcugaacgacauggggaaggugcggaaggacaucccccaguggcagcccuccaagggcuggcacgacuggcagcagguccccuucugcagccaccacuuccacgagcucaucaugaaggacgggcgcaagcuggucgugccgugccggccccaggacgagcugaucggccgcgcccggaucucccagggggccggcuggagccuccgcgagaccgccugccugggcaaggcguacgcccagauguggucccugauguacuuccaccgccgggaccuccgccuggccagcaacgccaucugcuccgccgugcccguccacugggugcccaccagccggaccacguggagcauccacgcgcaccaccaguggaugaccaccgaggacaugcugaccguguggaaccgcgucuggaucgaggacaacccguggauggaggacaagacgcccgugaccaccugggagaacgugcccuaccucgggaagcgggaggaccaguggugcggcucccugaucgggcugaccagccgcgccacgugggcccagaacauccccaccgccauccagcagguccggucccucaucggcaacgaggaguuccuggacuacaugccgagcaugaagcgcuuccggaaggaggaggaguccgagggggccaucugguga

SEQ ID NO: 10161 - RNA, 9873 nt, Artificial Sequence
  derived and/or modified CDS sequence (opt1) from DENV-3__FJ024465__SS-prME
accagccugugccucaugaugauccugcccgccgcccuggccuuccaccucaccagccgggacggcgagccccggaugaucguggggaagaacgagcggggcaagagccugcuguucaagaccgccagcgggaucaacaugugcacccucaucgccauggaccugggcgagaugugcgacgacaccgugaccuacaagugcccccacaucgccgagguggagcccgaggacaucgacugcuggugcaaccugacgagcaccugggugaccuacgggaccugcaaccaggccggcgagcaccggcgcgacaagcgguccgucgcgcucgcgccccacgugggcauggggcuggacacgcgcacccagaccuggaugagcgccgagggcgccuggcgccagguggagaaggucgagaccugggcgcugcgccacccgggguucacgauccucgcccuguuccuggcccacuacaucggcaccucccucacccagaagguggugaucuucauccugcugaugcucgucacccccagcaugacgaugcggugcgugggggugggcaaccgcgacuucgucgagggccuguccggggccaccuggguggacgugguccuggagcacggcgggugcgugaccaccauggccaagaacaagcccacgcucgacaucgagcugcagaagaccgaggcgacccagcuggccacccuccggaagcugugcaucgagggcaagaucacgaacaucaccaccgacagccgcugccccacccagggcgaggccgugcugccggaggagcaggaccagaacuacgucugcaagcacacguacguggaccggggguggggcaacgggugcggccucuucgggaagggcucccuggugaccugcgccaaguuccagugccuggagcccaucgagggcaaggucgugcaguacgagaaccucaaguacaccgugaucaucaccguccacacgggggaccagcaccaggugggcaacgagacccagggggucaccgccgagaucacgccccaggcgagcacgaccgaggccauccugcccgaguacggcacccuggggcucgagugcuccccgcgcaccggccuggacuucaacgagaugauccugcucaccaugaagaacaaggccuggauggugcaccggcagugguucuucgaccugccccugcccuggacgagcggcgccaccaccgagacccccacguggaaccgcaaggagcuccuggugaccuucaagaacgcccacgcgaagaagcaggaggucguggugcuggggucccaggagggcgccaugcacaccgcccucaccggggccacggagauccagaacagcggcgggaccuccaucuucgccggccaccugaagugccggcugaagauggacaagcucgagcugaagggcaugagcuacgcgaugugcaccaacaccuucguccugaagaaggagguguccgagacgcagcacgggaccauccucaucaagguggaguacaagggcgaggacgucccgugcaagauccccuucagcaccgaggacgggcagggcaaggcccacaacggccgccugaucaccgccaaccccguggugacgaagaaggaggagcccgucaacaucgaggccgagccgcccuucggggagagcaacaucgugaucggcaucggggacaacgcgcugaagaucaacugguacaagaagggcuccagcaucgggaagauguucgaggccaccgcccggggcgcccgccggauggccauccugggcgacaccgcgugggacuucggguccgugggcgggguccucaacagccugggcaagauggugcaccagaucuucggguccgccuacaccgcccuguucagcggcguguccugggucaugaagaucggcaucggggugcuccugacguggaucggccugaacagcaagaacaccuccaugagcuucuccugcaucgccaucgggaucaucacccucuaccugggcgccgugguccaggcggacaccgggugcgugaucaacuggaagggcaaggagcugaagugcggcagcgggaucuucgugacgaacgagguccacaccuggaccgagcaguacaaguuccaggccgacucccccaagcgccucgccaccgccaucgccggcgcgugggagaacggggugugcggcauccgcagcacgacccggauggagaaccugcuguggaagcagaucgccaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgcgucccgggccuggaacgugugggagguggaggacuacggguucggcgucuucaccaccaacaucuggcucaagcugcgcgagguguacacccagcugugcgaccaccggcucaugagcgccgccgugaaggacgagcgcgccguccacgcggacaugggcuacuggaucgagagccagaagaacggguccuggaagcuggagaaggccagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgcgauccuguucgaggaggugaugcgggggaaguucggcaagaagcacaugaucgccgggguguucuucaccuucguccugcuccuguccggccagaucaccuggcgcgacauggcccacacccugaucaugaucggcagcaacgccuccgaccggauggggaugggcgugacguaccucgcccugaucgcgaccuucaagauccagcccuuccuggcccucggguucuuccugcgcaagcugaccagccgggagaaccuccugcugggcgugggccucgccauggccaccacgcugcagcugcccgaggacaucgagcagauggcgaacgggaucgcccucggccugauggcccugaagcucaucacccaguucgagaccuaccagcuguggaccgcccugaucagccucacgugcuccaacaccaucuucacccugaccgucgccuggcgcacggcgacccugauccucgccggggugagccugcugccggucugccaguccagcuccaugcggaaguccgacuggcuccccaugaccguggccgccaugggcgugccgccccucccgcuguucaucuucucccucaaggacacccugaagcgccgcagcuggccccugaacgagggggucauggccgugggccucguguccauccuggcgagcucccugcuccggaacgacguccccauggccggcccccugguggccgggggccugcucaucgccugcuacgugaucacggggaccagcgccgaccuggcggucgagaaggccgccgacgugaccugggaggaggaggccgagcagaccggcgugucccacaaccugaugaucacggucgacgacgacgggaccaugcgcaucaaggacgacgagaccgagaacauccucaccgugcugcugaagaccgcccuccugaucgugagcggcaucuucccguacuccauccccgcgacgcugcucgucuggcacaccuggcagaagcagacccagcggagcggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacccggggcgccguccucaccuacaacgggaagcgccuggagcccaacugggccagcgugaagaaggaccugaucuccuacggcgggggcuggcggcucagcgcgcaguggcagaagggggaggaggugcaggucaucgccguggagcccggcaagaaccccaagaacuuccagacgaugcccggcaccuuccagaccaccacgggggagaucggcgccaucgcccuggacuucaagcccgggaccagcggcucccccaucaucaaccgcgagggcaagguggucgggcuguacggcaacgggguggugaccaagaacggcggguacgucagcggcaucgcccagaccaacgcggagccggacggccccacgcccgagcuggaggaggagauguucaagaagcggaaccucaccaucauggaccugcaccccggguccggcaagacccgcaaguaccugccggccaucgugcgggaggccaucaagcgccggcuccgcacccugauccuggcccccacgcggguggucgccgcggagauggaggaggcccucaaggggcugcccauccgcuaccagaccaccgccaccaagagcgagcacacgggccgggagaucguggaccugaugugccacgccaccuucaccaugcgccuccugucccccgugcgggucccgaacuacaaccugaucaucauggacgaggcccacuucaccgaccccgcgagcaucgccgcccgcggguacaucuccacgcgggugggcaugggcgaggccgcggccaucuucaugaccgccacgccgcccgggaccgccgacgccuucccgcagagcaacgcgcccauccaggacgaggagcgcgacauccccgagcgcuccuggaacagcggcaacgaguggaucacggacuucgccgggaagaccgugugguucguccccuccaucaaggccggcaacgacaucgccaacugccuccggaagaacgggaagaaggugauccagcugagccgcaagaccuucgacaccgaguaccagaagacgaagcugaacgacugggacuucguggucaccaccgacaucuccgagaugggcgccaacuucaaggcggaccgggugaucgacccgcgccggugccucaagcccgugauccugaccgacggccccgagcgcgucauccuggccgggcccaugccggugacggccgccagcgccgcgcagcggcgcggccggguggggcgcaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgggagaaguccgcggccaucgacggcgaguaccgccugaagggcgagagccggaagaccuucgucgagcugaugcgccgcggggaccuccccguguggcuggcccacaaggucgccuccgagggcaucaaguacacggaccgcaaguggugcuucgacgggcagcggaacaaccagauccuggaggagaacauggacguggagaucuggaccaaggagggcgagaagaagaagcuccgcccccgguggcuggacgcccgcaccuacagcgacccgcuggcgcucaaggaguucaaggacuucgccgccggccgcaaguccaucgcccuggaccuggugaccgagaucgggcggguccccagccaccucgcccaccgcacgcggaacgcgcuggacaaccuggugaugcuccacaccagcgagcacggcgggaaggccuaccgccacgccguggaggagcugcccgagaccauggagacccugcuccugcugggccucaugauccugcugaccggcggggccaugcuguuccugaucuccgggaaggggaucggcaagaccagcaucgggcugaucugcgucaucgccuccagcggcaugcucuggauggcggagaucccgcugcaguggaucgccuccgccaucgugcuggaguucuucaugauggugcuccugauccccgagcccgagaagcagcggacgccccaggacaaccagcuggccuacgucgugaucgggauccucacccuggccgcgaucaucgccgccaacgagaugggccugcucgagacgaccaagcgcgaccugggcaugagcaaggagccggggguggucucccccaccagcuaccuggacguggaccuccaccccgccuccgcguggacccuguacgccguggccacgaccgucaucacccccaugcugcggcacaccaucgagaacagcacggccaacgugucccucgccgcgaucgccaaccaggccgugguccugaugggccuggacaagggguggccgaucagcaagauggaccucggcgugccccugcuggcccucgggugcuacucccaggugaacccccugacccugaccgccgcgguccuccugcugaucacccacuacgccaucaucggccccggccuccaggccaaggccacgcgcgaggcccagaagcggaccgcggccgggaucaugaagaacccgaccguggacggcaucaugaccaucgaccuggaccccgugaucuacgacagcaaguucgagaagcagcuggggcaggucaugcuccuggugcugugcgccgugcagcuccugcugaugcgcacguccugggcccucugcgaggcgcugacccuggccaccggccccaucaccacgcucugggagggcagccccgggaaguucuggaacaccaccaucgccgucuccauggccaacaucuuccggggcagcuaccuggccggggcgggccuggccuucuccaucaugaaguccguggggaccggcaagcgcggcacggggagccagggcgagacccucggggagaaguggaagaagaagcugaaccagcugucccggaaggaguucgaccucuacaagaaguccggcaucaccgagguggaccgcaccgaggccaaggaggggcugaagcggggcgagaucacccaccacgccgucucccgcggcagcgccaagcugcagugguucguggagcggaacauggugaucccggaggggcgcgucaucgaccucggcugcgggcggggcgggugguccuacuacugcgcgggccugaagaaggugacggaggugcgcggcuacaccaagggcgggcccgggcacgaggagcccguccccaugagcaccuacggcuggaacaucgugaagcugauguccgggaaggacguguucuaccucccgcccgagaagugcgacacccugcugugcgacaucggcgagagcucccccagccccacggucgaggagucccggaccauccgcgugcugaagaugguggagccguggcucaagaacaaccaguucugcaucaagguccugaaccccuacaugcccaccgugaucgagcaccuggagcgccuccagcggaagcacggcgggaugcuggugcgcaacccccugagccggaacuccacccacgagauguacuggaucagcaacggcacggggaacaucgucgccuccgugaacauggugagccgccuccugcugaaccgguucaccaugacccaccgccggccgaccaucgagaaggacgucgaccucggcgccggcacgcgccacgugaacgccgagcccgagacccccaacauggacgugaucggggagcggaucaagcgcaucaaggaggagcacaacuccaccuggcacuacgacgacgagaacccguacaagaccugggccuaccacggcagcuacgaggucaaggcgacgggguccgccagcagcaugaucaacggcguggucaagcugcugaccaagcccugggacguggugcccaccgucacccagauggccaugacggacaccacccccuucgggcagcagcggguguucaaggagaagguggacacccgcacgccgcgguccaugcccggcacccgccgggucaugggcaucaccgccgaguggcucuggcgcacccuggggcggaacaagaagccccgccugugcacgcgggaggaguucaccaagaaggugcgcaccaacgcggccaugggcgccguguucaccgaggagaaccagugggacagcgccaaggccgcggucgaggacgaggacuucuggaagcucguggaccgcgagcgggagcugcacaagcuggggaagugcggcuccugcguguacaacaugauggggaagcgcgagaagaagcucggcgaguucggcaaggccaaggggagccgggccaucugguacauguggcugggcgcccgcuaccuggaguucgaggcccucggguuccugaacgaggaccacugguucucccgggagaacagcuacuccggcgucgagggggagggccugcacaagcucggcuacauccugcgcgacaucagcaagauccccgggggcgcgauguacgccgacgacacggccgggugggacacccggaucaccgaggacgaccugcacaacgaggagaagaucacccagcagauggacccggagcaccgccagcucgccaacgccaucuucaagcugacguaccagaacaagguggugaagguccagcggcccacccccaccggcaccgugauggacaucaucucccgcaaggaccagcggggcagcggccaggugggcaccuacgggcugaacacguucaccaacauggaggcgcagcucauccgccagauggagggcgaggggguccuguccaaggccgaccuggagaacagccaccucuccgagaagaagaucacccaguggcuggagaccaagggcguggagcggcugaagcgcauggccaucagcggcgacgacugcguggucaagcccaucgacgaccgguucgccaacgcccuccuggcgcugaacgacauggggaaggugcgcaaggacaucccgcaguggcagcccuccaagggcuggcacgacuggcagcagguccccuucugcagccaccacuuccacgagcucaucaugaaggacgggcggaagcuggucgugcccugccgcccgcaggacgagcugaucggccgggcccgcaucucccagggggccggcuggagccuccgggagacggccugccugggcaaggcguacgcccagauguggucccugauguacuuccaccgccgcgaccuccggcuggccagcaacgccaucugcagcgccgugcccguccacugggugcccaccucccgcaccaccuggagcauccacgcgcaccaccaguggaugacgaccgaggacaugcugaccguguggaaccgggucuggaucgaggacaaccccuggauggaggacaagaccccggugacgaccugggagaacgugcccuaccucgggaagcgcgaggaccaguggugcggcucccugaucgggcugaccagccgggccaccugggcccagaacauccccacggccauccagcagguccgcucccucaucggcaacgaggaguuccuggacuacaugcccagcaugaagcgguuccgcaaggaggaggaguccgagggggccaucugguga

SEQ ID NO: 10162 - RNA, 9873 nt, Artificial Sequence
  derived and/or modified CDS sequence (opt1) from DENV-3__FJ024466__SS-prME
accagccugugccucaugaugauccugcccgccgcccuggccuuccaccucaccagccgggacggggagccccggaugaucguggggaagaacgagcggggcaagagccugcuguucaagaccgccagcgggaucaacaugugcacccucaucgccauggaccugggggagaugugcgacgacaccgugaccuacaagugcccccacaucgccgagguggagcccgaggacaucgacugcuggugcaaccugaccagcaccugggugaccuacgggaccugcaaccaggccggcgagcaccggcgcgacaagcgguccguggcgcucgcgccccacgugggcauggggcuggacacgcgcacccagaccuggaugagcgccgagggcgccuggcgccagguggagaagguggagaccugggcgcugcgccacccgggguucacgauccucgcccuguuccuggcccacuacaucggcaccucccucacccagaagguggugaucuucauccugcugaugcucgugacccccagcaugacgaugcggugcgugggggugggcaaccgcgacuucgucgagggccuguccggggccaccuggguggacgugguccuggagcacggcgggugcgugaccaccauggccaagaacaagcccacgcucgacaucgagcugcagaagaccgaggcgacccagcuggccacccuccggaagcugugcaucgagggcaagaucacgaacaucaccaccgacagccgcugccccacccagggcgaggccgugcugccggaggagcaggaccagaacuacgucugcaagcacacguacguggaccggggguggggcaacgggugcggccucuucgggaagggcucccuggugaccugcgccaaguuccagugccuggagcccaucgagggcaaggucgugcaguacgagaaccucaaguacaccgugaucaucaccguccacacgggggaccagcaccaggugggcaacgagacccagggggucaccgccgagaucacgccccaggcgagcacgaccgaggccauccugcccgaguacggcacccuggggcucgagugcuccccgcgcaccggccuggacuucaacgagaugauccugcucaccaugaagaacaaggccuggauggugcaccggcagugguucuucgaccugccccugcccuggacgagcggcgccaccaccgagacccccacguggaaccgcaaggagcuccuggugaccuucaagaacgcccacgcgaagaagcaggaggucguggugcuggggucccaggagggcgccaugcacaccgcccucaccggggccacggagauccagaacagcggcgggaccuccaucuucgccggccaccugaagugccggcugaagauggacaagcucgagcugaagggcaugagcuacgcgaugugcaccaacaccuucguccugaagaaggagguguccgagacgcagcacgggaccauccucaucaagguggaguacaagggcgaggacgccccgugcaagauccccuucagcaccgaggacgggcagggcaaggcccacaacggccgccugaucaccgccaaccccgucgugacgaagaaggaggagcccgugaacaucgaggcggagccgcccuucggggagagcaacaucgucaucggcaucggggacaacgcccugaagaucaacugguacaagaagggcuccagcaucgggaagauguucgaggccaccgcccggggcgcccgccggauggcgauccugggcgacaccgccugggacuucggguccgugggcggggugcucaacagccugggcaagaugguccaccagaucuucggguccgccuacaccgcccuguucagcggcguguccugggugaugaagaucggcaucgggguccuccugacguggaucggccugaacagcaagaacaccuccaugagcuucuccugcaucgccaucgggaucaucacccucuaccugggcgcgguggugcaggccgacaccgggugcgucaucaacuggaagggcaaggagcugaagugcggcagcgggaucuucgugacgaacgaggugcacaccuggaccgagcaguaccgcuuccaggccgacucccccaagcgccucgccaccgccaucgcgggcgccugggagaacggggucugcggcauccggagcacgacccgcauggagaaccugcuguggaagcagaucgccaacgagcucaacuacauccugugggagaacaacaucaagcugaccgugguggucggggacaucaucggcgugcucgagcagggcaagcggacccugacgccccagccgauggagcugaaguacuccuggaagaccugggggaaggccaagaucgugaccgcggagacccagaacagcuccuucaucaucgacggccccaacacgcccgagugccccagcgccucccgcgccuggaacgucugggagguggaggacuacggguucggcguguucaccaccaacaucuggcucaagcugcgggaggucuacacccagcugugcgaccaccgccucaugagcgccgccgugaaggacgagcgggcggugcacgccgacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaacuaccgcccgggcuaccacacccagaccgccgggcccuggcaccucggcaagcuggagcuggacuucaacuacugcgagggcacgaccguggucaucaccgacaacugcgggacccggggccccagccuccgcacgaccaccguguccgggaagcugauccacgaguggugcugccggagcugcacccugcccccgcuccgcuacaugggcgaggacgggugcugguacggcauggagauccggcccaucuccgagaaggaggagaacauggucaagagccuggucuccgcgggcagcgggaagguggacaacuucacgaugggcgugcugugccucgccauccuguucgaggaggucaugcgcgggaaguucggcaagaagcacaugaucgccgggguguucuucaccuucgugcugcuccuguccggccagaucaccuggcgggacauggcccacacccugaucaugaucggcagcaacgccuccgaccgcauggggaugggcgucacguaccucgcgcugaucgccaccuucaagauccagcccuuccuggcccucggguucuuccugcggaagcugaccagccgcgagaaccuccugcugggcgugggccucgccauggcgaccacgcugcagcugcccgaggacaucgagcagauggccaacgggaucgcccucggccugauggcccugaagcucaucacccaguucgagaccuaccagcuguggaccgcccugaucagccucacgugcuccaacaccaucuucacccugaccguggcguggcggacggccacccugauccucgccggggucagccugcugccggugugccaguccagcuccaugcgcaagagcgacuggcuccccaugaccgucgccgccaugggcgugccgccccucccgcuguucaucuucucccucaaggacacccugaagcgccggagcuggccccugaacgagggggugauggcggucggccucguguccauccuggccagcucccugcuccgcaacgacgugcccauggccggcccccuggucgccgggggccugcucaucgccugcuacgugaucacggggaccagcgcggaccugaccguggagaaggccgccgacgucaccugggaggaggaggccgagcagacgggcgugucccacaaccugaugaucaccguggacgacgacgggaccaugcggaucaaggacgacgagaccgagaacauccucaccguccugcugaagacggcccuccugaucgugagcggcaucuucccguacuccauccccgcgacccugcucguguggcacaccuggcagaagcagacccgccggagcggcguccugugggacgugcccagcccgcccgagacgcagaaggccgagcuggaggaggggguguaccgcaucaagcagcagggcaucuucgggaagacccaggucggcgugggggugcagaaggagggcgucuuccacaccauguggcacgugacccggggcgccgugcucacguacaacgggaagcgccuggagcccaacugggccagcgucaagaaggaccugaucuccuacggcgggggcuggcggcucagcgcgcaguggcagaagggggaggagguccaggugaucgccgucgagcccggcaagaaccccaagaacuuccagaccaugcccggcaccuuccagaccacgaccggggagaucggcgccaucgcccuggacuucaagcccgggaccagcggcucccccaucaucaaccgcgagggcaaggugguggggcuguacggcaacggggucgugaccaagaacggcggguacgugagcggcaucgcccagacgaacgcggagccggacggccccacccccgagcuggaggaggagauguucaagaagcggaaccucaccaucauggaccugcaccccggguccggcaagacccgcaaguaccugccggccaucguccgggaggccaucaagcgccggcuccgcacgcugauccuggcccccacccgggugguggccgcggagauggaggaggcccucaaggggcugcccauccgcuaccagaccaccgccaccaaguccgagcacaccggccgggagaucgucgaccugaugugccacgccaccuucaccaugcgccuccugucccccgugcgggugccgaacuacaaccugaucaucauggacgaggcccacuucacggaccccgcgagcaucgccgcccgcggguacaucuccacccgcgucggcaugggcgaggccgcggccaucuucaugaccgccacgccgcccgggacggccgacgccuucccgcagagcaacgcgcccauccaggacgaggagcgggacauccccgagcgcuccuggaacagcggcaacgaguggaucaccgacuucgccgggaagaccgugugguucgugcccuccaucaaggccggcaacgacaucgccaacugccuccggaagaacgggaagaaggucauccagcugagccgcaagaccuucgacacggaguaccagaagaccaagcugaacgacugggacuucguggugaccaccgacaucuccgagaugggcgccaacuucaaggcggaccgggucaucgacccgcgccggugccucaagcccgugauccugacggacggccccgagcgcgugauccuggccgggcccaugccggucaccgccgccagcgccgcgcagcggcgcggccggguggggcgcaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgggagaaguccgcggccaucgacggcgaguaccgccugaagggcgagagccggaagacguucguggagcugaugcgccgcggggaccuccccgucuggcuggcccacaagguggccuccgagggcaucaaguacaccgaccgcaaguggugcuucgacgggcagcggaacaaccagauccuggaggagaacauggacgucgagaucuggaccaaggagggcgagaagaagaagcuccgcccccgcuggcuggacgcccggaccuacagcgacccgcuggcgcucaaggaguucaaggacuucgccgccggccgcaaguccaucgcccuggaccuggugacggagaucgggcgggugcccagccaccucgcccaccgcacccggaacgcgcuggacaaccuggucaugcuccacaccagcgagcacggcgggaaggccuaccgccacgccguggaggagcugcccgagaccauggagacgcugcuccugcugggccucaugauccugcugaccgggggcgccaugcuguuccugaucuccggcaaggggaucggcaagaccagcaucgggcugaucugcgugaucgccuccagcggcaugcucuggauggcggagaucccgcugcaguggaucgccuccgccaucguccuggaguucuucaugauggugcuccugauccccgagcccgagaagcagcggacgccccaggacaaccagcuggccuacguggucaucgggauccucacgcuggccgcgaucaucgccgccaacgagaugggccugcucgagaccaccaagcgcgaccugggcaugagcaaggagccggggguggugucccccaccagcuaccuggacgucgaccuccaccccgccuccgcguggacgcuguacgccguggccaccaccgugaucacccccaugcugcggcacacgaucgagaacagcaccgccaacgucucccucgccgcgaucgccaaccaggccguggugcugaugggccuggacaagggguggccgaucagcaagauggaccucggcgucccccugcuggcccucgggugcuacucccaggugaacccccugacccugaccgccgcggugcuccugcugaucacgcacuacgccaucaucggccccggccuccaggccaaggccacccgcgaggcccagaagcggaccgcggccgggaucaugaagaacccgaccgucgacggcaucaugacgaucgaccuggaccccgugaucuacgacagcaaguucgagaagcagcugggccaggugaugcuccugguccugugcgccgugcagcuccugcugaugcgcaccuccugggcccucugcgaggcgcugacccuggccaccggccccaucacgacccucugggagggcagccccgggaaguucuggaacaccaccaucgccguguccauggccaacaucuuccggggcagcuaccuggccggggcgggccuggccuucuccaucaugaaguccgucgggacgggcaagcgcggcaccgggagccagggcgagacccucggggagaaguggaagaagaagcugaaccagcugucccggaaggaguucgaccucuacaagaaguccggcaucaccgagguggaccgcaccgaggccaaggaggggcugaagcggggcgagaucacgcaccacgccgugucccgcggcagcgccaagcugcagugguucgucgagcggaacauggugaucccggaggggcgcgugaucgaccucggcugcgggcggggcgggugguccuacuacugcgcgggccugaagaaggucaccgaggugcgcggcuacaccaagggcgggcccgggcacgaggagcccgugcccaugagcaccuacggcuggaacaucgucaagcugauguccgggaaggacguguucuaccucccgcccgagaagugcgacacgcugcugugcgacaucggcgagagcucccccagccccaccguggaggagucccgcaccauccggguccugaagaugguggagccguggcucaagaacaaccaguucugcaucaaggugcugaaccccuacaugcccaccgucaucgagcaccuggagcgccuccagcggaagcacggcgggaugcuggugcgcaacccccugagccggaacuccacgcacgagauguacuggaucagcaacggcaccgggaacaucguggccuccgucaacauggugagccgccuccugcugaaccgguucaccaugacccaccgccggccgacgaucgagaaggacguggaccucggcgccggcacccgccacgucaacgccgagcccgagacccccaacauggacgugaucggggagcggaucaagcgcaucaaggaggagcacaacuccaccuggcacuacgacgacgagaacccguacaagacgugggccuaccacggcagcuacgaggugaaggcgaccggguccgccagcagcaugaucaacggcgucgugaagcugcugaccaagcccugggacgucgugcccauggugacccagauggccaugacggacaccacccccuucgggcagcagcgggucuucaaggagaagguggacacccgcacgccgcgguccaugcccggcacccgccgggugaugggcaucaccgccgaguggcucuggcgcacccuggggcggaacaagaagccccgccugugcacgcgcgaggaguucaccaagaagguccggaccaacgcggccaugggcgccguguucaccgaggagaaccagugggacagcgccaaggccgcgguggaggacgaggacuucuggaagcucgucgaccgcgagcgggagcugcacaagcuggggaagugcggcuccugcguguacaacaugauggggaagcgcgagaagaagcucggcgaguucggcaaggccaaggggagccgggccaucugguacauguggcugggcgcccgcuaccuggaguucgaggcccucggguuccugaacgaggaccacugguucucccgggagaacagcuacuccggcguggagggggagggccugcacaagcucggcuacauccugcgcgacaucagcaagauccccgggggcgcgauguacgccgacgacacggccgggugggacacccggaucaccgaggacgaccugcacaacgaggagaagaucacccaccagauggacccggagcaccgccagcucgccaacgccaucuucaagcugacguaccagaacaaggucgugaaggugcagcggcccacccccaccggcaccgucauggacaucaucucccgcaaggaccagcggggcagcggccaggugggcaccuacgggcugaacacguucaccaacauggaggcgcagcucauccgccagauggagggcgagggggugcuguccaaggccgaccuggagaacccccaccucagcgagaagaagaucacccaguggcuggagaccaagggcgucgagcggcugaagcgcauggccaucuccggcgacgacugcguggugaagccgaucgacgaccgguucgccaacgcccuccuggcgcugaacgacauggggaagguccgcaaggacaucccccaguggcagcccagcaagggcuggcacgacuggcagcagguccccuucugcucccaccacuuccacgagcucaucaugaaggacgggcggaagcugguggucccgugccgcccccaggacgagcugaucggccgggcccgcaucagccagggggccggcuggucccuccgcgagacggccugccugggcaaggcguacgcccagauguggagccugauguacuuccaccggcgcgaccuccggcuggccuccaacgccaucugcagcgccgugcccgugcacuggguccccaccagccgcaccaccugguccauccacgcgcaccaccaguggaugacgaccgaggacaugcugaccguguggaaccggguguggaucgaggacaacccguggauggaggacaagacccccgucacgaccugggagaacgugcccuaccucgggaagcgcgaggaccaguggugcggcagccugaucgggcugaccucccgggccaccugggcccagaacauccccacggccauccagcagguccgcagccucaucggcaacgaggaguuccuggacuacaugccguccaugaagcgguuccgcaaggaggaggagagcgagggggccaucugguga

SEQ ID NO: 10163 - RNA, 9873 nt, Artificial Sequence
  derived and/or modified CDS sequence (opt1) from DENV-3__FJ024467__SS-prME
accagccucugccucaugauggugcugcccgcggcccuggcguuccaccucaccagccgcgacggcgagccccggaugaucguggggaagaacgagcgcggcaagagccugcuguucaagacggccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaagguggagacgugggcccugcgccacccgggguucaccauccucgcgcuguuccuggcccacuacaucggcaccucccucacccagaagguggucaucuucauccugcugaugcucgugacgcccagcaugaccaugcggugcgugggggucggcaaccgcgacuucguggagggccuguccggggccaccuggguggacgucgugcuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccguccugccggaggagcaggaccagaacuacgugugcaagcacaccuacguggaccggggguggggcaacgggugcggccucuucgggaagggcucccuggugaccugcgccaaguuccagugccuggagcccaucgagggcaagguggugcaguacgagaaccucaaguacaccgucaucaucacggugcacaccggggaccagcaccaggucggcaacgagacccagggggugaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggucaccuucaagaacgcccacgccaagaagcaggagguggugguccuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucgugcugaagaaggagguguccgagacccagcacgggaccauccucaucaaggucgaguacaagggcgaggacgcgccgugcaagauccccuucagcaccgaggacgggcagggcaaggcccacaacggccgccugaucacggccaaccccguggugaccaagaaggaggagcccgucaacaucgaggccgagccgcccuucggggagagcaacaucgugaucggcaucggggacaacgcgcugaagaucaacugguacaagaagggcuccagcaucgggaagauguucgaggccaccgcccggggcgcccgccggauggccauccugggcgacaccgcgugggacuucggguccgugggcgggguccucaacagccugggcaagauggugcaccagaucuucggguccgccuacacggcccuguucagcggcguguccugggucaugaagaucggcaucggggugcuccugaccuggaucggccugaacagcaagaacaccuccaugagcuucuccugcaucgccaucggggugaucacccucuaccugggcgccgucgugcaggcggacauggggugcgugaucaacuggaagggcaaggagcugaagugcggcagcgggaucuucgucacgaacgaggugcacaccuggaccgagcaguacaaguuccaggccgacucccccaagcgccucgccaccgccaucgccggcgcgugggagaacggggugugcggcauccgcagcacgacccggauggagaaccugcuguggaagcagaucgccaacgagcucaacuacauccugugggagaacaacaucaagcugaccgucguggugggggacaucaucggcguccucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgcgucccgggccuggaacgugugggaggucgaggacuacggguucggcguguucaccaccaacaucuggcucaagcugcgcgagguguacacccagcugugcgaccaccggcucaugagcgccgccgucaaggacgagcgcgccgugcacgcggacaugggcuacuggaucgagagccagaagaacggguccuggaagcuggagaaggccagccugaucgaggugaagaccugcacguggccgaagucccacacccucuggagcaacggcguccuggaguccgacaugaucauccccaagagccuggccgggcccaucucccagcacaaccaccggccgggcuaccagacccagaccgccgggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaaggucgacaacuucacgaugggcgugcugugccucgcgauccuguucgaggagaugaugcgggggaaguucggcaagaagcacaugaucgccgggguguucuucaccuucguccugcuccuguccggccagaucaccuggcgcgacauggcccacacccugaucaugaucggcagcaacgccuccgaccggauggggaugggcgugacguaccucgcccugaucgcggccuucaagauccagcccuuccuggcccucggguucuuccugcgcaagcugaccagccgggagaaccuccugcugggcgugggccucgccauggcgaccacccugcagcugcccgaggacaucgagcagauggccaacgggaucgcccucggccugauggcccugaagcucaucacgcaguucgagaccuaccagcuguggaccgcccugaucagccugaccugcuccaacacgauguucacccugaccgucgcguggcgcaccgccacgcugauccucgccggggugagccugcugccggucugccaguccagcuccaugcggaagaccgacuggcuccccauggccguggccgcgaugggcgugccgccccucccgcuguucaucuucagccucaaggacacccugaagcgccgcuccuggccccugaacgagggggucauggccgugggccucgugagcauccuggccuccagccugcuccggaacgacguccccauggccggcccccugguggccgggggccugcucaucgcgugcuacgugaucaccgggacguccgccgaccugaccgucgagaaggccgccgacaucaccugggaggaggaggccgagcagaccggcgugagccacaaccugaugaucacgguggacgacgacgggaccaugcgcaucaaggacgacgagaccgagaacauccucaccguccugcugaagaccgcgcuccugaucguguccggcguguucccguacagcauccccgccacgcugcucgucuggcacaccuggcagaagcagacccagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacccggggcgccguccucaccuacaacgggaagcgccuggagcccaacugggcguccgugaagaaggaccugaucagcuacggcgggggcuggcggcucuccgcccaguggcagaagggggaggaggugcaggucaucgccguggagcccggcaagaaccccaagaacuuccagacgaugcccggcaccuuccagaccaccacgggggagaucggcgccaucgcccuggacuucaagcccgggaccagcggcagccccaucaucaaccgcgagggcaagguggucgggcuguacggcaacgggguggugaccaagaacggcggguacgucuccggcaucgcgcagaccaacgccgagccggacggccccacgcccgagcuggaggaggagauguucaagaagcggaaccucaccaucauggaccugcaccccgggagcggcaagacccgcaaguaccugccggccaucgugcgggaggccaucaagcgccggcuccgcacccugauccuggcccccacgcggguggucgcggccgagauggaggaggcccucaaggggcugcccauccgcuaccagaccaccgccaccaaguccgagcacacgggccgggagaucguggaccugaugugccacgccaccuucaccaugcgccuccugagccccgugcgggucccgaacuacaaccugaucaucauggacgaggcgcacuucaccgaccccgccuccaucgccgcccgcggguacaucagcacgcgggugggcaugggcgaggcggccgccaucuucaugaccgccacgccgcccgggaccgccgacgcguucccgcaguccaacgcccccauccaggacgaggagaaggacauccccgagcgcagcuggaacuccggcaacgaguggaucacggacuucgccgggaagaccgugugguucguccccagcaucaaggccggcaacgacaucgccaacugccuccgcaagaacgggaagaaggugauccagcugucccggaagaccuucgacaccgaguaccagaagacgaagcugaacgacugggacuucguggucaccaccgacaucagcgagaugggcgcgaacuucaaggccgaccgcgugaucgacccgcggcgcugccucaagcccgugauccugaccgacggccccgagcgggucauccuggccgggcccaugccggugacggccgccuccgcggcccagcgccggggccgcguggggcggaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgcgagaaguccgccgccaucgacggcgaguaccggcugaagggcgagucccgcaagaccuucgucgagcugaugcggcgcggggaccuccccguguggcuggcccacaaggucgccagcgagggcaucaaguacacggaccggaaguggugcuucgacgggcagcgcaacaaccagauccuggaggagaacauggacguggagaucuggaccaaggagggcgagaagaagaagcuccggccccgcuggcuggacgcgcggaccuacuccgacccgcuggcccucaaggaguucaaggacuucgccgccggccgcaagagcaucgcccuggaccuggugaccgagaucgggcgcguccccucccaccucgcgcaccggacgcgcaacgcccuggacaaccuggugaugcuccacaccagcgagcacggcgggcgggccuaccgccacgccguggaggagcugcccgagaccauggagacccugcuccugcugggccucaugauccugcugaccggcggggccaugcuguuccugaucagcgggaaggggaucggcaagaccuccaucgggcugaucugcgucaucgcgagcuccggcaugcucuggauggccgagaucccgcugcaguggaucgccagcgccaucgugcuggaguucuucaugauggugcuccugauccccgagcccgagaagcagcggacgccccaggacaaccagcuggccuacgucgugaucgggauccucacccuggcggccaucaucgccgccaacgagaugggccugcucgagacgaccaagcgcgaccugggcauguccaaggagccggggguggucagccccaccuccuaccuggacguggaccuccaccccgcgagcgccuggacccuguacgccguggccacgaccgucaucacccccaugcugcggcacaccaucgagaacuccacggccaacgugagccucgcggccaucgccaaccaggccgugguccugaugggccuggacaagggguggccgaucuccaagauggaccucggcgugccccugcuggcccucgggugcuacagccaggugaacccccugacccugaccgcggccguccuccugcugaucacccacuacgccaucaucggccccggccuccaggccaaggccacgcgcgaggcgcagaagcggaccgccgccgggaucaugaagaacccgaccguggacggcaucaugaccaucgaccuggaccccgugaucuacgacuccaaguucgagaagcagcuggggcaggucaugcuccuggugcugugcgccgugcagcuccugcugaugcgcacgagcugggcgcucugcgaggcccugacccuggccaccggccccaucaccacgcucugggagggcucccccgggaaguucuggaacaccaccaucgccgucagcauggccaacaucuuccggggcuccuaccuggcgggggccggccuggccuucagcaucaugaaguccguggggaccggcaagcgcggcacggggagccagggcgagacccucggggagaaguggaagaagaagcugaaccagcugagccggaaggaguucgaccucuacaagaaguccggcaucaccgagguggaccgcaccgaggccaaggaggggcugaagcggggcgagaccacgcaccacgccgucagccgcggcaccgcgaagcugcagugguucguggagcggaacauggugaucccggaggggcgcgucaucgaccucggcugcgggcggggcgggugguccuacuacugcgccggccugaagaaggugaccgaggugcgcggcuacaccaagggcgggcccgggcacgaggagcccguccccaugagcacguacggcuggaacaucgugaagcugauguccgggaaggacguguucuaccucccgcccgagaagugcgacacccugcugugcgacaucggcgagagcucccccagccccaccgucgaggagucccggaccauccgcgugcugaagaugguggagccguggcucaagaacaaccaguucugcaucaagguccugaaccccuacaugcccacggugaucgagcaccuggagcgccuccagcggaagcacggcgggaugcuggugcgcaacccccugagccggaacuccacccacgagauguacuggaucagcaacggcaccgggaacaucgucgccuccgugaacauggugagccgccuccugcugaaccgguucaccaugacgcaccgccggccgaccaucgagaaggacgucgaccucggcgccggcacccgccacgugaacgccgagcccgagacccccaacauggacgugaucggggagcggaucaagcgcaucaaggaggagcacaacuccacguggcacuacgacgacgagaacccguacaagaccugggcguaccacggcagcuacgaggucaaggccaccggguccgccagcuccaugaucaacggcguggucaagcugcugaccaagcccugggacguggugcccauggucacgcagauggccaugaccgacaccacccccuucgggcagcagcggguguucaaggagaagguggacacgcgcaccccgcggagcaugcccggcacccgccgggcgaugggcaucaccgccgaguggcucuggcgcacgcuggggcggaacaagaagccccgccugugcacccgggaggaguucaccaagaagguccgcaccaacgccgccaugggcgccguguucacggaggagaaccagugggacagcgcgaaggccgccguggaggacgagaacuucuggaagcucgucgaccgcgagcgggagcugcacaagcuggggaagugcggcuccugcguguacaacaugauggggaagcgcgagaagaagcucggcgaguucggcaaggccaaggggagccgggccaucugguacauguggcugggcgcgcgcuaccuggaguucgaggcccucggguuccugaacgaggaccacugguucucccgggagaacagcuacuccggcguggagggggagggccugcacaagcucggcuacauccugcgcgacaucagcaagauccccgggggcgccauguacgccgacgacaccgccgggugggacacccggaucaccgaggacgaccugcacaacgaggagaagaucacgcagcagauggacccggagcaccgccagcucgcgaacgccaucuucaagcugaccuaccagaacaaggucgugaaggugcagcggcccacccccaccggcaccgucauggacaucaucucccgcaaggaccagcggggcagcggccaggugggcacguacgggcugaacaccuucaccaacauggaggcccagcucauccgccagauggagggcgagggggugcuguccaaggccgaccuggagaacccccaccucccggagaagaagaucacccaguggcuggagacgaagggcgucgagcggcugcgccggauggccaucagcggcgacgacugcguggugaagcccaucgacgaccgcuucgcgaacgcccuccuggcccugaacgacauggggaagguccggaaggacaucccccaguggcagcccuccaagggcuggcacgacuggcagcaggucccguucugcagccaccacuuccacgagcucaucaugaaggacgggcgcaagcuggugguccccugccggccccaggacgagcugaucggccgcgcccggaucucccagggggcgggcuggagccuccgcgagaccgccugccugggcaaggccuacgcccagauguggucccugauguacuuccaccgccgggaccuccgccuggccagcaacgcgaucugcuccgccgugcccgugcacugggucccgaccagccggaccacgugguccauccacgcccaccaccaguggaugaccaccgaggacaugcugaccguguggaaccgcguguggaucgaggacaaccccuggauggaggacaagacgcccgucaccaccugggagaacgugcccuaccucgggaagcgggaggaccaguggugcggcagccugaucgggcugaccagccgcgccacgugggcccagaacaucccgaccgcgauccagcagguccggucccucaucggcaacgaggaguuccuggacuacaugcccagcaugaagcgcuuccggaaggaggaggaguccgagggggccaucugguga

SEQ ID NO: 10164 - RNA, 9873 nt, Artificial Sequence
  derived and/or modified CDS sequence (opt1) from DENV-3__FJ024468__SS-prME
accagccugugccucaugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucggggugaucacccucuaccugggcgccgugguccaggcggacauggggugcgugaucaacuggaagggcaaggagcugaagugcggcagcgggaucuucgugacgaacgagguccacaccuggaccgagcaguacaaguuccaggccgacucccccaagcgccucgccaccgccaucgccggcgcgugggagaacggggugugcggcauccgcagcacgacccggauggagaaccugcuguggaagcagaucgccaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgcgucccgggccuggaacgugugggagguggaggacuacggguucggcgucuucaccaccaacaucuggcucaagcugcgcgagguguacacccagcugugcgaccaccggcucaugagcgccgccgugaaggacgagcgcgccguccacgcggacaugggcuacuggaucgagagccagaagaacggguccuggaagcuggagaaggccagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgcgauccuguucgaggaggugaugcgggggaaguucggcaagaagcacaugaucgccgggguguucuucaccuucguccugcuccuguccggccagaucaccuggcgcgacauggcccacacccugaucaugaucggcagcaacgccuccgacaagauggggaugggcgugacguaccucgcccugaucgcgaccuucaagauccagcccuuccuggcccucggguucuuccugcggaagcugaccagccgcgagaaccuccugcugggcgugggccucgccauggccaccacgcugcagcugcccgaggacaucgagcagauggcgaacgggaucgcccucggccugauggcccugaagcucaucacccaguucgagaccuaccagcuguggaccgcccugaucagccucacgugcuccaacaccauguucacccugaccgucgccuggcggacggcgacccugauccucgccggggugagccugcugccggucugccaguccagcuccaugcgcaagaccgacuggcuccccauggccguggccgccaugggcgugccgccccucccgcuguucaucuucagccucaaggacacccugaagcggcgcuccuggccccugaacgagggggucauggcggugggccucgugagcauccuggccuccagccugcuccgcaacgacguccccauggccggcccccugguggccgggggccugcucaucgccugcuacgugaucacggggaccuccgcggaccugaccgucgagaaggccgccgacaucaccugggaggaggaggccgagcagacgggcgugagccacaaccugaugaucaccguggacgacgacgggaccaugcggaucaaggacgacgagaccgagaacauccucaccguccugcugaagacggcccuccugaucguguccggcguguucccguacagcauccccgcgacccugcucgucuggcacaccuggcagaagcagacccagcgcuccggcgugcugugggacgugcccagcccgcccgagacgcagaaggccgagcuggaggagggggucuaccggaucaagcagcagggcaucuucgggaagacccaggugggcguggggguccagaaggagggcguguuccacaccauguggcacgugacccgcggcgccguccucacguacaacgggaagcggcuggagcccaacugggccuccgugaagaaggaccugaucagcuacggcgggggcuggcgccucuccgcgcaguggcagaagggggaggaggugcaggucaucgccguggagcccggcaagaaccccaagaacuuccagaccaugcccggcaccuuccagaccacgaccggggagaucggcgccaucgcccuggacuucaagcccgggaccagcggcagccccaucaucaaccgggagggcaagguggucgggcuguacggcaacgggguggugaccaagaacggcggguacgucuccggcaucgcccagacgaacgcggagccggacggccccacccccgagcuggaggaggagauguucaagaagcgcaaccucaccaucauggaccugcaccccgggagcggcaagacccggaaguaccugccggccaucgugcgcgaggccaucaagcggcgccuccggacgcugauccuggcccccacccgcguggucgccgcggagauggaggaggcccucaaggggcugcccauccgguaccagaccaccgccacgaaguccgagcacaccggccgcgagaucguggaccugaugugccacgccaccuucaccaugcggcuccugagccccgugcgcgucccgaacuacaaccugaucaucauggacgaggcccacuucacggaccccgcguccaucgccgcccggggguacaucagcacccgcgugggcaugggcgaggccgcggccaucuucaugaccgccacgccgcccgggacggccgacgccuucccgcaguccaacgcgcccauccaggacgaggagcgggacauccccgagcgcagcuggaacuccggcaacgaguggaucaccgacuucgccgggaagaccgugugguucguccccagcaucaaggccggcaacgacaucgccaacugccuccgcaagaacgggaagaaggugauccagcugucccggaagaccuucgacacggaguaccagaagaccaagcugaacgacugggacuucguggucaccaccgacaucagcgagaugggcgccaacuucaaggcggaccgcgugaucgacccgcggcgcugccucaagcccgugauccugacggacggccccgagcgggucauccuggccgggcccaugccggugaccgccgccuccgccgcgcagcgccggggccgcguggggcggaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgcgagaaguccgcggccaucgacggcgaguaccggcugaagggcgagucccgcaagacguucgucgagcugaugcggcgcggggaccuccccguguggcuggcccacaaggucgccagcgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcccggaccuacuccgacccgcuggcgcucaaggaguucaaggacuucgccgccggccgcaagagcaucgcccuggaccuggugacggagaucgggcgcguccccucccaccucgcccaccggacccgcaacgcgcuggacaaccuggugaugcuccacaccagcgagcacggcgggcgggccuaccgccacgccguggaggagcugcccgagaccauggagacgcugcuccugcugggccucaugauccugcugaccgggggcgccaugcuguuccugaucagcggcaaggggaucggcaagaccuccaucgggcugaucugcgucaucgccagcuccggcaugcucuggauggcggagaucccgcugcaguggaucgccagcgccaucgugcuggaguucuucaugauggugcuccugauccccgagcccgagaagcagcggacgccccaggacaaccagcuggccuacgucgugaucgggauccucacgcuggccgcgaucaucgccgccaacgagaugggccugcucgagaccaccaagcgcgaccugggcauguccaaggagccggggguggucagccccaccuccuaccuggacguggaccuccaccccgccagcgcguggacgcuguacgccguggccaccaccgucaucacccccaugcugcggcacacgaucgagaacuccaccgccaacgugagccucgccgcgaucgccaaccaggccgugguccugaugggccuggacaagggguggccgaucuccaagauggaccucggcgugccccugcuggcccucgggugcuacagccaggugaacccccugacccugaccgccgcgguccuccugcugaucacgcacuacgccaucaucggccccggccuccaggccaaggccacccgcgaggcccagaagcggaccgcggccgggaucaugaagaacccgaccguggacggcaucaugacgaucgaccuggaccccgugaucuacgacuccaaguucgagaagcagcuggggcaggucaugcuccuggugcugugcgccgugcagcuccugcugaugcgcaccagcugggcccucugcgaggcgcugacccuggccaccggccccaucacgacccucugggagggcucccccgggaaguucuggaacaccaccaucgccgucagcauggccaacaucuuccggggcuccuaccuggccggggcgggccuggccuucagcaucaugaaguccguggggacgggcaagcgcggcaccgggagccagggcgagacccucggggagaaguggaagaagaagcugaaccagcugagccggaaggaguucgaccucuacaagaaguccggcaucaccgagguggaccgcaccgaggccaaggaggggcugaagcggggcgagacgacccaccacgccgucagccgcggcaccgccaagcugcagugguucguggagcggaacauggugaucccggaggggcgcgucaucgaccucggcugcgggcggggcgggugguccuacuacugcgcgggccugaagaaggugaccgaggugcgcggcuacacgaagggcgggcccgggcacgaggagcccguccccaugagcaccuacggcuggaacaucgugaagcugauguccgggaaggacguguucuaccucccgcccgagaagugcgacacccugcugugcgacaucggcgagagcucccccagccccaccgucgaggagucccggacgauccgcgugcugaagaugguggagccguggcucaagaacaaccaguucugcaucaagguccugaaccccuacaugcccaccgugaucgagcaccuggagcgccuccagcggaagcacggcgggaugcuggugcgcaacccccugagccggaacuccacccacgagauguacuggaucagcaacggcaccgggaacaucgucgccuccgugaacauggugagccgccuccugcugaaccgguucacgaugacccaccgccggccgaccaucgagaaggacgucgaccucggcgccggcacccgccacgugaacgccgagcccgagacgcccaacauggacgugaucggggagcggaucaagcgcaucaaggaggagcacaacuccaccuggcacuacgacgacgagaacccguacaagaccugggccuaccacggcagcuacgaggucaaggcgaccggguccgccagcuccaugaucaacggcguggucaagcugcugacgaagcccugggacguggugcccauggucacccagauggccaugaccgacaccacgcccuucgggcagcagcggguguucaaggagaagguggacacccgcaccccgcggagcaugcccggcacccgccgggucaugggcaucacggccgaguggcucuggcgcacccuggggcggaacaagaagccccgccugugcacccgggaggaguucaccaagaaggugcgcacgaacgcggccaugggcgccguguucaccgaggagaaccagugggacagcgccaaggccgcggucgaggacgaggacuucuggaagcucguggaccgcgagcgggagcugcacaagcuggggaagugcggcuccugcguguacaacaugauggggaagcgcgagaagaagcucggcgaguucggcaaggccaaggggagccgggccaucugguacauguggcugggcgcccgcuaccuggaguucgaggcccucggguuccugaacgaggaccacugguucucccgggagaacagcuacuccggcgucgagggggagggccugcacaagcucggcuacauccugcgcgacaucagcaagauccccgggggcgcgauguacgccgacgacaccgccgggugggacacccggaucacggaggacgaccugcacaacgaggagaagaucacccagcagauggacccggagcaccgccagcucgccaacgccaucuucaagcugaccuaccagaacaagguggugaagguccagcggcccacccccaccggcacggugauggacaucaucucccgcaaggaccagcggggcagcggccaggugggcaccuacgggcugaacaccuucaccaacauggaggcgcagcucauccgccagauggagggcgaggggguccuguccaaggccgaccuggagaacccccaccucccggagaagaagaucacgcaguggcuggagaccaagggcguggagcggcugcgccggauggccaucagcggcgacgacugcguggucaagcccaucgacgaccgcuucgccaacgcccuccuggcgcugaacgacauggggaaggugcggaaggacaucccccaguggcagcccuccaagggcuggcacgacuggcagcaggucccguucugcagccaccacuuccacgagcucaucaugaaggacgggcgcaagcuggucgugcccugccggccccaggacgagcugaucggccgcgcccggaucucccagggggccggcuggagccuccgcgagaccgccugccugggcaaggcguacgcccagauguggucccugauguacuuccaccgccgggaccuccgccuggccagcaacgccaucugcuccgccgugcccguccacugggugccgaccagccggacgaccugguccauccacgcgcaccaccaguggaugaccaccgaggacaugcugacgguguggaaccgcgucuggaucgaggacaaccccuggauggaggacaagacccccgugaccaccugggagaacgugcccuaccucgggaagcgggaggaccaguggugcggcagccugaucgggcugacgagccgcgccaccugggcccagaacaucccgaccgccauccagcagguccggucccucaucggcaacgaggaguuccuggacuacaugcccagcaugaagcgcuuccggaaggaggaggaguccgagggggccaucugguga

SEQ ID NO: 10165 - RNA, 9873 nt, Artificial Sequence
  derived and/or modified CDS sequence (opt1) from DENV-3__FJ024470__SS-prME
accagccugugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgcccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacaccgugaucaucacggugcacaccggggaccagcaccaggucggcaacgagacccagggggugaccgccgagaucacgccccaggcgagcaccaccgaggccauccugcccgaguacggcacccuggggcucgagugcuccccgcgcaccggccuggacuucaacgagaugauccugcucacgaugaagaacaaggccuggaugguccaccggcagugguucuucgaccugccccugcccuggaccagcggcgccaccaccgagacgcccaccuggaaccgcaaggagcuccuggugaccuucaagaacgcccacgcgaagaagcaggagguggucgugcuggggucccaggagggcgccaugcacaccgcccucacgggggccaccgagauccagaacagcggcgggaccuccaucuucgccggccaccugaagugccggcugaagauggacaagcucgagcugaagggcaugagcuacgcgaugugcaccaacacguucgugcugaagaaggaggucuccgagacccagcacgggaccauccucaucaagguggaguacaagggcgaggacgugccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgcgucccgggccuggaacgucugggagguggaggacuacggguucggcguguucaccaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccguggucaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcgggaagguggacaacuucacgaugggcgugcugugccucgcgauccuguucgaggaggucaugcgggggaaguucggcaagaagcacaugaucgccgggguguucuucaccuucgugcugcuccuguccggccagaucaccuggcgcgacauggcccacacccugaucaugaucggcagcaacgccuccgaccggauggggaugggcgucacguaccucgcccugaucgcgaccuucaagauccagcccuuccuggcccucggguucuuccugcgcaagcugaccagccgggagaaccuccugcugggcgugggccucgccauggccaccacgcugcagcugcccgaggacaucgagcagauggcgaacgggaucgcccucggccugauggcccugaagcucaucacccaguucgagaccuaccagcuguggaccgcccugaucagccucacgugcuccaacaccaucuucacccugaccguggccuggcgcacggcgacccugauccucgccggggucagccugcugccggugugccaguccagcuccaugcggaagaccgacuggcuccccauggccgucgccgccaugggcgugccgccccucccgcuguucaucuucagccucaaggacacccugaagcgccgcuccuggccccugaacgagggggugauggcggucggccucgugagcauccuggccuccagccugcuccggaacgacgugcccauggccggcccccuggucgccgggggccugcucaucgccugcuacgugaucacggggaccuccgcggaccugaccguggagaaggccgccgacaucaccugggaggaggaggccgagcagacgggcgucagccacaaccugaugaucaccguggacgacgacgggaccaugcgcaucaaggacgacgagaccgagaacauccucaccgugcugcugaagacggcccuccugaucgucuccggcaucuucccguacagcauccccgcgacccugcucguguggcacaccuggcagaagcagacccagcgguccggcgugcugugggacguccccagcccgcccgagacgcagaaggccgagcuggaggaggggguguaccgcaucaagcagcagggcaucuucgggaagacccaggugggcgucggggugcagaaggagggcguguuccacaccauguggcacgucacccggggcgccgugcucacguacaacgggaagcgccuggagcccaacugggccuccgugaagaaggaccugaucagcuacggcgggggcuggcggcucuccgcgcaguggcagaagggggaggagguccaggugaucgccguggagcccggcaagaaccccaagaacuuccagaccaugcccggcaccuuccagaccacgaccggggagaucggcgccaucgcccuggacuucaagcccgggaccagcggcagccccaucaucaaccgcgagggcaaggucguggggcuguacggcaacgggguggucaccaagaacggcggguacguguccggcaucgcccagacgaacgcggagccggacggccccacccccgagcuggaggaggagauguucaagaagcggaaccucaccaucauggaccugcaccccgggagcggcaagacccgcaaguaccugccggccaucgugcgggaggccaucaagcgccggcuccgcacgcugauccuggcccccacccgggucguggccgcggagauggaggaggcccucaaggggcugcccauccgcuaccagaccaccgccacgaaguccgagcacaccggccgggagaucguggaccugaugugccacgccaccuucaccaugcgccuccugagccccguccgggugccgaacuacaaccugaucaucauggacgaggcccacuucacggaccccgcguccaucgccgcccgcggguacaucagcacccgggugggcaugggcgaggccgcggccaucuucaugaccgccacgccgcccgggacggccgacgccuucccgcaguccaacgcgcccauccaggacgaggagcgcgacauccccgagcgcagcuggaacuccggcaacgaguggaucaccgacuucgccgggaagaccgucugguucgugcccagcaucaaggccggcaacgacaucgccaacugccuccggaagaacgggaagaaggugauccagcugucccgcaagaccuucgacacggaguaccagaagaccaagcugaacgacugggacuucgucgugaccaccgacaucagcgagaugggcgccaacuucaaggcggaccgggugaucgacccgcgccggugccucaagcccgucauccugacggacggccccgagcgcgugauccuggccgggcccaugccggugaccgccgccuccgccgcgcagcggcgcggccgggucgggcgcaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgggagaaguccgcggccaucgacggcgaguaccgccugaagggcgagucccggaagacguucguggagcugaugcgccgcggggaccuccccguguggcuggcccacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcaccuacuccgacccgcuggcgcucaaggaguucaaggacuucgccgccggccgcaagagcaucgcccuggaccuggucacggagaucgggcgggugcccucccaccucgcccaccgcacccggaacgcgcuggacaaccuggugaugcuccacaccagcgagcacggcgggcgcgccuaccggcacgccgucgaggagcugcccgagaccauggagacgcugcuccugcugggccucaugauccugcugaccgggggcgccaugcuguuccugaucagcggcaaggggaucggcaagaccuccaucgggcugaucugcgugaucgccagcuccggcaugcucuggauggcggagaucccgcugcaguggaucgccagcgccaucgugcuggaguucuucaugaugguccuccugauccccgagcccgagaagcagcgcacgccccaggacaaccagcuggccuacguggugaucgggauccucacgcuggccgcgaucaucgccgccaacgagaugggccugcucgagaccaccaagcgggaccugggcauguccaaggagccgggggucgugagccccaccuccuaccuggacguggaccuccaccccgccagcgcguggacgcuguacgccgucgccaccaccgugaucacccccaugcugcgccacacgaucgagaacuccaccgccaacgugagccucgccgcgaucgccaaccaggccgucgugcugaugggccuggacaagggguggccgaucuccaagauggaccucggcgugccccugcuggcccucgggugcuacagccaggucaacccccugacccugaccgccgcggugcuccugcugaucacgcacuacgccaucaucggccccggccuccaggccaaggccacccgggaggcccagaagcgcaccgcggccgggaucaugaagaacccgaccguggacggcaucaugacgaucgaccuggaccccgucaucuacgacuccaaguucgagaagcagcugggccaggugaugcuccuggugcugugcgccguccagcuccugcugaugcggaccagcugggcccucugcgaggcgcugacccuggccaccggccccaucacgacccucugggagggcucccccgggaaguucuggaacaccaccaucgccgugagcauggccaacaucuuccgcggcuccuaccuggccggggcgggccuggccuucagcaucaugaaguccguggggacgggcaagcggggcaccgggagccagggcgagacccucggggagaaguggaagaagaagcugaaccagcugagccgcaaggaguucgaccucuacaagaaguccggcaucaccgaggucgaccggaccgaggccaaggaggggcugaagcgcggcgagaucacgcaccacgccgugagccggggcuccgccaagcugcagugguucguggagcgcaacauggucaucccggaggggcgggugaucgaccucggcugcgggcgcggcggguggagcuacuacugcgcgggccugaagaaggugaccgagguccggggcuacaccaagggcgggcccgggcacgaggagcccgugcccauguccaccuacggcuggaacaucgugaagcugaugagcgggaaggacgucuucuaccucccgcccgagaagugcgacacgcugcugugcgacaucggcgaguccagccccucccccaccguggaggagagccgcaccauccgcgugcugaagauggucgagccguggcucaagaacaaccaguucugcaucaaggugcugaaccccuacaugcccaccgugaucgagcaccuggagcggcuccagcgcaagcacggcgggaugcugguccggaacccccugucccgcaacagcacgcacgagauguacuggaucuccaacggcaccgggaacaucguggccagcgugaacauggucucccggcuccugcugaaccgcuucaccaugacccaccggcgcccgacgaucgagaaggacguggaccucggcgccggcacccggcacgugaacgccgagcccgagacccccaacauggacgucaucggggagcgcaucaagcggaucaaggaggagcacaacagcaccuggcacuacgacgacgagaacccguacaagacgugggccuaccacggcuccuacgaggugaaggcgaccgggagcgccuccagcaugaucaacggcguggucaagcugcugaccaagcccugggacgugguccccauggugacccagauggccaugacggacaccacccccuucgggcagcagcgcguguucaaggagaaggucgacacccggacgccgcgcagcaugcccggcacccggcgcgugaugggcaucaccgccgaguggcucuggcggacccuggggcgcaacaagaagccccggcugugcacgcgcgaggaguucaccaagaaggugcgcaccaacgcggccaugggcgccgucuucaccgaggagaaccagugggacuccgccaaggccgcgguggaggacgaggacuucuggaagcucguggaccgggagcgcgagcugcacaagcuggggaagugcggcagcugcgucuacaacaugauggggaagcgggagaagaagcucggcgaguucggcaaggccaaggggucccgcgccaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgcgauguacgccgacgacacggccgggugggacacccgcaucaccgaggacgaccugcacaacgaggagaagaucacccagcagauggacccggagcaccggcagcucgccaacgccaucuucaagcugacguaccagaacaagguggucaaggugcagcgccccacccccaccggcaccgugauggacaucaucagccggaaggaccagcgcggcuccgggcaggucggcaccuacgggcugaacacguucaccaacauggaggcgcagcucauccggcagauggagggcgagggggugcugagcaaggccgaccuggagucccaccaccuccccgagaagaagaucacccaguggcuggagaccaagggcguggagcgccugaagcggauggccaucagcggcgacgacugcgucgugaagccgaucgacgaccgcuucgccaacgcccuccuggcgcugaacgacauggggaaggugcggaaggacaucccccaguggcagcccuccaagggcuggcacgacuggcagcagguccccuucugcagccaccacuuccacgagcucaucaugaaggacgggcgcaagcugguggugccgugccggccccaggacgagcugaucggccgcgcccggaucucccagggggccggcuggagccuccgcgagacggccugccugggcaaggcguacgcccagauguggucccugauguacuuccaccgccgggaccuccgccuggccagcaacgccaucugcuccgccguccccgugcacugggugcccaccagccggaccaccuggagcauccacgcgcaccaccaguggaugacgaccgaggacaugcugaccgucuggaaccgcguguggaucgaggacaacccguggauggaggacaagacccccgugacgaccugggagaacguccccuaccucgggaagcgggaggaccaguggugcggcucccugaucgggcugaccagccgcgccaccugggcccagaacauccccacggccauccagcagguccggucccucaucggcaacgaggaguuccuggacuacaugccgagcaugaagcgcuuccggaaggaggaggaguccgagggggccaucugguga

SEQ ID NO: 10166 - RNA, 9873 nt, Artificial Sequence
  derived and/or modified CDS sequence (opt1) from DENV-3__FJ024471__SS-prME
accagccugugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgcccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacaccgugaucaucacggugcacaccggggaccagcaccaggucggcaacgagacccagggggugaccgccgagaucacgccccaggcgagcaccaccgaggccauccugcccgaguacggcacccuggggcucgagugcuccccgcgcaccggccuggacuucaacgagaugauccugcucacgaugaagaacaaggccuggaugguccaccggcagugguucuucgaccugccccugcccuggaccagcggcgccaccaccgagacgcccaccuggaaccgcaaggagcuccuggugaccuucaagaacgcccacgcgaagaagcaggagguggucgugcuggggucccaggagggcgccaugcacaccgcccucacgggggccaccgagauccagaacagcggcgggaccuccaucuucgccggccaccugaagugccggcugaagauggacaagcucgagcugaagggcaugagcuacgcgaugugcaccaacacguucgugcugaagaaggaggucuccgagacccagcacgggaccauccucaucaagguggaguacaagggcgaggacgugccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgcgucccgggccuggaacgucugggagguggaggacuacggguucggcguguucaccaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccguggucaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcgggaagguggacaacuucacgaugggcgugcugugccucgcgauccuguucgaggaggucaugcgggggaaguucggcaagaagcacaugaucgccgggguguucuucaccuucgugcugcuccuguccggccagaucaccuggcgcgacauggcccacacccugaucaugaucggcagcaacgccuccgaccggauggggaugggcgucacguaccucgcccugaucgcgaccuucaagauccagcccuuccuggcccucggguucuuccugcgcaagcugaccagccgggagaaccuccugcugggcgugggccucgccauggccaccacgcugcagcugcccgaggacaucgagcagauggcgaacgggaucgcccucggccugauggcccugaagcucaucacccaguucgagaccuaccagcuguggaccgcccugaucagccucacgugcuccaacaccaucuucacccugaccguggccuggcgcacggcgacccugauccucgccggggucagccugcugccggugugccaguccagcuccaugcggaagaccgacuggcuccccauggccgucgccgccaugggcgugccgccccucccgcuguucaucuucagccucaaggacacccugaagcgccgcuccuggccccugaacgagggggugauggcggucggccucgugagcauccuggccuccagccugcuccggaacgacgugcccauggccggcccccuggucgccgggggccugcucaucgccugcuacgugaucacggggaccuccgcggaccugaccguggagaaggccgccgacaucaccugggaggaggaggccgagcagacgggcgucagccacaaccugaugaucaccguggacgacgacgggaccaugcgcaucaaggacgacgagaccgagaacauccucaccgugcugcugaagacggcccuccugaucgucuccggcaucuucccguacagcauccccgcgacccugcucguguggcacaccuggcagaagcagacccagcgguccggcgugcugugggacguccccagcccgcccgagacgcagaaggccgagcuggaggaggggguguaccgcaucaagcagcagggcaucuucgggaagacccaggugggcgucggggugcagaaggagggcguguuccacaccauguggcacgucacccggggcgccgugcucacguacaacgggaagcgccuggagcccaacugggccuccgugaagaaggaccugaucagcuacggcgggggcuggcggcucuccgcgcaguggcagaagggggaggagguccaggugaucgccguggagcccggcaagaaccccaagaacuuccagaccaugcccggcaccuuccagaccacgaccggggagaucggcgccaucgcccuggacuucaagcccgggaccagcggcagccccaucaucaaccgcgagggcaaggucguggggcuguacggcaacgggguggucaccaagaacggcggguacguguccggcaucgcccagacgaacgcggagccggacggccccacccccgagcuggaggaggagauguucaagaagcggaaccucaccaucauggaccugcaccccgggagcggcaagacccgcaaguaccugccggccaucgugcgggaggccaucaagcgccggcuccgcacgcugauccuggcccccacccgggucguggccgcggagauggaggaggcccucaaggggcugcccauccgcuaccagaccaccgccacgaaguccgagcacaccggccgggagaucguggaccugaugugccacgccaccuucaccaugcgccuccugagccccguccgggugccgaacuacaaccugaucaucauggacgaggcccacuucacggaccccgcguccaucgccgcccgcggguacaucagcacccgggugggcaugggcgaggccgcggccaucuucaugaccgccacgccgcccgggacggccgacgccuucccgcaguccaacgcgcccauccaggacgaggagcgcgacauccccgagcgcagcuggaacuccggcaacgaguggaucaccgacuucgccgggaagaccgucugguucgugcccagcaucaaggccggcaacgacaucgccaacugccuccggaagaacgggaagaaggugauccagcugucccgcaagaccuucaacacggaguaccagaagaccaagcugaacgacugggacuucgucgugaccaccgacaucagcgagaugggcgccaacuucaaggcggaccgggugaucgacccgcgccggugccucaagcccgucauccugacggacggccccgagcgcgugauccuggccgggcccaugccggugaccgccgccuccgccgcgcagcggcgcggccgggucgggcgcaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgggagaaguccgcggccaucgacggcgaguaccgccugaagggcgagucccggaagacguucguggagcugaugcgccgcggggaccuccccguguggcuggcccacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcaccuacuccgacccgcuggcgcucaaggaguucaaggacuucgccgccggccgcaagagcaucgcccuggaccuggucacggagaucgggcgggugcccucccaccucgcccaccgcacccggaacgcgcuggacaaccuggugaugcuccacaccagcgagcacggcgggcgcgccuaccggcacgccgucgaggagcugcccgagaccauggagacgcugcuccugcugggccucaugauccugcugaccgggggcgccaugcuguuccugaucagcggcaaggggaucggcaagaccuccaucgggcugaucugcgugaucgccagcuccggcaugcucuggauggcggagaucccgcugcaguggaucgccagcgccaucgugcuggaguucuucaugaugguccuccugauccccgagcccgagaagcagcgcacgccccaggacaaccagcuggccuacguggugaucgggauccucacgcuggccgcgaucaucgccgccaacgagaugggccugcucgagaccaccaagcgggaccugggcauguccaaggagccgggggucgugagccccaccuccuaccuggacguggaccuccaccccgccagcgcguggacgcuguacgccgucgccaccaccgugaucacccccaugcugcgccacacgaucgagaacuccaccgccaacgugagccucgccgcgaucgccaaccaggccgucgugcugaugggccuggacaagggguggccgaucuccaagauggaccucggcgugccccugcuggcccucgggugcuacagccaggucaacccccugacccugaccgccgcggugcuccugcugaucacgcacuacgccaucaucggccccggccuccaggccaaggccacccgggaggcccagaagcgcaccgcggccgggaucaugaagaacccgaccguggacggcaucaugacgaucgaccuggaccccgucaucuacgacuccaaguucgagaagcagcugggccaggugaugcuccuggugcugugcgccguccagcuccugcugaugcggaccagcugggcccucugcgaggcgcugacccuggccaccggccccaucacgacccucugggagggcucccccgggaaguucuggaacaccaccaucgccgugagcauggccaacaucuuccgcggcuccuaccuggccggggcgggccuggccuucagcaucaugaaguccguggggacgggcaagcggggcaccgggagccagggcgagacccucggggagaaguggaagaagaagcugaaccagcugagccgcaaggaguucgaccucuacaagaaguccggcaucaccgaggucgaccggaccgaggccaaggaggggcugaagcgcggcgagaucacgcaccacgccgugagccggggcuccgccaagcugcagugguucguggagcgcaacauggucaucccggaggggcgggugaucgaccucggcugcgggcgcggcggguggagcuacuacugcgcgggccugaagaaggugaccgagguccggggcuacaccaagggcgggcccgggcacgaggagcccgugcccauguccaccuacggcuggaacaucgugaagcugaugagcgggaaggacgucuucuaccucccgcccgagaagugcgacacgcugcugugcgacaucggcgaguccagccccucccccaccguggaggagagccgcaccauccgcgugcugaagauggucgagccguggcucaagaacaaccaguucugcaucaaggugcugaaccccuacaugcccaccgugaucgagcaccuggagcggcuccagcgcaagcacggcgggaugcugguccggaacccccugucccgcaacagcacgcacgagauguacuggaucuccaacggcaccgggaacaucguggccagcgugaacauggucucccggcuccugcugaaccgcuucaccaugacccaccggcgcccgacgaucgagaaggacguggaccucggcgccggcacccggcacgugaacgccgagcccgagacccccaacauggacgucaucggggagcgcaucaagcggaucaaggaggagcacaacagcaccuggcacuacgacgacgagaacccguacaagacgugggccuaccacggcuccuacgaggugaaggcgaccgggagcgccuccagcaugaucaacggcguggucaagcugcugaccaagcccugggacgugguccccauggugacccagauggccaugacggacaccacccccuucgggcagcagcgcguguucaaggagaaggucgacacccggacgccgcgcagcaugcccggcacccggcgcgugaugggcaucaccgccgaguggcucuggcggacccuggggcgcaacaagaagccccggcugugcacgcgcgaggaguucaccaagaaggugcgcaccaacgcggccaugggcgccgucuucaccgaggagaaccagugggacuccgccaaggccgcgguggaggacgaggacuucuggaagcucguggaccgggagcgcgagcugcacaagcuggggaagugcggcagcugcgucuacaacaugauggggaagcgggagaagaagcucggcgaguucggcaaggccaaggggucccgcgccaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgcgauguacgccgacgacacggccgggugggacacccgcaucaccgaggacgaccugcacaacgaggagaagaucacccagcagauggacccggagcaccggcagcucgccaacgccaucuucaagcugacguaccagaacaagguggucaaggugcagcgccccacccccaccggcaccgugauggacaucaucagccggaaggaccagcgcggcuccgggcaggucggcaccuacgggcugaacacguucaccaacauggaggcgcagcucauccggcagauggagggcgagggggugcugagcaaggccgaccuggagucccaccaccucagcgagaagaagaucacccaguggcuggagaccaagggcguggagcgccugaagcggauggccaucuccggcgacgacugcgucgugaagcccaucgacgaccgcuucgccaacgcccuccuggcgcugaacgacauggggaaggugcggaaggacaucccgcaguggcagcccagcaagggcuggcacgacuggcagcagguccccuucugcucccaccacuuccacgagcucaucaugaaggacgggcgcaagcugguggugcccugccggccgcaggacgagcugaucggccgcgcccggaucagccagggggccggcuggucccuccgcgagacggccugccugggcaaggcguacgcccagauguggagccugauguacuuccaccgccgggaccuccgccuggccuccaacgccaucugcagcgccguccccgugcacugggugcccaccagccggaccaccugguccauccacgcgcaccaccaguggaugacgaccgaggacaugcugaccgucuggaaccgcguguggaucgaggacaaccccuggauggaggacaagaccccggugacgaccugggagaacguccccuaccucgggaagcgggaggaccaguggugcggcagccugaucgggcugaccucccgcgccaccugggcccagaacauccccacggccauccagcagguccggagccucaucggcaacgaggaguuccuggacuacaugcccuccaugaagcgcuuccggaaggaggaggagagcgagggggccaucugguga

SEQ ID NO: 10167 - RNA, 9873 nt, Artificial Sequence
  derived and/or modified CDS sequence (opt1) from DENV-3__FJ182005__SS-prME
accagccucugccucaugaugauccugcccgccgcccuggcguuccaccucaccagccgggacggggagccgcggaugaucguggggaagaacgagcgcggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaaggugcccuucagcaccgaggacgggcagggcaaggcgcacagcggccgccugaucacggccaaccccguggucaccaagaaggaggagcccgugaacaucgaggccgagccgcccuucggggaguccaacaucgugaucggcaucggggacaacgcccugaagaucaacugguacaagaagggcagcuccaucgggaagauguucgaggcgaccgcccggggcgcccgccggauggccauccugggcgacaccgccugggacuucgggagcgucggcggggugcucaacucccugggcaagauggugcaccagaucuucgggagcgcguacacggcccuguucuccggcgucagcugggugaugaagaucggcaucgggauccuccugaccuggaucggccugaacuccaagaacaccagcauguccuucagcugcaucgugaucgggaucaucacccucuaccugggcgccgucgugcaggccgacauggggugcgugaucaacuggaagggcaaggagcugaagugcggcuccgggaucuucgucacgaacgaggugcacaccuggaccgagcaguacaaguuccaggccgacagccccaagcgccucgcgaccgccaucgccggcgccugggagaacggggugugcggcauccgcuccacgacccggauggagaaccugcuguggaagcagaucgccaacgagcucaacuacauccugugggagaacaacaucaagcugaccgucguggugggggacaucaucggcguccucgagcagggcaagcgcacccugacgccccagccgauggagcugaaguacagcuggaaggcgugggggaaggccaagaucgugaccgccgagacccagaacuccagcuucaucaucgacggccccaacacccccgagugccccuccgccagccgggcguggaacgugugggaggucgaggacuacggguucggcguguucacgaccaacaucuggcucaagcugcgcgagguguacacccagcugugcgaccaccggcucaugagcgccgccgucaaggacgagcgcgccgugcacgccgacaugggcuacuggaucgagucccagaagaacgggagcuggaagcuggagaaggcgucccugaucgaggugaagaccugcaccuggcccaagucccacacgcucugguccaacggcguccuggagagcgacaugaucauccccaagucccuggccgggcccaucagccagcacaacuaccggccgggcuaccacacccagaccgccgggcccuggcaccucggcaagcuggagcuggacuucaacuacugcgagggcaccacgguggugaucaccgagaacugcgggacccgcggccccucccuccggaccacgaccgucagcgggaagcugauccacgaguggugcugccgcuccugcacccugcccccgcuccgguacaugggcgaggacgggugcugguacggcauggagauccgccccaucagcgagaaggaggagaacauggugaagucccuggugagcgccggcuccgggaaggucgacaacuucaccaugggcgugcugugccucgccauccuguucgaggaggugaugcgggggaaguucggcaagaagcacaugaucgcgggggucuucuucacguucgugcugcuccugagcggccagaucaccuggcgcgacauggcccacacccugaucaugaucggcuccaacgccagcgaccggauggggaugggcgugaccuaccucgcccugaucgccacguucaagauccagcccuuccuggcgcucggguucuuccugcgcaagcugaccagccgggagaaccuccugcugggcgucggccucgccauggccaccacccugcagcugcccgaggacaucgagcagauggccaacgggaucgcgcucggccugauggcccugaagcucaucacgcaguucgagaccuaccagcuguggaccgcccugaucucccugaccugcagcaacacgaucuucacccugaccguggccuggcgcaccgccacgcugauccucgcgggggucucccugcugccggugugccagagcuccagcaugcggaagaccgacuggcuccccaugaccguggccgccaugggcgugccgccccucccgcuguucaucuucucccucaaggacacccugaagcgccgcagcuggccccugaacgagggggugauggccgugggccucgucuccauccuggccagcucccugcuccggaacgacgugcccauggcgggcccccugguggccgggggccugcucaucgccugcuacgucaucacggggaccagcgccgaccugaccguggagaaggccgcggacgugaccugggaggaggaggccgagcagacgggcgucucccacaaccugaugaucaccguggacgacgacgggaccaugcgcaucaaggacgacgagaccgagaacauccucaccgugcugcugaagacggcccuccugaucgucagcggcaucuucccguacuccauccccgccacccugcucguguggcacaccuggcagaagcagacccagcggagcggcgugcugugggacguccccagcccgcccgagacgcagaaggccgagcuggaggaggggguguaccgcaucaagcagcagggcaucuucgggaagacccaggugggcgucggggugcagaaggagggcguguuccacaccauguggcacgucacccggggcgcggugcucacguacaacgggaagcgccuggagcccaacugggccagcgugaagaaggaccugaucuccuacggcgggggcuggcggcucagcgcccaguggcagaagggggaggagguccaggugaucgccguggagcccggcaagaaccccaagaacuuccagaccaugcccggcaccuuccagaccacgaccggggagaucggcgcgaucgcccuggacuucaagcccgggaccagcggcucccccaucaucaaccgcgagggcaaggucguggggcuguacggcaacgggguggucaccaagaacggcggguacgugagcggcaucgcccagacgaacgccgagccggacggccccacccccgagcuggaggaggagauguucaagaagcggaaccucaccaucauggaccugcaccccggguccggcaagacccgcaaguaccugccggccaucgugcgggaggcgaucaagcgccggcuccgcacgcugauccuggcccccacccgggucguggccgccgagauggaggaggcccucaaggggcugcccauccgcuaccagaccaccgcgaccaagagcgagcacaccggccgggagaucguggaccugaugugccacgccaccuucaccaugcgccuccugucccccguccgggugccgaacuacaaccugaucaucauggacgaggcccacuucacggaccccgccagcaucgccgcgcgcggguacaucuccacccgggugggcaugggcgaggccgccgccaucuucaugaccgcgacgccgcccgggacggccgacgccuucccgcagagcaacgcccccauccaggacgaggagcgcgacauccccgagcgcuccuggaacagcggcaacgaguggaucaccgacuucgccgggaagaccgucugguucgugcccuccaucaaggcgggcaacgacaucgccaacugccuccggaagaacgggaagaaggugauccagcugagccgcaagaccuucgacacggaguaccagaagaccaagcugaacgacugggacuucgucgugaccaccgacaucuccgagaugggcgccaacuucaaggccgaccgggugaucgacccgcgccggugccucaagcccgucauccugacggacggccccgagcgcgugauccuggccgggcccaugccggugaccgcggccagcgccgcccagcggcgcggccgggucgggcgcaacccccagaaggagaacgaccaguacaucuucaccggccagccccucaacaacgacgaggaccacgcccacuggaccgaggcgaagaugcugcuggacaacaucaacacccccgaggggaucaucccggcccucuucgagcccgagcgggagaaguccgccgccaucgacggcgaguaccgccugaagggcgagagccggaagacguucguggagcugaugcgccgcggggaccuccccgucuggcuggcgcacaagguggccuccgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcaccuacagcgacccgcuggcccucaaggaguucaaggacuucgccgcgggccgcaaguccaucgcccuggaccuggucacggagaucgggcgggugcccagccaccucgcccaccgcacccggaacgcccuggacaaccuggugaugcuccacaccagcgagcacggcgggcgcgccuaccggcacgcggucgaggagcugcccgagaccauggagacgcugcuccugcugggccucaugauccugcugaccgggggcgccaugcuguuccugaucuccggcaaggggaucggcaagaccagcaucgggcugaucugcgugaucgccuccagcggcaugcucuggauggccgagaucccgcugcaguggaucgccuccgcgaucgugcuggaguucuucaugaugguccuccugauccccgagcccgagaagcagcgcacgccccaggacaaccagcuggccuacguggugaucgggauccucacgcuggccgccaucaucgccgcgaacgagaugggccugcucgagaccaccaagcgggaccugggcaugagcaaggagccgggggucgugucccccaccagcuaccuggacguggaccuccaccccgccuccgccuggacgcuguacgccgucgcgaccaccgugaucacccccaugcugcgccacacgaucgagaacagcaccgccaacgugucccucgccgccaucgccaaccaggcggucgugcugaugggccuggacaagggguggccgaucagcaagauggaccucggcgugccccugcuggcccucgggugcuacucccaggucaacccccugacccugaccgccgccgugcuccugcugaucacgcacuacgccaucaucggccccggccuccaggcgaaggccacccgggaggcccagaagcgcaccgccgccgggaucaugaagaacccgaccguggacggcaucaugacgaucgaccuggaccccgucaucuacgacagcaaguucgagaagcagcugggccaggugaugcuccuggugcugugcgcgguccagcuccugcugaugcggaccuccugggcccucugcgaggcccugacccuggccaccggccccaucacgacccucugggagggcagccccgggaaguucuggaacaccaccaucgcgguguccauggccaacaucuuccgcggcagcuaccuggccggggccggccuggccuucuccaucaugaaguccguggggacgggcaagcggggcaccgggagccagggcgagacccucggggagaaguggaagaagaagcugaaccagcugucccgcaaggaguucgaccucuacaagaaguccggcaucaccgaggucgaccggaccgaggcgaaggaggggcugaagcgcggcgagaucacgcaccacgccgugucccggggcagcgccaagcugcagugguucguggagcgcaacauggucaucccggaggggcgggugaucgaccucggcugcgggcgcggcgggugguccuacuacugcgccggccugaagaaggugaccgagguccggggcuacaccaagggcgggcccgggcacgaggagcccgugcccaugagcaccuacggcuggaacaucgugaagcugauguccgggaaggacgucuucuaccucccgcccgagaagugcgacacgcugcugugcgacaucggcgagagcucccccagccccaccguggaggagucccgcaccauccgcgugcugaagauggucgagccguggcucaagaacaaccaguucugcaucaaggugcugaaccccuacaugcccaccgugaucgagcaccuggagcggcuccagcgcaagcacggcgggaugcugguccggaacccccugagccgcaacuccacgcacgagauguacuggaucagcaacggcaccgggaacaucguggccuccgugaacauggucagccggcuccugcugaaccgcuucaccaugacccaccggcgcccgacgaucgagaaggacguggaccucggcgcgggcacccggcacgugaacgccgagcccgagacccccaacauggacgucaucggggagcgcaucaagcggaucaaggaggagcacaacuccaccuggcacuacgacgacgagaacccguacaagacgugggccuaccacggcagcuacgaggugaaggccaccggguccgccagcagcaugaucaacggcgucgugaagcugcugaccaagcccugggacgugguccccauggugacccagauggcgaugacggacaccacccccuucgggcagcagcgcguguucaaggagaaggucgacacccggacgccgcgcuccaugcccggcacccggcgcgugaugggcaucaccgccgaguggcucuggcggacccuggggcgcaacaagaagccccggcugugcacgcgcgaggaguucaccaagaaggugcgcaccaacgccgccaugggcgcggucuucaccgaggagaaccagugggacagcgccaaggccgccguggaggacgaggacuucuggauccucguggaccgggagcgcgagcugcacaagcuggggaagugcggcuccugcgucuacaacaugauggggaagcgggagaagaagcucggcgaguucggcaaggccaaggggagccgcgcgaucugguacauguggcugggcgcccgguaccuggaguucgaggcccucggguuccugaacgaggaccacugguucucccgcgagaacagcuacuccggcguggagggggagggccugcacaagcucggcuacauccugcgggacaucagcaagauccccgggggcgccauguacgccgacgacacggcggggugggacacccgcaucaccgaggacgaccugcacaacgaggagaagaucacccagcagauggacccggagcaccggcagcucgccuccgccaucuucaagcugacguaccagaacaagguggucaaggugcagcgccccacccccaccggcaccgugauggacaucaucagccggaaggaccagcgcggcuccgggcaggucggcaccuacgggcugaacacguucaccaacauggaggcccagcucauccggcagauggagggcgagggggugcugagcaaggccgaccuggagaacccccaccucccggagaagaagaucacccaguggcuggagaccaagggcguggagcgccugaagcggauggcgaucuccggcgacgacugcgucgugaagcccaucgacgaccgcuucgccaacgcccuccuggcccugaacgacauggggaaggugcggaaggacaucccccaguggcagcccagcaagggcuggcacgacuggcagcaggucccguucugcucccaccacuuccacgagcucaucaugaaggacgggcgcaagcugguggugcccugccggccccaggacgagcugaucggccgcgcccggaucagccagggggcgggcuggucccuccgcgagacggccugccugggcaaggccuacgcccagauguggagccugauguacuuccaccgccgggaccuccgccuggcguccaacgccaucugcagcgccguccccgugcacugggugccgaccagccggaccaccugguccauccacgcccaccaccaguggaugacgaccgaggacaugcugaccgucuggaaccgcguguggaucgaggacaaccccuggauggaggacaagacccccgugacgaccugggagaacguccccuaccucgggaagcgggaggaccaguggugcggcagccugaucgggcugaccucccgcgccaccugggcgcagaacaucccgacggccauccagcagguccggagccucaucggcaacgaggaguuccuggacuacaugcccuccaugaagcgcuuccggaaggaggaggagagcgagggggccaucugguga

SEQ ID NO: 10168 - RNA, 9873 nt, Artificial Sequence
  derived and/or modified CDS sequence (opt1) from DENV-3__FJ373302__SS-prME
accagccugugccucaugaugauccugcccgccgcccuggcguuccaccucaccagccgcgacggggagccccggaugaucguggggaagaacgagcgcggcaagagccugcuguucaagaccgccagcgggaucaacaugugcacccucaucgccauggaccugggcgagaugugcgacgacaccgugaccuacaagugcccccacaucgccgagguggagcccgaggacaucgacugcuggugcaaccugaccagcaccugggugaccuacgggaccugcaaccaggccggcgagcaccggcgcgacaagcgguccguggcgcucgcgccccacgugggcauggggcuggacacgcgcacccagaccuggaugagcgccgagggcgccuggcggcaggucgagaaggucgagaccugggcgcugcgccacccgggguucacgauccucgcccuguuccuggcccacuacaucggcaccucccucacccagaagguggugaucuucauccugcugaugcucgucacccccagcaugacgaugcggugcgugggggugggcaaccgcgacuucgucgagggccuguccggggccaccuggguggacgugguccuggagcacggcgggugcgugaccaccauggccaagaacaagcccacgcucgacaucgagcugcagaagaccgaggcgacccagcuggccacccuccggaagcugugcaucgagggcaagaucacgaacaucaccaccgacagccgcugccccacccagggcgaggccgugcugccggaggagcaggaccagaacuacgucugcaagcacacguacguggaccggggguggggcaacgggugcggccucuucgggaagggcucccuggugaccugcgccaaguuccagugccuggagcccaucgagggcaaggucgugcaguacgagaaccucaaguacaccgugaucaucaccguccacacgggggaccagcaccaggugggcaacgagacccagggggucaccgccgagaucacgccccaggcgagcacgaccgaggccauccugcccgaguacggcacccuggggcucgagugcuccccgcgcaccggccuggacuucaacgagaugauccugcucaccaugaagaacaaggccuggauggugcaccggcagugguucuucgaccugccccugcccuggacgagcggcgccaccaccgagacccccacguggaaccgcaaggagcuccuggugaccuucaagaacgcccacgcgaagaagcaggaggucguggugcuggggucccaggagggcgccaugcacaccgcccucaccggggccacggagauccagaacagcggcgggaccuccaucuucgccggccaccugaagugccggcugaagauggacaagcucgagcugaagggcaugagcuacgcgaugugcaccaacaccuucguccugaagaaggagguguccgagacgcagcacgggaccauccucaucaagguggaguacaagggcgaggacgccccgugcaagauccccuucagcaccgaggacgggcagggcaaggcccacaacggccgccugaucaccgccaaccccgucgugacgaagaaggaggagcccgugaacaucgaggcggagccgcccuucggggagagcaacaucgucaucggcaucggggacaacgcccugaagaucaacugguacaagaagggcuccagcaucgggaagauguucgaggccaccgcccggggcgcccgccggauggcgauccugggcgacaccgccugggacuucggguccgugggcggggugcucaacagccugggcaagaugguccaccagaucuucggguccgccuacaccgcccuguucagcggcguguccugggugaugaagaucggcaucgggguccuccugacguggaucggccugaacagcaagaacaccuccaugagcuucuccugcaucgccaucgggaucaucacccucuaccugggcgcgguggugcaggccgacaccgggugcgucaucaacuggaagggcaaggagcugaagugcggcagcgggaucuucgugacgaacgaggugcacaccuggaccgagcaguacaaguuccaggccgacucccccaagcgccucgccaccgccaucgcgggcgccugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgcggagacccagaacagcuccuucaucaucgacggccccaacacgcccgagugccccagcgccucccgggccuggaacgucugggagguggaggacuacggguucggcguguucaccaccaacaucuggcucaagcugcgcgaggccuacacccagcugugcgaccaccggcucaugagcgccgcggucaaggacgagcgcgccgugcacgccgacaugggcuacuggaucgagagccagaagaagggguccuggaagcuggagaaggccagccugaucgaggugaagaccugcacguggccgaagucccacacccucuggagcaacggcguccuggaguccgacaugaucauccccaagagccuggccgggcccaucucccagcacaacuaccggccgggcuaccacacccagaccgcggggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaaggucgacaacuucacgaugggcgugcugugccucgccauccuguucgaggaggugaugcgggggaaguucggcaagaagcacaugaucgccggggucuucuucaccuucgugcugcuccuguccggccagaucaccuggcgcgacauggcccacacccugaucaugaucggcagcaacgcguccgaccggauggggaugggcgugacguaccucgcccugaucgccaccuucaagauccagcccuuccuggcccucggguucuuccugcgcaagcugaccagccgggagaaccuccugcugggcgucggccucgcgauggccaccacgcugcagcugcccgaggacaucgagcagauggccaacgggaucgcccucggccugauggcccugaagcucaucacccaguucgagaccuaccagcuguggaccgcgcugaucagccucacgugcuccaacaccaucuucacccugaccguggccuggcgcacggccacccugauccucgccggggugagccugcugccggucugccaguccagcuccaugcggaaguccgacuggcuccccaugaccguggccgcgaugggcgugccgccccucccgcuguucaucuucucccucaaggacacccugaagcgccgcagcuggccccugaacgagggggugauggccgugggccucgucuccauccuggccagcucccugcuccggaacgacgugcccauggccggcccccugguggccgggggccugcucaucgcgugcuacgucaucacggggaccagcgccgaccugaccguggagaaggccgccgacgugaccugggaggaggaggccgagcagacgggcgucucccacaaccugaugaucaccguggacgacgacgggaccaugcgcaucaaggacgacgagaccgagaacauccucaccgugcugcugaagacggcgcuccugaucgucagcggcaucuucccguacuccauccccgccacccugcucguguggcacaccuggcagaagcagacccggcgcagcggcgugcugugggacguccccagcccgcccgagacgcagaaggccgagcuggaggaggggguguaccggaucaagcagcagggcaucuucgggaagacccaggugggcgucggggugcagaaggagggcguguuccacaccauguggcacgucacccgcggcgccgugcucacguacaacgggaagcggcuggagcccaacugggcgagcgugaagaaggaccugaucuccuacggcgggggcuggcgccucagcgcccaguggcagaagggggaggagguccaggugaucgccguggagcccggcaagaaccccaagaacuuccagaccaugcccggcaccuuccagaccacgaccggggagaucggcgccaucgcccuggacuucaagcccgggaccagcggcucccccaucaucaaccgggagggcaaggucguggggcuguacggcaacgggguggucaccaagaacggcggguacgugagcggcaucgcgcagacgaacgccgagccggacggccccacccccgagcuggaggaggagauguucaagaagcgcaaccucaccaucauggaccugcaccccggguccggcaagacccggaaguaccugccggccaucgugcgcgaggccaucaagcggcgccuccggacgcugauccuggcccccacccgcgucguggcggccgagauggaggaggcccucaaggggcugcccauccgguaccagaccaccgccaccaagagcgagcacaccggccgcgagaucguggaccugaugugccacgccaccuucaccaugcggcuccugucccccguccgcgugccgaacuacaaccugaucaucauggacgaggcgcacuucacggaccccgccagcaucgccgcccggggguacaucuccacccgcgugggcaugggcgaggcggccgccaucuucaugaccgccacgccgcccgggacggccgacgcguucccgcagagcaacgcccccauccaggacgaggagcgcgacauccccgagcgguccuggaacagcggcaacgaguggaucaccgacuucgccgggaagaccgucugguucgugcccuccaucaaggccggcaacgacaucgccaacugccuccgcaagaacgggaagaaggugauccagcugagccggaagaccuucgacacggaguaccagaagaccaagcugaacgacugggacuucgucgugaccaccgacaucuccgagaugggcgcgaacuucaaggccgaccgcgugaucgacccgcggcgcugccucaagcccgucauccugacggacggccccgagcgggugauccuggccgggcccaugccggugaccgccgccagcgcggcccagcgccggggccgcgucgggcggaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgcgagaaguccgccgccaucgacggcgaguaccggcugaagggcgagagccgcaagacguucguggagcugaugcggcgcggggaccuccccguguggcuggcccacaaggucgccuccgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcgcgcaccuacagcgacccgcuggcccucaaggaguucaaggacuucgccgccggccggaaguccaucgcccuggaccuggucacggagaucgggcgcgugcccagccaccucgcgcaccggacccgcaacgcccuggacaaccuggugaugcuccacaccagcgagcacggcgggaaggccuaccggcacgccgucgaggagcugcccgagaccauggagacgcugcuccugcugggccucaugauccugcugaccgggggcgccaugcuguuccugaucuccggcaaggggaucggcaagaccagcaucgggcugaucugcgugaucgcguccagcggcaugcucuggauggccgagaucccgcugcaguggaucgccuccgccaucgugcuggaguucuucaugaugguccuccugauccccgagcccgagaagcagcgcacgccccaggacaaccagcuggccuacguggugaucgggauccucacgcuggcggccaucaucgccgccaacgagaugggccugcucgagaccaccaagcgggaccugggcaugagcaaggagccgggggucgugucccccaccagcuaccuggacguggaccuccaccccgcguccgccuggacgcuguacgccgucgccaccaccgugaucacccccaugcugcgccacacgaucgagaacagcaccgccaacgugucccucgcggccaucgccaaccaggccgucgugcugaugggccuggacaagggguggccgaucagcaagauggaccucggcgugccccugcuggcccucgggugcuacucccaggucaacccccugacccugaccgcggccgugcuccugcugaucacgcacuacgccaucaucggccccggccuccaggccaaggccacccgggaggcgcagaagcgcaccgccgccgggaucaugaagaacccgaccguggacggcaucaugacgaucgaccuggaccccgucaucuacgacagcaaguucgagaagcagcugggccaggugaugcuccuggugcugugcgccguccagcuccugcugaugcggaccuccugggcgcucugcgaggcccugacccuggccaccggccccaucacgacccucugggagggcagccccgggaaguucuggaacaccaccaucgccguguccauggccaacaucuuccgcggcagcuaccuggcgggggccggccuggccuucuccaucaugaaguccguggggacgggcaagcggggcaccgggagcaagggcgagacccucggggagaaguggaagaagaagcugaaccagcugucccgcaaggaguucgaccucuacaagaaguccggcaucaccgaggucgaccggaccgaggccaaggaggggcugaagcgcggcgagaucacgcaccacgccgugucccggggcagcgcgaagcugcagugguucguggagcgcaacauggucaucccggaggggcgggugaucgaccucggcugcgggcgcggcgggugguccuacuacugcgccggccugaagaaggugaccgagguccggggcuacaccaagggcgggcccgggcacgaggagcccgugcccaugagcaccuacggcuggaacaucgugaagcugauguccgggaaggacgucuucuaccucccgcccgagaagugcgacacgcugcugugcgacaucggcgagagcucccccagccccaccguggaggagucccgcaccauccgcgugcugaagauggucgagccguggcucaagaacaaccaguucugcaucaaggugcugaaccccuacaugcccaccgugaucgagcaccuggagcggcuccagcgcaagcacggcgggaugcugguccggaacccccugagccgcaacuccacgcacgagauguacuggaucagcaacggcaccgggaacaucguggccuccgugaacauggucagccggcuccugcugaaccgcuucaccaugacccaccggcgcccgacgaucgagaaggacguggaccucggcgccggcacccggcacgugaacgccgagcccgagacccccaacauggacgucaucggggagcgcaucaagcggaucaaggaggagcacaacuccaccuggcacuacgacgacgagaacccguacaagacgugggcguaccacggcagcuacgaggugaaggccaccggguccgccagcagcaugaucaacggcguggucaagcugcugaccaagcccugggacgugguccccauggugacccagauggccaugacggacaccacccccuucgggcagcagcgcguguucaaggagaaggucgacacccggacgccgcgcuccaugcccggcacccggcgcgugaugggcaucaccgcggaguggcucuggcggacccuggggcgcaacaagaagccccggcugugcacgcgcgaggaguucaccaagaaggugcgcaccaacgccgccaugggcgccgucuucaccgaggagaaccagugggacagcgccaaggcggccguggaggacgaggacuucuggaagcucguggaccgggagcgcgagcugcacaagcuggggaagugcggcuccugcgucuacaacaugauggggaagcgggagaagaagcucggcgaguucggcaaggccaaggggagccgcgccaucugguacauguggcugggcgcccgguaccuggaguucgaggcgcucggguuccugaacgaggaccacugguucucccgcgagaacagcuacuccggcguggagggggagggccugcacaagcucggcuacauccugcgggacaucagcaagauccccgggggcgccauguacgccgacgacacggccgggugggacacccgcaucaccgaggacgaccugcacaacgaggagaagaucacccagcagauggacccggagcaccggcagcucgccaacgcgaucuucaagcugacguaccagaacaagguggucaaggugcagcgccccacccccaccggcaccgugauggacaucaucucccggaaggaccagcgcggcagcgggcaggucggcaccuacgggcugaacacguucaccaacauggaggcccagcucauccggcagauggagggcgagggggugcuguccaaggccgaccuggagaacccccaccucagcgagaagaagaucacccaguggcuggagaccaagggcguggagcgccugaagcggauggccaucuccggcgacgacugcgucgugaagccgaucgacgaccgcuucgccaacgcgcuccuggcccugaacgacauggggaaggugcggaaggacaucccccaguggcagcccagcaagggcuggcacgacuggcagcagguccccuucugcucccaccacuuccacgagcucaucaugaaggacgggcgcaagcugguggugccgugccggccccaggacgagcugaucggccgcgcccggaucagccagggggccggcuggucccuccgcgagacggcgugccugggcaaggccuacgcccagauguggagccugauguacuuccaccgccgggaccuccgccuggccuccaacgccaucugcagcgcgguccccgugcacugggugcccaccagccggaccaccugguccauccacgcccaccaccaguggaugacgaccgaggacaugcugaccgucuggaaccgcguguggaucgaggacaacccguggauggaggacaagacccccgugacgaccugggagaacguccccuaccucgggaagcgggaggaccaguggugcggcagccugaucgggcugaccucccgcgccaccugggcccagaacauccccacggccauccagcagguccggagccucaucggcaacgaggaguuccuggacuacaugccguccaugaagcgcuuccggaaggaggaggagagcgagggggcgaucugguga

SEQ ID NO: 10169 - RNA, 9873 nt, Artificial Sequence
  derived and/or modified CDS sequence (opt1) from DENV-3__FJ182007__SS-prME
accagccucugccucaugaugauccugcccgccgcccuggccuuccaccucaccagccgggacggggagccccggaugaucguggggaagaacgagcgcggcaagagccugcuguucaagaccgccagcgggaucaacaugugcacccucaucgccauggaccugggggagaugugcgacgacaccgugaccuacaagugcccccacaucgccgagguggagcccgaggacaucgacugcuggugcaaccugaccagcaccugggugaccuacgggaccugcaaccaggccggcgagcaccggcgcgacaagcgguccguggcgcucgcgccccacgugggcauggggcuggacacgcgcacccagaccuggaugagcgccgagggcgccuggcgccagguggagaagguggagaccugggcgcugcgccacccgggguucacgauccucgcccuguuccuggcccacuacaucggcaccucccucacccagaagguggugaucuucauccugcugaugcucgugacccccagcaugacgaugcggugcgugggggugggcaaccgcgacuucgucgagggccuguccggggccaccuggguggacgugguccuggagcacggcgggugcgugaccaccauggccaagaacaagcccacgcucgacaucgagcugcagaagaccgaggcgacccagcuggccacccuccggaagcugugcaucgagggcaagaucacgaacaucaccaccgacagccgcugccccacccagggcgaggccgugcugccggaggagcaggaccagaacuacgucugcaagcacacguacguggaccggggguggggcaacgggugcggccucuucgggaagggcucccuggugaccugcgccaaguuccagugccuggagcccaucgagggcaaggucgugcaguacgagaaccucaaguacaccgugaucaucaccguccacacgggggaccagcaccaggugggcaacgagacccagggggucaccgccgagaucacgccccaggcgagcacgaccgaggccauccugcccgaguacggcacccuggggcucgagugcuccccgcgcaccggccuggacuucaacgagaugauccugcucaccaugaagaacaaggccuggauggugcaccggcagugguucuucgaccugccccugcccuggacgagcggcgccaccaccgagacccccacguggaaccgcaaggagcuccuggugaccuucaagaacgcccacgcgaagaagcaggaggucguggugcuggggucccaggagggcgccaugcacaccgcccucaccggggccacggagauccagaacagcggcgggaccuccaucuucgccggccaccugaagugccggcugaagauggacaagcucgagcugaagggcaugagcuacgcgaugugcaccaacaccuucguccugaagaaggagguguccgagacgcagcacgggaccauccucaucaagguggaguacaagggcgaggacgccccgugcaagauccccuucagcaccgaggacgggcagggcaaggcccacaacggccgccugaucaccgccaaccccgucgugacgaagaaggaggagcccgugaacaucgaggcggagccgcccuucggggagagcaacaucgucaucggcaccggggacaacgcccugaagaucaacugguacaagaagggcuccagcaucgggaagauguucgaggccaccgcccggggcgcccgccggauggcgauccugggcgacaccgccugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgcgguggugcaggccgacacggggugcgucaucaacuggaagggcaaggagcugaagugcggcagcgggaucuucgugaccaacgaggugcacaccuggaccgagcaguacaaguuccaggccgacucccccaagcgccucgccacggccaucgcgggcgccugggagaacggggucugcggcauccgcagcaccacccggauggagaaccugcuguggaagcagaucgccaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgcggagacgcagaacagcuccuucaucaucgacggccccaacacccccgagugccccagcgccucccgggccuggaacgucugggagguggaggacuacggguucggcguguucaccaccaacaucuggcucaagcugcgcgaggucuacacccagcugugcgaccaccggcucaugagcgccgccgugaaggacgagcgcgcggugcacgccgacaugggcuacuggaucgagagccagaagaacggguccuggaagcuggagaaggccagccugaucgaggucaagacgugcaccuggccgaagucccacacccucuggagcaacggcgugcuggaguccgacaugaucauccccaagagccuggccgggcccaucucccagcacaacuaccggccgggcuaccacacccagacggccgggcccuggcaccucggcaagcuggagcuggacuucaacuacugcgagggcaccaccguggucaucaccgaggacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccuggucuccgcgggcagcgggaagguggacaacuucaccaugggcgugcugugccucgccauccuguucgaggaggucaugcgggggaaguucggcaagaagcacaugaucgccgggguguucuucaccuucgugcugcuccuguccggccagaucaccuggcgcgacauggcccacacgcugaucaugaucggcagcaacgccuccgaccggauggggaugggcgucaccuaccucgcgcugaucgccaccuucaagauccagcccuuccuggcccucggguucuuccugcgcaagcugaccagccgggagaaccuccugcugggcgugggccucgccauggcgacgacccugcagcugcccgaggacaucgagcagauggccaacgggaucgcccucggccugauggcccugaagcucaucacccaguucgagaccuaccagcuguggacggcccugaucagccugaccugcuccaacaccaucuucacccugacgguggcguggcgcaccgccacccugauccucgccggggucagccugcugccggugugccaguccagcuccaugcggaaguccgacuggcuccccaugaccgucgccgccaugggcgugccgccccucccgcuguucaucuucucccucaaggacacgcugaagcgccgcagcuggccccugaacgagggggugauggcggucggccucguguccauccuggccagcucccugcuccggaacgacgugcccauggccggcccccuggucgccgggggccugcucaucgccugcuacgugaucaccgggaccagcgcggaccugaccguggagaaggccgccgacgucacgugggaggaggaggccgagcagaccggcgugucccacaaccugaugaucaccguggacgacgacgggaccaugcgcaucaaggacgacgagaccgagaacauccucacgguccugcugaagaccgcccuccugaucgugagcggcaucuucccguacuccauccccgcgacccugcucguguggcacaccuggcagaagcagacgcggcgcagcggcguccugugggacgugcccagcccgcccgagacccagaaggccgagcuggaggaggggguguaccggaucaagcagcagggcaucuucgggaagacccaggucggcgugggggugcagaaggagggcgucuuccacaccauguggcacgugacgcgcggcgccgugcucaccuacaacgggaagcggcuggagcccaacugggccagcgucaagaaggaccugaucuccuacggcgggggcuggcgccucagcgcgcaguggcagaagggggaggagguccaggugaucgccgucgagcccggcaagaaccccaagaacuuccagaccaugcccggcaccuuccagacgaccaccggggagaucggcgccaucgcccuggacuucaagcccgggaccagcggcucccccaucaucaaccgggagggcaaggugguggggcuguacggcaacggggucgugacgaagaacggcggguacgugagcggcaucgcccagaccaacgcggagccggacggccccacccccgagcuggaggaggagauguucaagaagcgcaaccucaccaucauggaccugcaccccggguccggcaagacgcggaaguaccugccggccaucguccgcgaggccaucaagcggcgccuccggacccugauccuggcccccacccgcgugguggccgcggagauggaggaggcccucaaggggcugcccauccgguaccagaccacggccaccaagagcgagcacaccggccgcgagaucgucgaccugaugugccacgccaccuucacgaugcggcuccugucccccgugcgcgugccgaacuacaaccugaucaucauggacgaggcccacuucaccgaccccgcgagcaucgccgcccggggguacaucuccacccgcgucggcaugggcgaggccgcggccaucuucaugaccgccacgccgcccgggaccgccgacgccuucccgcagagcaacgcgcccauccaggacgaggagcgcgacauccccgagcgguccuggaacagcggcaacgaguggaucaccgacuucgccgggaagaccgugugguucgugcccuccaucaaggccggcaacgacaucgccaacugccuccgcaagaacgggaagaaggucauccagcugagccggaagacguucgacaccgaguaccagaagaccaagcugaacgacugggacuucguggugaccacggacaucuccgagaugggcgccaacuucaaggcggaccgcgucaucgacccgcggcgcugccucaagcccgugauccugaccgacggccccgagcgggugauccuggccgggcccaugccggucaccgccgccagcgccgcgcagcgccggggccgcguggggcggaacccccagaaggagaacgaccaguacaucuucaccggccagccccucaacaacgacgaggaccacgcccacuggaccgaggccaagaugcugcuggacaacaucaacacgcccgaggggaucaucccggcccucuucgagcccgagcgcgagaaguccgcggccaucgacggcgaguaccggcugaagggcgagagccgcaagaccuucguggagcugaugcggcgcggggaccuccccgucuggcuggcccacaagguggccuccgagggcaucaaguacaccgaccggaaguggugcuucgacgggcagcgcaacaaccagauccuggaggagaacauggacgucgagaucuggaccaaggagggcgagaagaagaagcuccggccccgcuggcuggacgcccgcacguacagcgacccgcuggcgcucaaggaguucaaggacuucgccgccggccggaaguccaucgcccuggaccuggugaccgagaucgggcgcgugcccagccaccucgcccaccggacccgcaacgcgcuggacaaccuggucaugcuccacaccagcgagcacggcgggaaggccuaccggcacgccguggaggagcugcccgagacgauggagacccugcuccugcugggccucaugauccugcugaccgggggcgccaugcuguuccugaucuccggcaaggggaucggcaagaccagcaucgggcugaucugcgugaucgccuccagcggcaugcucuggaucgcggagaucccgcugcaguggaucgccuccgccaucguccuggaguucuucaugauggugcuccugauccccgagcccgagaagcagcgcacgccccaggacaaccagcuggccuacguggucaucgggauccucacccuggccgcgaucaucgccgccaacgagaugggccugcucgagaccaccaagcgggaccugggcaugagcaaggagccggggguggugucccccacgagcuaccuggacgucgaccuccaccccgccuccgcguggacccuguacgccguggccaccaccgugaucacgcccaugcugcgccacaccaucgagaacagcaccgccaacgucucccucgccgcgaucgccaaccaggccguggugcugaugggccuggacaagggguggccgaucagcaagauggaccucggcgucccccugcuggcccucgggugcuacucccaggugaacccccugacccugacggccgcggugcuccugcugaucacccacuacgccaucaucggccccggccuccaggccaaggccacccgggaggcccagaagcgcaccgcggccgggaucaugaagaacccgacggucgacggcaucaugaccaucgaccuggaccccgugaucuacgacagcaaguucgagaagcagcugggccaggugaugcuccugguccugugcgccgugcagcuccugcugaugcggaccuccugggcccucugcgaggcgcugacccuggccacgggccccaucaccacccucugggagggcagccccgggaaguucuggaacaccacgaucgccguguccauggccaacaucuuccgcggcagcuaccuggccggggcgggccuggccuucuccaucaugaaguccgucgggaccggcaagcggggcaccgggagccagggcgagacccucggggagaaguggaagcgcaagcugaaccagcugucccggaaggaguucgaccucuacaagaaguccggcaucaccgagguggaccgcacggaggccaaggaggggcugaagcggggcgagaucacccaccacgccgugucccgcggcagcgccaagcugcagugguucgucgagcggaacauggugaucccggaggggcgcgugaucgaccucggcugcgggcggggcgggugguccuacuacugcgcgggccugaagaaggucaccgaggugcgcggcuacaccaagggcgggcccgggcacgaggagcccgugcccaugagcacguacggcuggaacaucgucaagcugauguccgggaaggacguguucuaccucccgcccgagaagugcgacacccugcugugcgacaucggcgagagcucccccagccccaccguggaggagucccgcaccauccggguccugaagaugguggagccguggcucaagaacaaccaguucugcaucaaggugcugaaccccuacaugcccacggucaucgagcaccuggagcgccuccagcggaagcacggcgggaugcuggugcgcaacccccugagccggaacuccacccacgagauguacuggaucagcaacggcaccgggaacaucguggccuccgucaacauggugagccgccuccugcugaaccgguucaccaugacgcaccgccggccgaccaucgagaaggacguggaccucggcgccggcacccgccacgucaacgccgagcccgagacccccaacauggacgugaucggggagcggaucaagcgcaucaaggaggagcacaacuccacguggcacuacgacgacgagaacccguacaagaccugggccuaccacggcagcuacgaggugaaggcgaccggguccgccagcagcaugaucaacggcgucgugaagcugcugaccaagcccugggacgucgugcccauggugacgcagauggccaugaccgacaccacccccuucgggcagcagcgggucuucaaggagaagguggacacgcgcaccccgcgguccaugcccggcacccgccgggugaugggcaucaccgccgaguggcucuggcgcacgcuggggcggaacaagaagccccgccugugcacccgcgaggaguucaccaagaagguccggaccaacgcggccaugggcgccguguucacggaggagaaccagugggacagcgccaaggccgcgguggaggacgaggacuucuggaagcucgucgaccgcgagcgggagcugcacaagcuggggaagugcggcuccugcguguacaacaugauggggaagcgcgagaagaagcucggcgaguucggcaaggccaaggggagccgggccaucugguacauguggcugggcgcccgcuaccuggaguucgaggcccucggguuccugaacgaggaccacugguucucccgggagaacagcuacuccggcguggagggggagggccugcacaagcucggcuacauccugcgcgacaucagcaagauccccgggggcgcgauguacgccgacgacaccgccgggugggacacccggaucaccgaggacgaccugcacaacgaggagaagaucacgcagcagauggacccggagcaccgccagcucgccaacgccaucuucaagcugaccuaccagaacaaggucgugaaggugcagcggcccacccccaccggcaccgucauggacaucaucucccgcaaggaccagcggggcagcggccaggugggcacguacgggcugaacaccuucaccaacauggaggcgcagcucauccgccagauggagggcgagggggugcuguccaaggccgaccuggagaacccccaccucagcgagaagaagaucacccaguggcuggagacgaagggcgucgagcggcugaagcgcauggccaucuccggcgacgacugcguggugaagccgaucgacgaccgguucgccaacgcccuccuggcgcugaacgacauggggaagguccgcaaggacaucccccaguggcagcccagcaagggcuggcacgacuggcagcagguccccuucugcucccaccacuuccacgagcucaucaugaaggacgggcggaagcugguggucccgugccgcccccaggacgagcugaucggccgggcccgcaucagccagggggccggcuggucccuccgcgagaccgccugccugggcaaggcguacgcccagauguggagccugauguacuuccaccggcgcgaccuccggcuggccuccaacgccaucugcagcgccgugcccgugcacuggguccccaccagccgcaccacgugguccauccacgcgcaccaccaguggaugaccaccgaggacaugcugaccguguggaaccggguguggaucgaggacaacccguggauggaggacaagacgcccgucaccaccugggagaacgugcccuaccucgggaagcgcgaggaccaguggugcggcagccugaucgggcugaccucccgggccacgugggcccagaacauccccaccgccauccagcagguccgcagccucaucggcaacgaggaguuccuggacuacaugccguccaugaagcgguuccgcaaggaggaggagagcgagggggccaucugguga

SEQ ID NO: 10170 - RNA, 9873 nt, Artificial Sequence
  derived and/or modified CDS sequence (opt1) from DENV-3__FJ182008__SS-prME
accagccugugcaucaugaugauccuccccgcggcccuggcguuccaccugaccagccgggacggggagccgcggaugaucguggggaagaacgagcgcggcaagagccuccuguucaagaccgccuccgggaucaacaugugcacccugaucgccauggaccucggggagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccuggcgccccacgugggcauggggcucgacacccgcacccagaccuggaugagcgccgagggcgccuggcgccagguggagaagguggagacgugggcccugcgccacccgggguucaccauccuggcccucuuccuggcccacuacaucggcaccucccugacccagaagguggugaucuucauccuccugaugcuggucacgcccagcaugaccaugcggugcgugggggugggcaaccgcgacuucgucgagggccucuccggggccaccuggguggacgugguccuggagcacggcgggugcgugaccacgauggccaagaacaagcccacccuggacaucgagcuccagaagaccgaggccacccagcuggcgacgcugcggaagcucugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccuguucgggaagggcucccucgugaccugcgccaaguuccagugccuggagcccaucgagggcaaggucgugcaguacgagaaccugaaguacaccgugaucaucacgguccacaccggggaccagcaccaggugggcaacgagacccagggggucaccgccgagaucacgccccaggccagcaccaccgaggcgauccuccccgaguacggcacccuggggcuggagugcuccccgcgcaccggccucgacuucaacgagaugauccugcugacgaugaagaacaaggccuggauggugcaccggcagugguucuucgaccucccccugcccuggaccagcggcgccaccaccgagacgcccaccuggaaccgcaaggagcugcucgugaccuucaagaacgcccacgccaagaagcaggaggucguggugcuggggucccaggagggcgcgaugcacaccgcccugacgggggccaccgagauccagaacagcggcgggaccuccaucuucgccggccaccucaagugccggcugaagauggacaagcuggagcucaagggcaugagcuacgccaugugcaccaacacguucguccugaagaaggagguguccgagacccagcacgggaccauccugaucaagguggaguacaagggcgaggacgcgccgugcaagauccccuucagcaccgaggacgggcagggcaaggcccacaacggccgccucaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcugaacagccucggcaagaugguccaccagaucuucggguccgccuacacggcccuguucagcggcguguccugggugaugaagaucggcaucgggguccugcucaccuggaucggccugaacagcaagaacaccuccaugagcuucuccugcaucgccaucggggugaucacccuguaccucggcgccgugguccaggcggacauggggugcgugaucaacuggaagggcaaggagcugaagugcggcagcgggaucuucgugacgaacgagguccacaccuggaccgagcaguacaaguuccaggccgacucccccaagcgccuggccaccgccaucgccggcgcgugggagaacggggugugcggcauccgcagcacgacccggauggagaaccuccuguggaagcagaucgccaacgagcugaacuacauccucugggagaacaacaucaagcugaccguggucgugggggacaucaucggcgugcuggagcagggcaagcgcacccucacgccccagccgauggagcugaaguacuccuggaagaccugggggaaggccaagaucgucaccgccgagacccagaacagcuccuucaucaucgacggccccaacacgcccgagugccccagcgcgucccgggccuggaacgugugggagguggaggacuacggguucggcgucuucaccaccaacaucuggcugaagcuccgcgagguguacacccagcugugcgaccaccggcugaugagcgccgccgugaaggacgagcgcgccguccacgcggacaugggcuacuggaucgagagccagaagaacggguccuggaagcucgagaaggccagccugaucgaggugaagaccugcacguggccgaagucccacacccuguggagcaacggcgugcucgaguccgacaugaucauccccaagagccuggccgggcccaucucccagcacaacuaccggccgggcuaccacacccagaccgccgggcccuggcaccugggcaagcucgagcuggacuucaacuacugcgagggcacgaccgucgugaucaccgagaacugcgggacccgcggccccagccugcggacgaccaccguguccgggaagcucauccacgaguggugcugccgcagcugcacccugcccccgcugcgguacaugggcgaggacgggugcugguacggcauggagauccgccccaucuccgagaaggaggagaacauggucaagagccucguguccgccggcagcgggaagguggacaacuucacgaugggcguccugugccuggcgauccucuucgaggaggugaugcgggggaaguucggcaagaagcacaugaucgccgggguguucuucaccuucguccugcugcucuccggccagaucaccuggcgcgacauggcccacacccugaucaugaucggcagcaacgccuccgacaagauggggaugggcgugacguaccuggcccucaucgcgaccuucaagauccagcccuuccuggcccugggguucuuccuccggaagcugaccagccgcgagaaccugcuccugggcgugggccuggccauggccaccacgcuccagcugcccgaggacaucgagcagauggcgaacgggaucgcccugggccucauggcccugaagcugaucacccaguucgagaccuaccagcucuggaccgcccugaucagccugacgugcuccaacaccauguucacccucaccgucgccuggcggacggcgacccugauccuggccggggugagccuccugccggucugccaguccagcuccaugcgcaagaccgacuggcugcccauggccguggccgccaugggcgugccgccccucccgcuguucaucuucagccugaaggacacccucaagcggcgcuccuggccccugaacgagggggucauggcggugggccuggugagcauccucgccuccagccugcugcgcaacgacguccccauggccggcccccucguggccgggggccugcugaucgccugcuacgugaucacggggaccuccgcggaccucaccgucgagaaggccgccgacaucaccugggaggaggaggccgagcagacgggcgugagccacaaccugaugaucaccguggacgacgacgggaccaugcggaucaaggacgacgagaccgagaacauccugaccguccuccugaagacggcccugcucaucaucuccggcguguucccguacagcauccccgcgacccugcugguguggcacaccuggcagaagcagacccagcgcuccggcguccucugggacgugcccagcccgcccgagacgcagaaggccgagcuggaggaggggguguaccggaucaagcagcagggcaucuucgggaagacccaggucggcgugggggugcagaaggagggcgucuuccacaccauguggcacgugacccgcggcgccgugcugacguacaacgggaagcggcucgagcccaacugggccuccgucaagaaggaccugaucagcuacggcgggggcuggcgccuguccgcgcaguggcagaagggggaggagguccaggugaucgccgucgagcccggcaagaaccccaagaacuuccagaccaugcccggcaccuuccagaccacgaccggggagaucggcgccaucgcccucgacuucaagcccgggaccagcggcagccccaucaucaaccgggagggcaaggugguggggcuguacggcaacggggucgugaccaagaacggcggguacguguccggcaucgcccagacgaacgcggagccggacggccccacccccgagcuggaggaggagauguucaagaagcgcaaccugaccaucauggaccuccaccccgggagcggcaagacccggaaguaccugccggccaucguccgcgaggccaucaagcggcgccugcggacgcucauccuggcccccacccgcgugguggccgcggagauggaggaggcccugaaggggcuccccauccgguaccagaccaccgccacgaaguccgagcacaccggccgcgagaucgucgaccugaugugccacgccaccuucaccaugcggcugcucagccccgugcgcgugccgaacuacaaccugaucaucauggacgaggcccacuucacggaccccgcguccaucgccgcccggggguacaucagcacccgcgucggcaugggcgaggccgcggccaucuucaugaccgccacgccgcccgggacggccgacgccuucccgcaguccaacgcgcccauccaggacgaggagcgggacauccccgagcgcagcuggaacuccggcaacgaguggaucaccgacuucgccgggaagaccgugugguucgugcccagcaucaaggccggcaacgacaucgccaacugccugcgcaagaacgggaagaaggucauccagcucucccggaagaccuucgacacggaguaccagaagaccaagcugaacgacugggacuucguggugaccaccgacaucagcgagaugggcgccaacuucaaggcggaccgcgucaucgacccgcggcgcugccugaagcccgugauccucacggacggccccgagcgggugauccuggccgggcccaugccggucaccgccgccuccgccgcgcagcgccggggccgcguggggcggaacccccagaaggagaacgaccaguacaucuucaccggccagccccugaacaacgacgaggaccacgcccacuggaccgaggccaagaugcuccuggacaacaucaacacccccgaggggaucaucccggcccuguucgagcccgagcgcgagaaguccgcggccaucgacggcgaguaccggcucaagggcgagucccgcaagacguucguggagcugaugcggcgcggggaccugcccgucuggcucgcccacaagguggccagcgagggcaucaaguacaccgaccggaaguggugcuucgacgggcagcgcaacaaccagauccuggaggagaacauggacgucgagaucuggaccaaggagggcgagaagaagaagcugcggccccgcuggcucgacgcccggaccuacuccgacccgcuggcgcugaaggaguucaaggacuucgccgccggccgcaagagcaucgcccucgaccuggugacggagaucgggcgcgugcccucccaccuggcccaccggacccgcaacgcgcucgacaaccuggucaugcugcacaccagcgagcacggcgggcgggccuaccgccacgccguggaggagcuccccgagaccauggagacgcugcugcuccugggccugaugauccuccugaccgggggcgccaugcuguuccucaucagcggcaaggggaucggcaagaccuccaucgggcugaucugcgugaucgccagcuccggcaugcuguggauggcggagaucccgcuccaguggaucgccagcgccaucguccuggaguucuucaugauggugcugcucauccccgagcccgagaagcagcggacgccccaggacaaccagcuggccuacguggucaucgggauccugacgcucgccgcgaucaucgccgccaacgagaugggccugcuggagaccaccaagcgcgaccucggcauguccaaggagccggggguggugagccccaccuccuaccuggacgucgaccugcaccccgccagcgcguggacgcucuacgccguggccaccaccgugaucacccccaugcugcggcacacgaucgagaacuccaccgccaacgucagccuggccgcgaucgccaaccaggccguggugcucaugggccuggacaagggguggccgaucuccaagauggaccugggcgucccccuccuggcccuggggugcuacagccaggugaacccccucacccugaccgccgcggugcugcuccugaucacgcacuacgccaucaucggccccggccugcaggccaaggccacccgcgaggcccagaagcggaccgcggccgggaucaugaagaacccgaccgucgacggcaucaugacgaucgaccucgaccccgugaucuacgacuccaaguucgagaagcagcugggccaggugaugcugcucguccugugcgccgugcagcugcuccugaugcgcaccagcugggcccugugcgaggcgcucacccuggccaccggccccaucacgacccugugggagggcucccccgggaaguucuggaacaccaccaucgccgugagcauggccaacaucuuccggggcuccuaccucgccggggcgggccuggccuucagcaucaugaaguccgucgggacgggcaagcgcggcaccgggagccagggcgagacccugggggagaaguggaagaagaagcucaaccagcugagccggaaggaguucgaccuguacaagaaguccggcaucaccgagguggaccgcaccgaggccaaggaggggcucaagcggggcgagacgacccaccacgccgugagccgcggcaccgccaagcugcagugguucgucgagcggaacauggugaucccggaggggcgcgugaucgaccugggcugcgggcggggcgggugguccuacuacugcgcgggccucaagaaggucaccgaggugcgcggcuacacgaagggcgggcccgggcacgaggagcccgugcccaugagcaccuacggcuggaacaucgucaagcugauguccgggaaggacguguucuaccugccgcccgagaagugcgacacccuccugugcgacaucggcgagagcucccccagccccaccguggaggagucccggacgauccgcguccugaagaugguggagccguggcugaagaacaaccaguucugcaucaaggugcucaaccccuacaugcccaccgucaucgagcaccuggagcgccugcagcggaagcacggcgggaugcucgugcgcaacccccugagccggaacuccacccacgagauguacuggaucagcaacggcaccgggaacaucguggccuccgucaacauggugagccgccugcuccugaaccgguucacgaugacccaccgccggccgaccaucgagaaggacguggaccugggcgccggcacccgccacgucaacgccgagcccgagacgcccaacauggacgugaucggggagcggaucaagcgcaucaaggaggagcacaacuccaccuggcacuacgacgacgagaacccguacaagaccugggccuaccacggcagcuacgaggugaaggcgaccggguccgccagcuccaugaucaacggcgucgugaagcuccugacgaagcccugggacgucgugcccauggugacccagauggccaugaccgacaccacgcccuucgggcagcagcgggucuucaaggagaagguggacacccgcaccccgcggagcaugcccggcacccgccgggugaugggcaucacggccgaguggcuguggcgcacccucgggcggaacaagaagccccgccugugcacccgggaggaguucaccaagaagguccgcacgaacgcggccaugggcgccguguucaccgaggagaaccagugggacagcgccaaggccgcgguggaggacgaggacuucuggaagcuggucgaccgcgagcgggagcuccacaagcuggggaagugcggcuccugcguguacaacaugauggggaagcgcgagaagaagcugggcgaguucggcaaggccaaggggagccgggccaucugguacauguggcucggcgcccgcuaccuggaguucgaggcccugggguuccucaacgaggaccacugguucucccgggagaacagcuacuccggcguggagggggagggccugcacaagcugggcuacauccuccgcgacaucagcaagauccccgggggcgcgauguacgccgacgacaccgccgggugggacacccggaucacggaggacgaccugcacaacgaggagaagaucacccagcagauggacccggagcaccgccagcuggccaacgccaucuucaagcucaccuaccagaacaaggucgugaaggugcagcggcccacccccaccggcacggucauggacaucaucucccgcaaggaccagcggggcagcggccaggugggcaccuacgggcugaacaccuucaccaacauggaggcgcagcugauccgccagauggagggcgagggggugcucuccaaggccgaccuggagaacccccaccuccccgagaagaagaucacgcaguggcuggagaccaagggcgucgagcggcugcgccggauggccaucagcggcgacgacugcguggugaagcccaucgacgaccgcuucgccaacgcccugcucgcgcugaacgacauggggaagguccggaaggacaucccccaguggcagcccuccaagggcuggcacgacuggcagcaggucccguucugcagccaccacuuccacgagcugaucaugaaggacgggcgcaagcucgugguccccugccggccccaggacgagcugaucggccgcgcccggaucucccagggggccggcuggagccugcgcgagaccgccugccucggcaaggcguacgcccagauguggucccugauguacuuccaccgccgggaccugcgccucgccagcaacgccaucugcuccgccgugcccgugcacugggucccgaccagccggacgaccugguccauccacgcgcaccaccaguggaugaccaccgaggacaugcugacgguguggaaccgcguguggaucgaggacaaccccuggauggaggacaagacccccgucaccaccugggagaacgugcccuaccuggggaagcgggaggaccaguggugcggcagccucaucgggcugacgagccgcgccaccugggcccagaacaucccgaccgccauccagcagguccggucccugaucggcaacgaggaguuccucgacuacaugcccagcaugaagcgcuuccggaaggaggaggaguccgagggggccaucugguga

SEQ ID NO: 10171 - RNA, 9873 nt, Artificial Sequence
  derived and/or modified CDS sequence (opt1) from DENV-3__FJ182010__SS-prME
accagccugugccucaugaugauccugcccgccgcccuggccuuccaccucaccagccgcgacggggagccccggaugaucguggggaagaacgagcgcggcaagagccugcuguucaagaccgccagcgggaucaacaugugcacccucaucgccauggaccugggcgagaugugcgacgacaccgugaccuacaagugcccccacaucgccgagguggagcccgaggacaucgacugcuggugcaaccugaccagcaccugggugaccuacgggaccugcaaccaggccggcgagcaccggcgcgacaagcgguccguggcgcucgcgccccacgugggcauggggcuggacacgcgcacccagaccuggaugagcgccgagggcgccuggcggcaggucgagaaggucgagaccugggcgcugcgccacccgggguucacgauccucgcccuguuccuggcccacuacaucggcaccucccucacccagaagguggugaucuucguccugcugaugcucgugacccccagcaugacgaugcggugcgugggggucggcaaccgcgacuucguggagggccuguccggggccaccuggguggacgucgugcuggagcacggcgggugcgugaccaccauggccaagaacaagcccacgcucgacaucgagcugcagaagaccgaggcgacccagcuggccacccuccggaagcugugcaucgagggcaagaucacgaacaucaccaccgacagccgcugccccacccagggcgaggccguccugccggaggagcaggaccagaacuacgugugcaagcacacguacguggaccggggguggggcaacgggugcggccucuucgggaagggcucccuggugaccugcgccaaguuccagugccuggagcccaucgagggcaagguggugcaguacgagaaccucaaguacaccgucaucaucaccgugcacacgggggaccagcaccaggucggcaacgagacccagggggugaccgccgagaucacgccccaggcgagcacgaccgaggccauccugcccgaguacggcacccuggggcucgagugcuccccgcgcaccggccuggacuucaacgagaugauccugcucaccaugaagaacaaggccuggauggugcaccggcagugguucuucgaccugccccugcccuggacgagcggcgccaccaccgagacccccacguggaaccgcaaggagcuccuggucaccuucaagaacgcccacgcgaagaagcaggagguggugguccuggggucccaggagggcgccaugcacaccgcccucaccggggccacggagauccagaacagcggcgggaccuccaucuucgccggccaccugaagugccggcugaagauggacaagcucgagcugaagggcaugagcuacgcgaugugcaccaacaccuucgugcugaagaaggagguguccgagacgcagcacgggaccauccucaucaaggucgaguacaagggcgaggacgccccgugcaagauccccuucagcaccgaggacgggcagggcaaggcccacaacggccgccugaucaccgccaaccccguggugacgaagaaggaggagcccgucaacaucgaggcggagccgcccuucggggagagcaacaucgugaucggcaucggggacaacgcccugaagaucaacugguacaagaagggcuccagcaucgggaagauguucgaggccaccgcccggggcgcccgccggauggcgauccugggcgacaccgccugggacuucggguccgugggcgggguccucaacagccugggcaagauggugcaccagaucuucggguccgccuacaccgcccuguucagcggcguguccugggucaugaagaucggcaucggggugcuccugacguggaucggccugaacagcaagaacaccuccaugagcuucuccugcaucgccaucgggaucaucacccucuaccugggcgcggugguccaggccgacaccgggugcgugaucaacuggaagggcaaggagcugaagugcggcagcgggaucuucgugacgaacgagguccacaccuggaccgagcaguacaaguuccaggccgacucccccaagcgccucgccaccgccaucgcgggcgccugggagaacggggugugcggcauccgcagcacgacccggauggagaaccugcuguggaagcaggucgccaacgagcucaacuacauccugugggagaacaacaucaagcugaccgucguggugggggacaucaucggcguccucgagcagggcaagcgcacccugacgccccagccgauggagcugaaguacuccuggaagaccugggggaaggccaagaucgugaccgcggagacccagaacagcuccuucaucaucgacggccccaacacgcccgagugccccagcgccucccgggccuggaacgugugggaggucgaggacuacggguucggcguguucaccaccaacaucuggcucaagcugcgcgagguguacacccagcugugcgaccaccggcucaugagcgccgccgucaaggacgagcgcgcggugcacgccgacaugggcuacuggaucgagagccagaagaacggguccuggaagcuggagaaggccagccugaucgaggugaagaccugcacguggccgaagucccacacccucuggagcaacggcguccuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgcgggcagcgggaaggucgacaacuucacgaugggcgugcugugccucgccauccuguucgaggaggugaugcgggggaaguucggcaagaagcacaugaucgccggggucuucuucaccuucgugcugcuccuguccggccagaucaccuggcgcgacauggcccacacccugaucaugaucggcagcaacgccuccgaccggauggggaugggcgugacguaccucgcgcugaucgccaccuucaagauccagcccuuccuggcccucggguucuuccugcgcaagcugaccagccgggagaaccuccugcugggcgucggccucgccauggcgaccacgcugcagcugcccgaggacaucgagcagauggccaacgggaucgcccucggccugauggcccugaagcucaucacccaguucgagaccuaccagcuguggaccgcccugaucagccucacgugcuccaacaccaucuucacccugaccguggcguggcgcacggccacccugauccucgccggggucagccugcugccggugugccaguccagcuccaugcggaaguccgacuggcuccccaugaccguggccgccaugggcgugccgccccucccgcuguucaucuucucccucaaggacacccugaagcgccgcagcuggccccugaacgagggggugauggcggugggccucgucuccauccuggccagcucccugcuccggaacgacgugcccauggccggcccccugguggccgggggccugcucaucgccugcuacgucaucacggggaccagcgcggaccugaccguggagaaggccgccgacgugaccugggaggaggaggccgagcagacgggcgucucccacaaccugaugaucaccguggacgacgacgggaccaugcgcaucaaggacgacgagaccgagaacauccucaccgugcugcugaagacggcccuccugaucgucagcggcaucuucccguacuccauccccgcgacccugcucguguggcacaccuggcagaagcagacccggcgcagcggcgugcugugggacguccccagcccgcccgagacgcagaaggccgagcuggaggaggggguguaccggaucaagcagcagggcaucuucgggaagacccaggugggcgucggggugcagaaggagggcguguuccacaccauguggcacgucacccgcggcgccgugcucacguacaacgggaagcggcuggagcccaacugggccagcgugaagaaggaccugaucuccuacggcgggggcuggcgccucagcgcgcaguggcagaagggggaggagguccaggugaucgccguggagcccggcaagaaccccaagaacuuccagaccaugcccggcaccuuccagaccacgaccggggagaucggcgccaucgcccuggacuucaagcccgggaccagcggcucccccaucaucaaccgggagggcaaggucguggggcuguacggcaacgggguggucaccaagaacggcggguacgugagcggcaucgcccagacgaacgcggagccggacggccccacccccgagcuggaggaggagauguucaagaagcgcaaccucaccaucauggaccugcaccccggguccggcaagacccggaaguaccugccggccaucgugcgcgaggccaucaagcggcgccuccggacgcugauccuggcccccacccgcgucguggccgcggagauggaggaggcccucaaggggcugcccauccgguaccagaccaccgccaccaagagcgagcacaccggccgcgagaucguggaccugaugugccacgccaccuucaccaugcggcuccugucccccguccgcgugccgaacuacaaccugaucaucauggacgaggcccacuucacggaccccgcgagcaucgccgcccggggguacaucuccacccgcgugggcaugggcgaggccgcggccaucuucaugaccgccacgccgcccgggacggccgacgccuucccgcagagcaacgcgcccauccaggacgaggagcgcgacauccccgagcgguccuggaacagcggcaacgaguggaucaccgacuucgccgggaagaccgucugguucgugcccuccaucaaggccggcaacgacaucgccaacugccuccgcaagaacgggaagaaggugauccagcugagccggaagaccuucgacacggaguaccagaagaccaagcugaacgacugggacuucgucgugaccaccgacaucuccgagaugggcgccaacuucaaggcggaccgcgugaucgacccgcggcgcugccucaagcccgucauccugacggacggccccgagcgggugauccuggccgggcccaugccggugaccgccgccagcgccgcgcagcgccggggccgcgucgggcggaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgcgagaaguccgcggccaucgacggcgaguaccggcugaagggcgagagccgcaagacguucguggagcugaugcggcgcggggaccuccccgucuggcuggcccacaagguggccuccgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcccgcaccuacagcgacccgcuggcgcucaaggaguucaaggacuucgccgccggccggaaguccaucgcccuggaccuggucacggagaucgggcgcgugcccagccaccucgcccaccggacccgcaacgcgcuggacaaccuggugaugcuccacaccagcgagcacggcgggaaggccuaccggcacgccgucgaggagcugcccgagaccauggagacgcugcuccugcugggccucaugauccugcugaccgggggcgccaugcuguuccugaucuccggcaaggggaucggcaagaccagcaucgggcugaucugcgugaucgccuccagcggcaugcucuggauggcggagaucccgcugcaguggaucgccuccgccaucgugcuggaguucuucaugaugguccuccugauccccgagcccgagaagcagcgcacgccccaggacaaccagcuggccuacguggugaucgggauccucacgcuggccgcgaucaucgccgccaacgagaugggccugcucgagaccaccaagcgggaccugggcaugagcaaggagccgggggucgugucccccaccagcuaccuggacguggaccuccaccccgccuccgcguggacgcuguacgccgucgccaccaccgugaucacccccaugcugcgccacacgaucgagaacagcaccgccaacgugucccucgccgcgaucgccaaccaggccgucgugcugaugggccuggacaagggguggccgaucagcaagauggaccucggcgugccccugcuggcccucgggugcuacucccaggucaacccccugacccugaccgccgcggugcuccugcugaucacgcacuacgccaucaucggccccggccuccaggccaaggccacccgggaggcccagaagcgcaccgcggccgggaucaugaagaacccgaccguggacggcaucaugacgaucgaccuggaccccgucaucuacgacagcaaguucgagaagcagcugggccaggugaugcuccuggugcugugcgccguccagcuccugcugaugcggaccuccugggcccucugcgaggcgcugacccuggccaccggccccaucacgacccucugggagggcagccccgggaaguucuggaacaccaccaucgccguguccauggccaacaucuuccgcggcagcuaccuggccggggcgggccuggccuucuccaucaugaaguccguggggacgggcaagcggggcaccgggagccagggcgagacccucggggagaaguggaagaagaagcugaaccagcugucccgcaaggaguucgaccucuacaagaaguccggcaucaccgaggucgaccggaccgaggccaaggaggggcugaagcgcggcgagaucacgcaccacgccgugucccggggcagcgccaagcugcagugguucguggagcgcaacauggucaucccggaggggcgggugaucgaccucggcugcgggcgcggcgggugguccuacuacugcgcgggccugaagaaggugaccgagguccggggcuacaccaagggcgggcccgggcacgaggagcccgugcccaugagcaccuacggcuggaacaucgugaagcugauguccgggaaggacgucuucuaccucccgcccgagaagugcgacacgcugcugugcgacaucggcgagagcucccccagccccaccguggaggagucccgcaccauccgcgugcugaagauggucgagccguggcucaagaacaaccaguucugcaucaaggugcugaaccccuacaugcccaccgugaucgagcaccuggagcggcuccagcgcaagcacggcgggaugcugguccggaacccccugagccgcaacuccacgcacgagauguacuggaucagcaacggcaccgggaacaucguggccuccgugaacauggucagccggcuccugcugaaccgcuucaccaugacccaccggcgcccgacgaucgagaaggacguggaccucggcgccggcacccggcacgugaacgccgagcccgagacccccaacauggacgucaucggggagcgcaucaagcggaucaaggaggagcacaacuccaccuggcacuacgacgacgagaacccguacaagacgugggccuaccacggcagcuacgaggugaaggcgaccggguccgccagcagcaugaucaacggcgucgugaagcugcugaccaagcccugggacgugguccccauggugacccagauggccaugacggacaccacccccuucgggcagcagcgcguguucaaggagaaggucgacacccggacgccgcgcuccaugcccggcacccggcgcgugaugggcaucaccgccgaguggcucuggcggacccuggggcgcaacaagaagccccggcugugcacgcgcgaggaguucaccaagaaggugcgcaccaacgcggccaugggcgccgucuucaccgaggagaaccagugggacagcgccaaggccgcgguggaggacgaggacuucuggaagcucguggaccgggagcgcgagcugcacaagcuggggaagugcggcuccugcgucuacaacaugauggggaagcgggagaagaagcucggcgaguucggcaaggccaaggggagccgcgccaucugguacauguggcugggcgcccgguaccuggaguucgaggcccucggguuccugaacgaggaccacugguucucccgcgagaacagcuacuccggcguggagggggagggccugcacaagcucggcuacauccugcgggacaucagcaagauccccgggggcgcgauguacgccgacgacacggccgggugggacacccgcaucaccgaggacgaccugcacaacgaggagaagaucacccagcagauggacccggagcaccggcagcucgccgacgccaucuucaagcugacguaccagaacaagguggucaaggugcagcgccccacccccaccggcaccgugauggacaucaucucccggaaggaccagcgcggcagcgggcaggucggcaccuacgggcugaacacguucaccaacauggaggcgcagcucauccggcagauggagggcgagggggugcugaccaaggccgaccuggagaacccccaccucuccgagaagaagaucacccaguggcuggagacgaagggcguggagcgccugaagcggauggccaucagcggcgacgacugcgucgugaagccgaucgacgaccgcuucgccaacgcccuccuggcgcugaacgacauggggaaggugcggaaggacaucccccaguggcagcccuccaagggcuggcacgacuggcagcagguccccuucugcagccaccacuuccacgagcucaucaugaaggacgggcgcaagcugguggugccgugccggccccaggacgagcugaucggccgcgcccggaucucccagggggccggcuggagccuccgcgagaccgccugccugggcaaggcguacgcccagauguggucccugauguacuuccaccgccgggaccuccgccuggccagcaacgccaucugcuccgccguccccgugcacugggugcccaccagccggaccacguggagcauccacgcgcaccaccaguggaugaccaccgaggacaugcugaccgucuggaaccgcguguggaucgaggacaacccguggauggaggacaagacgcccgugaccaccugggagaacguccccuaccucgggaagcgggaggaccaguggugcggcucccugaucgggcugaccagccgcgccacgugggcccagaacauccccaccgccauccagcagguccggucccucaucggcaacgaggaguuccuggacuacaugccgagcaugaagcgcuuccggaaggaggaggaguccgagggggccaucugguga

SEQ ID NO: 10172 - RNA, 9873 nt, Artificial Sequence
  derived and/or modified CDS sequence (opt1) from DENV-3__FJ182011__SS-prME
accagccugugccucaugaugauccugcccgccgcccuggccuuccaccucaccagccgggacggggagccccggaugaucguggggaagaacgagcgcggcaagagccugcuguucaagaccgccagcgggaucaacaugugcacccucaucgccauggaccugggggagaugugcgacgacaccgugaccuacaagugcccccacaucgccgagguggagcccgaggacaucgacugcuggugcaaccugaccagcaccugggugaccuacgggaccugcaaccaggccggcgagcaccggcgcgacaagcgguccguggcgcucgcgccccacgugggcauggggcuggacacgcgcacccagaccuggaugagcgccgagggcgccuggcgccagguggagaagguggagaccugggcgcugcgccacccgggguucacgauccucgcccuguuccuggcccacuacaucggcaccucccucacccagaagguggugaucuucauccugcugaugcucgugacccccagcaugacgaugcggugcgugggggugggcaaccgcgacuucgucgagggccuguccggggccaccuggguggacgugguccuggagcacggcgggugcgugaccaccauggccaagaacaagcccacgcucgacaucgagcugcagaagaccgaggcgacccagcuggccacccuccggaagcugugcaucgagggcaagaucacgaacaucaccaccgacagccgcugccccacccagggcgaggccgugcugccggaggagcaggaccagaacuacgucugcaagcacacguacguggaccggggguggggcaacgggugcggccucuucgggaagggcucccuggugaccugcgccaaguuccagugccuggagcccaucgagggcaaggucgugcaguacgagaaccucaaguacaccgugaucaucaccguccacacgggggaccagcaccaggugggcaacgagacccagggggucaccgccgagaucacgccccaggcgagcacgaccgaggccauccugcccgaguacggcacccuggggcucgagugcuccccgcgcaccggccuggacuucaacgagaugauccugcucaccaugaagaacaaggccuggauggugcaccggcagugguucuucgaccugccccugcccuggacgagcggcgccaccaccgagacccccacguggaaccgcaaggagcuccuggugaccuucaagaacgcccacgcgaagaagcaggaggucguggugcuggggucccaggagggcgccaugcacaccgcccucaccggggccacggagauccagaacagcggcgggaccuccaucuucgccggccaccugaagugccggcugaagauggacaagcucgagcugaagggcaugagcuacgcgaugugcaccaacaccuucguccugaagaaggagguguccgagacgcagcacgggaccauccucaucaagguggaguacaagggcgaggacgccccgugcaagauccccuucagcaccgaggacgggcagggcaaggcccacaacggccgccugaucaccgccaaccccgucgugacgaagaaggaggagcccgugaacaucgaggcggagccgcccuucggggagagcaacaucgucaucggcaucggggacaacgcccugaagaucaacugguacaagaagggcuccagcaucgggaagauguucgaggccaccgcccggggcgcccgccggauggcgauccugggcgacaccgccugggacuucggguccgugggcggggugcucaacagccugggcaagaugguccaccagaucuucggguccgccuacaccgcccuguucagcggcguguccugggugaugaagaucggcaucgggguccuccugacguggaucggccugaacagcaagaacaccuccaugagcuucuccugcaucgccaucgggaucaucacccucuaccugggcgcgguggugcaggccgacaccgggugcgucaucaacuggaagggcaaggagcugaagugcggcagcgggaucuucgugacgaacgaggugcacaccuggaccgagcaguacaaguuccaggccgacucccccaagcgccucgccaccgccaucgcgggcgccugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgcggagacccagaacagcuccuucaucaucgacggccccaacacgcccgagugccccagcgccucccgggccuggaacgucugggagguggaggacuacggguucggcguguucaccaccaacaucuggcucaagcugcgcgaggucuacacccagcugugcgaccaccggcucaugagcgccgccgugaaggacgagcgcgcggugcacgccgacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccguggucaucaccgacaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgcgggcagcgggaagguggacaacuucacgaugggcgugcugugccucgccauccuguucgaggaggucaugcgggggaaguucggcaagaagcacaugaucgccgggguguucuucaccuucgugcugcuccuguccggccagaucaccuggcgcgacauggcccacacccugaucaugaucggcagcaacgccuccgaccggauggggaugggcgucacguaccucgcgcugaucgccaccuucaagauccagcccuuccuggcccucggguucuuccugcgcaagcugaccagccgggagaaccuccugcugggcgugggccucgccauggcgaccacgcugcagcugcccgaggacaucgagcagauggccaacgggaucgcccucggccugauggcccugaagcucaucacccaguucgagaccuaccagcuguggaccgcccugaucagccucacgugcuccaacaccaucuucacccugaccguggcguggcgcacggccacccugauccucgccggggucagccugcugccggugugccaguccagcuccaugcggaaguccgacuggcuccccaugaccgucgccgccaugggcgugccgccccucccgcuguucaucuucucccucaaggacacccugaagcgccgcagcuggccccugaacgagggggugauggcggucggccucguguccauccuggccagcucccugcuccggaacgacgugcccauggccggcccccuggucgccgggggccugcucaucgccugcuacgugaucacggggaccagcgcggaccugaccguggagaaggccgccgacgucaccugggaggaggaggccgagcagacgggcgugucccacaaccugaugaucaccguggacgacgacgggaccaugcgcaucaaggacgacgagaccgagaacauccucaccguccugcugaagacggcccuccugaucgugagcggcaucuucccguacuccauccccgcgacccugcucguguggcacaccuggcagaagcagacccggcgcagcggcguccugugggacgugcccagcccgcccgagacgcagaaggccgagcuggaggaggggguguaccggaucaagcagcagggcaucuucgggaagacccaggucggcgugggggugcagaaggagggcgucuuccacaccauguggcacgugacccgcggcgccgugcucacguacaacgggaagcggcuggagcccaacugggccagcgucaagaaggaccugaucuccuacggcgggggcuggcgccucagcgcgcaguggcagaagggggaggagguccaggugaucgccgucgagcccggcaagaaccccaagaacuuccagaccaugcccggcaccuuccagaccacgaccggggagaucggcgccaucgcccuggacuucaagcccgggaccagcggcucccccaucaucaaccgggagggcaaggugguggggcuguacggcaacggggucgugaccaagaacggcggguacgugagcggcaucgcccagacgaacgcggagccggacggccccacccccgagcuggaggaggagauguucaagaagcgcaaccucaccaucauggaccugcaccccggguccggcaagacccggaaguaccugccggccaucguccgcgaggccaucaagcggcgccuccggacgcugauccuggcccccacccgcgugguggccgcggagauggaggaggcccucaaggggcugcccauccgguaccagaccaccgccaccaagagcgagcacaccggccgcgagaucgucgaccugaugugccacgccaccuucaccaugcggcuccugucccccgugcgcgugccgaacuacaaccugaucaucauggacgaggcccacuucacggaccccgcgagcaucgccgcccggggguacaucuccacccgcgucggcaugggcgaggccgcggccaucuucaugaccgccacgccgcccgggacggccgacgccuucccgcagagcaacgcgcccauccaggacgaggagcgcgacauccccgagcgguccuggaacagcggcaacgaguggaucaccgacuucgccgggaagaccgugugguucgugcccuccaucaaggccggcaacgacaucgccaacugccuccgcaagaacgggaagaaggucauccagcugagccggaagaccuucgacacggaguaccagaagaccaagcugaacgacugggacuucguggugaccaccgacaucuccgagaugggcgccaacuucaaggcggaccgcgucaucgacccgcggcgcugccucaagcccgugauccugacggacggccccgagcgggugauccuggccgggcccaugccggucaccgccgccagcgccgcgcagcgccggggccgcguggggcggaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgcgagaaguccgcggccaucgacggcgaguaccggcugaagggcgagagccgcaagacguucguggagcugaugcggcgcggggaccuccccgucuggcuggcccacaagguggccuccgagggcaucaaguacaccgaccggaaguggugcuucgacgggcagcgcaacaaccagauccuggaggagaacauggacgucgagaucuggaccaaggagggcgagaagaagaagcuccggccccgcuggcuggacgcccgcaccuacagcgacccgcuggcgcucaaggaguucaaggacuucgccgccggccggaaguccaucgcccuggaccuggugacggagaucgggcgcgugcccagccaccucgcccaccggacccgcaacgcgcuggacaaccuggucaugcuccacaccagcgagcacggcgggaaggccuaccggcacgccguggaggagcugcccgagaccauggagacgcugcuccugcugggccucaugauccugcugaccgggggcgccaugcuguuccugaucuccggcaaggggaucggcaagaccagcaucgggcugaucugcgugaucgccuccagcggcaugcucuggauggcggagaucccgcugcaguggaucgccuccgccaucguccuggaguucuucaugauggugcuccugauccccgagcccgagaagcagcgcacgccccaggacaaccagcuggccuacguggucaucgggauccucacgcuggccgcgaucaucgccgccaacgagaugggccugcucgagaccaccaagcgggaccugggcaugagcaaggagccggggguggugucccccaccagcuaccuggacgucgaccuccaccccgccuccgcguggacgcuguacgccguggccaccaccgugaucacccccaugcugcgccacacgaucgagaacagcaccgccaacgucucccucgccgcgaucgccaaccaggccguggugcugaugggccuggacaagggguggccgaucagcaagauggaccucggcgucccccugcuggcccucgggugcuacucccaggugaacccccugacccugaccgccgcggugcuccugcugaucacgcacuacgccaucaucggccccggccuccaggccaaggccacccgggaggcccagaagcgcaccgcggccgggaucaugaagaacccgaccgucgacggcaucaugacgaucgaccuggaccccgugaucuacgacagcaaguucgagaagcagcugggccaggugaugcuccugguccugugcgccgugcagcuccugcugaugcggaccuccugggcccucugcgaggcgcugacccuggccaccggccccaucacgacccucugggagggcagccccgggaaguucuggaacaccaccaucgccguguccauggccaacaucuuccgcggcagcuaccuggccggggcgggccuggccuucuccaucaugaaguccgucgggacgggcaagcggggcaccgggagccagggcgagacccucggggagaaguggaagaagaagcugaaccagcugucccgcaaggaguucgaccucuacaagaaguccggcaucaccgagguggaccggaccgaggccaaggaggggcugaagcgcggcgagaucacgcaccacgccgugucccggggcagcgccaagcugcagugguucgucgagcgcaacauggugaucccggaggggcgggugaucgaccucggcugcgggcgcggcgggugguccuacuacugcgcgggccugaagaaggucaccgaggugcggggcuacaccaagggcgggcccgggcacgaggagcccgugcccaugagcaccuacggcuggaacaucgucaagcugauguccgggaaggacguguucuaccucccgcccgagaagugcgacacgcugcugugcgacaucggcgagagcucccccagccccaccguggaggagucccgcaccauccgcguccugaagaugguggagccguggcucaagaacaaccaguucugcaucaaggugcugaaccccuacaugcccaccgucaucgagcaccuggagcggcuccagcgcaagcacggcgggaugcuggugcggaacccccugagccgcaacuccacgcacgagauguacuggaucagcaacggcaccgggaacaucguggccuccgucaacauggugagccggcuccugcugaaccgcuucaccaugacccaccggcgcccgacgaucgagaaggacguggaccucggcgccggcacccggcacgucaacgccgagcccgagacccccaacauggacgugaucggggagcgcaucaagcggaucaaggaggagcacaacuccaccuggcacuacgacgacgagaacccguacaagacgugggccuaccacggcagcuacgaggugaaggcgaccggguccgccagcagcaugaucaacggcgucgugaagcugcugaccaagcccugggacgucgugcccauggugacccagauggccaugacggacaccacccccuucgggcagcagcgcgucuucaaggagaagguggacacccggacgccgcgcuccaugcccggcacccggcgcgugaugggcaucaccgccgaguggcucuggcggacccuggggcgcaacaagaagccccggcugugcacgcgcgaggaguucaccaagaagguccgcaccaacgcggccaugggcgccguguucaccgaggagaaccagugggacagcgccaaggccgcgguggaggacgaggacuucuggaagcucgucgaccgggagcgcgagcugcacaagcuggggaagugcggcuccugcguguacaacaugauggggaagcgggagaagaagcucggcgaguucggcaaggccaaggggagccgcgccaucugguacauguggcugggcgcccgguaccuggaguucgaggcccucggguuccugaacgaggaccacugguucucccgcgagaacagcuacuccggcguggagggggagggccugcacaagcucggcuacauccugcgggacaucagcaagauccccgggggcgcgauguacgccgacgacacggccgggugggacacccgcaucaccgaggacgaccugcacaacgaggagaagaucacccaccagauggacccggagcaccggcagcucgccaacgccaucuucaagcugacguaccagaacaaggucgugaaggugcagcgccccacccccaccggcaccgucauggacaucaucucccggaaggaccagcgcggcagcggccaggugggcaccuacgggcugaacacguucaccaacauggaggcgcagcucauccggcagauggagggcgagggggugcuguccaaggccgaccuggagaacccccaccucagcgagaagaagaucacccaguggcuggagaccaagggcgucgagcgccugaagcggauggccaucuccggcgacgacugcguggugaagccgaucgacgaccgcuucgccaacgcccuccuggcgcugaacgacauggggaagguccggaaggacaucccccaguggcagcccagcaagggcuggcacgacuggcagcagguccccuucugcucccaccacuuccacgagcucaucaugaaggacgggcgcaagcugguggucccgugccggccccaggacgagcugaucggccgcgcccggaucagccagggggccggcuggucccuccgcgagacggccugccugggcaaggcguacgcccagauguggagccugauguacuuccaccgccgggaccuccgccuggccuccaacgccaucugcagcgccgugcccgugcacuggguccccaccagccggaccaccugguccauccacgcgcaccaccaguggaugacgaccgaggacaugcugaccguguggaaccgcguguggaucgaggacaacccguggauggaggacaagacccccgucacgaccugggagaacgugcccuaccucgggaagcgggaggaccaguggugcggcagccugaucgggcugaccucccgcgccaccugggcccagaacauccccacggccauccagcagguccggagccucaucggcaacgaggaguuccuggacuacaugccguccaugaagcgcuuccggaaggaggaggagagcgagggggccaucugguga

SEQ ID NO: 10173 - RNA, 9873 nt, Artificial Sequence
  derived and/or modified CDS sequence (opt1) from DENV-3__FJ182038__SS-prME
accagccucugccucaugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacgacccuguucagcggcguguccugggugaugaagaucggcaucgggguccuccugaccuggaucggccugaacagcaagaacaccuccaugagcuucuccugcaucgccaucggggugaucacgcucuaccugggcgccgugguccaggccgacauggggugcgugaucaacuggaagggcaaggagcugaagugcggcagcgggaucuucgugaccaacgagguccacaccuggaccgagcaguacaaguuccaggcggacucccccaagcgccucgccacggccaucgccggcgccugggagaacggggugugcggcauccgcagcaccacccggauggagaaccugcuguggaagcagaucgcgaacgagcucaacuacauccugugggagaacaacaucaagcugaccguggucgugggggacaucaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagacgugcaccuggccgaagucccacacccucuggagcaacggcgugcuggaguccgacaugaucauccccaagagccuggccgggcccaucucccagcacaacuaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgcggggguguucuucaccuucguccugcuccuguccggccagaucaccuggcgcgacauggcccacacgcugaucaugaucggcagcaacgccuccgacaagauggggaugggcgugaccuaccucgcccugaucgccaccuucaagauccagcccuuccuggcgcucggguucuuccugcggaagcugaccagccgcgagaaccuccugcugggcgugggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccauguucacccugacggucgccuggcggaccgccacccugauccucgcgggggugagccugcugccggucugccaguccagcuccaugcgcaagaccgacuggcuccccauggccguggccgccaugggcgugccgccccucccgcuguucaucuucagccucaaggacacgcugaagcggcgcuccuggccccugaacgagggggucauggccgugggccucgugagcauccuggcguccagccugcuccgcaacgacguccccauggccggcccccugguggccgggggccugcucaucgccugcuacgugaucaccgggaccuccgccgaccugaccgucgagaaggcggccgacaucacgugggaggaggaggccgagcagaccggcgugagccacaaccugaugaucaccguggacgacgacgggaccaugcggaucaaggacgacgagaccgagaacauccucacgguccugcugaagaccgcccuccugaucguguccggcguguucccguacagcauccccgccacccugcucgucuggcacaccuggcagaagcagacgcagcgcuccggcgugcugugggacgugcccagcccgcccgagacccagaaggcggagcuggaggagggggucuaccggaucaagcagcagggcaucuucgggaagacccaggugggcguggggguccagaaggagggcguguuccacaccauguggcacgugacgcgcggcgccguccucaccuacaacgggaagcggcuggagcccaacugggccuccgugaagaaggaccugaucagcuacggcgggggcuggcgccucuccgcccaguggcagaagggggaggaggugcaggucaucgcgguggagcccggcaagaaccccaagaacuuccagaccaugcccggcaccuuccagacgaccaccggggagaucggcgccaucgcccuggacuucaagcccgggaccagcggcagccccaucaucaaccgggagggcaagguggucgggcuguacggcaacgggguggugacgaagaacggcggguacgucuccggcaucgcccagaccaacgccgagccggacggccccacccccgagcuggaggaggagauguucaagaagcgcaaccucaccaucauggaccugcaccccgggagcggcaagacgcggaaguaccugccggcgaucgugcgcgaggccaucaagcggcgccuccggacccugauccuggcccccacccgcguggucgccgccgagauggaggaggcgcucaaggggcugcccauccgguaccagaccacggccaccaaguccgagcacaccggccgcgagaucguggaccugaugugccacgccaccuucacgaugcggcuccugagccccgugcgcgucccgaacuacaaccugaucaucauggacgaggcccacuucaccgaccccgccuccaucgcggcccggggguacaucagcacccgcgugggcaugggcgaggccgccgcgaucuucaugaccgccacgccgcccgggaccgccgacgccuucccgcaguccaacgcccccauccaggacgaggagcgggacauccccgagcgcagcuggaacuccggcaacgaguggaucaccgacuucgcggggaagaccgugugguucguccccagcaucaaggccggcaacgacaucgccaacugccuccgcaagaacgggaagaaggugauccagcugucccggaagacguucgacaccgaguaccagaagaccaagcugaacgacugggacuucguggucaccacggacaucagcgagaugggcgccaacuucaaggccgaccgcgugaucgacccgcggcgcugccucaagcccgugauccugaccgacggccccgagcgggucauccuggcggggcccaugccggugaccgccgccuccgccgcccagcgccggggccgcguggggcggaacccccagaaggagaacgaccaguacaucuucaugggccagccccucaacaacgacgaggaccacgcgcacuggaccgaggccaagaugcugcuggacaacaucaacacccccgaggggaucaucccggcccucuucgagcccgagcgcgagaaguccgccgcgaucgacggcgaguaccggcugaagggcgagucccgcaagacguucgucgagcugaugcggcgcggggaccuccccguguggcuggcccacaaggucgccagcgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcccggaccuacuccgacccgcuggcccucaaggaguucaaggacuucgcggccggccgcaagagcaucgcccuggaccuggugacggagaucgggcgcguccccucccaccucgcccaccggacccgcaacgcccuggacaaccuggugaugcuccacaccagcgagcacggcgggcgggcguaccgccacgccguggaggagcugcccgagaccauggagacgcugcuccugcugggccucaugauccugcugaccgggggcgccaugcuguuccugaucagcggcaaggggaucggcaagaccuccaucgggcugaucugcgucaucgccagcuccggcaugcucuggauggccgagaucccgcugcaguggaucgcgagcgccaucgugcuggaguucuucaugauggugcuccugauccccgagcccgagaagcagcggacgccccaggacaaccagcuggccuacgucgugaucgggauccucacgcuggccgccaccaucgcggccaacgagaugggccugcucgagaccaccaagcgcgaccugggcauguccaaggagccggggguggucagccccacguccuaccuggacguggaccuccaccccgccagcgccuggacccuguacgcgguggccaccaccgucaucacgcccaugcugcggcacaccaucgagaacuccaccgccaacgugagccucgccgccaucgcgaaccaggccgugguccugaugggccuggacaagggguggccgaucuccaagauggaccucggcgugccccugcuggcccucgggugcuacagccaggugaacccccugacccugacggccgccguccuccugcugaucacccacuacgcgaucaucggccccggccuccaggccaaggccacccgcgaggcccagaagcggaccgccgcggggaucaugaagaacccgacgguggacggcaucaugaccaucgaccuggaccccgugaucuacgacuccaaguucgagaagcagcuggggcaggucaugcuccuggugcugugcgccgugcagcuccugcugaugcgcaccagcugggcccucugcgaggcccugacccuggcgacgggccccaucaccacccucugggagggcucccccgggaaguucuggaacaccacgaucgccgucagcauggccaacaucuuccggggcuccuaccuggccggggccggccuggcguucagcaucaugaaguccguggggaccggcaagcgcggcaccgggagccagggcgagacccucggggagaaguggaagaagaagcugaaccagcugagccggaaggaguucgaccucuacaagaaguccggcaucaccgagguggaccgcacggaggccaaggaggggcugaagcggggcgagaccacccaccacgccgucagccgcggcaccgccaagcugcagugguucguggagcggaacauggugaucccggaggggcgcgucaucgaccucggcugcgggcggggcgggugguccuacuacugcgccggccugaagaaggugacggaggugcgcggcuacaccaagggcgggcccgggcacgaggagcccguccccaugagcaccuacggcuggaacaucgugaagcugauguccgggaaggacguguucuaccucccgcccgagaagugcgacacccugcugugcgacaucggcgagagcucccccagccccacggucgaggagucccggaccauccgcgugcugaagaugguggagccguggcucaagaacaaccaguucugcaucaagguccugaaccccuacaugcccaccgugaucgagcaccuggagcgccuccagcggaagcacggcgggaugcuggugcgcaacccccugagccggaacuccacccacgagauguacuggaucagcaacggcacggggaacaucgucgcguccgugaacauggugagccgccuccugcugaaccgguucaccaugacccaccgccggccgaccaucgagaaggacgucgaccucggcgccggcacgcgccacgugaacgccgagcccgagacccccaacauggacgugaucggggagcggaucaagcgcaucaaggaggagcacaacuccaccuggcacuacgacgacgagaacccguacaagaccugggccuaccacggcagcuacgaggucaaggccacgggguccgcgagcuccaugaucaacggcguggucaagcugcugaccaagcccugggacguggugcccauggucacccagauggccaugaccgacacgacccccuucgggcagcagcggguguucaaggagaagguggacacccgcaccccgcggagcaugcccggcacgcgccgggucaugggcaucaccgccgaguggcucuggcgcacccuggggcggaacaagaagccccgccugugcacccgggaggaguucacgaagaaggugcgcaccaacgccgcgaugggcgccguguucaccgaggagaaccagugggacagcgccaaggccgccgucgaggacgaggacuucuggaagcucguggaccgcgagcgggagcugcacaagcuggggaagugcggcuccugcguguacaacaugauggggaagcgcgagaagaagcucggcgaguucggcaaggcgaaggggagccgggccaucugguacauguggcugggcgcccgcuaccuggaguucgaggcccucggguuccugaacgaggaccacugguucucccgggagaacagcuacuccggcgucgagggggagggccugcacaagcucggcuacauccugcgcgacaucagcaagauccccgggggcgccauguacgcggacgacaccgccgggugggacacgcggaucaccgaggacgaccugcacaacgaggagaagaucacccagcagauggacccggagcaccgccagcucgccaacgccaucuucaagcugaccuaccagaacaagguggugaagguccagcggcccacccccacgggcaccgugauggacaucaucucccgcaaggaccagcggggcagcggccaggugggcaccuacgggcugaacaccuucacgaacauggaggcccagcucauccgccagauggagggcgaggggguccuguccaaggcggaccuggagaacccccaccucccggagaagaagaucacccaguggcuggagaccaagggcguggagcggcugcgccggauggccaucagcggcgacgacugcguggucaagcccaucgacgaccgcuucgccaacgcccuccuggcccugaacgacauggggaaggugcggaaggacaucccccaguggcagcccuccaagggcuggcacgacuggcagcaggucccguucugcagccaccacuuccacgagcucaucaugaaggacgggcgcaagcuggucgugcccugccggccccaggacgagcugaucggccgcgcgcggaucucccagggggccggcuggagccuccgcgagaccgccugccugggcaaggccuacgcgcagauguggucccugauguacuuccaccgccgggaccuccgccuggccagcaacgccaucugcuccgccgugcccguccacugggugccgacgagccggaccaccugguccauccacgcccaccaccaguggaugaccacggaggacaugcugaccguguggaaccgcgucuggaucgaggacaaccccuggauggaggacaagacccccgugaccacgugggagaacgugcccuaccucgggaagcgggaggaccaguggugcggcagccugaucgggcugaccagccgcgcgaccugggcccagaacaucccgaccgccauccagcagguccggucccucaucggcaacgaggaguuccuggacuacaugcccagcaugaagcgcuuccggaaggaggaggaguccgagggggccaucugguga

SEQ ID NO: 10174 - RNA, 9873 nt, Artificial Sequence
  derived and/or modified CDS sequence (opt1) from DENV-3__FJ182041__SS-prME
accagccugugccucaugaugauccugcccgccgcccuggccuuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucgccgagguggagcccgaggacaucgacugcuggugcaaccugaccagcaccugggugaccuacgggaccugcaaccaggccggcgagcaccggcgcgacaagcgguccgucgcgcucgcgccccacgugggcauggggcuggacacgcgcacccagaccuggaugagcgccgagggcgccuggcgccagguggagaaggucgagaccugggcgcugcgccacccgggguucacgauccucgcccuguuccuggcccacuacaucggcaccucccucacccagaagguggugaucuucauccugcugaugcucgucacccccagcaugacgaugcggugcgugggggugggcaaccgcgacuucgucgagggccuguccggggccaccuggguggacgugguccuggagcacggcgggugcgugaccaccauggccaagaacaagcccacgcucgacaucgagcugcagaagaccgaggcgacccagcuggccacccuccggaagcugugcaucgagggcaagaucacgaacaucaccaccgacagccgcugccccacccagggcgaggccgugcugccggaggagcaggaccagaacuacgucugcaagcacacguacguggaccggggguggggcaacgggugcggccucuucgggaagggcucccuggugaccugcgccaaguuccagugccuggagcccaucgagggcaaggucgugcaguacgagaaccucaaguacaccgugaucaucaccguccacacgggggaccagcaccaggugggcaacgagacccagggggucaccgccgagaucacgccccaggcgagcacgaccgaggccauccugcccgaguacggcacccuggggcucgagugcuccccgcgcaccggccuggacuucaacgagaugauccugcucaccaugaagaacaaggccuggauggugcaccggcagugguucuucgaccugccccugcccuggacgagcggcgccaccaccgagacccccacguggaaccgcaaggagcuccuggugaccuucaagaacgcccacgcgaagaagcaggaggucguggugcuggggucccaggagggcgccaugcacaccgcccucaccggggccacggagauccagaacagcggcgggaccuccaucuucgccggccaccugaagugccggcugaagauggacaagcucgagcugaagggcaugagcuacgcgaugugcaccaacaccuucguccugaagaaggagguguccgagacgcagcacgggaccauccucaucaagguggaguacaagggcgaggacgucccgugcaagauccccuucagcaccgaggacgggcagggcaaggcccacaacggccgccugaucaccgccaaccccguggugacgaagaaggaggagcccgucaacaucgaggccgagccgcccuucggggagagcaacaucgugaucggcaucggggacaacgcgcugaagaucaacugguacaagaagggcuccagcaucgggaagauguucgaggccaccgcccggggcgcccgccggauggccauccugggcgacaccgcgugggacuucggguccgugggcgggguccucaacagccugggcaagauggugcaccagaucuucggguccgccuacaccgcccuguucagcggcguguccugggucaugaagaucggcaucggggugcuccugacguggaucggccugaacagcaagaacaccuccaugagcuucuccugcaucgccaucgggaucaucacccucuaccugggcgccgugguccaggcggacaccgggugcgugaucaacuggaagggcaaggagcugaagugcggcagcgggaucuucgugacgaacgagguccacaccuggaccgagcaguacaaguuccaggccgacucccccaagcgccucgccaccgccaucgccggcgcgugggagaacggggugugcggcauccgcagcacgacccggauggagaaccugcuguggaagcagaucgccaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgcgucccgggccuggaacgugugggagguggaggacuacggguucggcgucuucaccaccaacaucuggcucaagcugcgcgagguguacacccagcugugcgaccaccggcucaugagcgccgccgugaaggacgagcgcgccguccacgcggacaugggcuacuggaucgagagccagaagaacggguccuggaagcuggagaaggccagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgcgauccuguucgaggaggugaugcgggggaaguucggcaagaagcacaugaucgccgggguguucuucaccuucguccugcuccuguccggccagaucaccuggcgcgacauggcccacacccugaucaugaucggcagcaacgccuccgaccggauggggaugggcgugacguaccucgcccugaucgcgaccuucaagauccagcccuuccuggcccucggguucuuccugcgcaagcugaccagccgggagaaccuccugcugggcgugggccucgccauggccaccacgcugcagcugcccgaggacaucgagcagauggcgaacgggaucgcccucggccugauggcccugaagcucaucacccaguucgagaccuaccagcuguggaccgcccugaucagccucacgugcuccaacaccaucuucacccugaccgucgccuggcgcacggcgacccugauccucgccggggugagccugcugccggucugccaguccagcuccaugcggaaguccgacuggcuccccaugaccguggccgccaugggcgugccgccccucccgcuguucaucuucucccucaaggacacccugaagcgccgcagcuggccccugaacgagggggucauggccgugggccucguguccauccuggcgagcucccugcuccggaacgacguccccauggccggcccccugguggccgggggccugcucaucgccugcuacgugaucacggggaccagcgccgaccugaccgucgagaaggcggccgacgugaccugggaggaggaggccgagcagacgggcgugucccacaaccugaugaucaccgucgacgacgacgggaccaugcgcaucaaggacgacgagaccgagaacauccucaccgugcugcugaagacggcccuccugaucgugagcggcaucuucccguacuccauccccgccacccugcucgucuggcacaccuggcagaagcagacccagcggagcggcgugcugugggacgugcccagcccgcccgagacgcagaaggcggagcuggaggagggggucuaccgcaucaagcagcagggcaucuucgggaagacccaggugggcguggggguccagaaggagggcguguuccacaccauguggcacgugacccggggcgccguccucacguacaacgggaagcgccuggagcccaacugggccagcgugaagaaggaccugaucuccuacggcgggggcuggcggcucagcgcccaguggcagaagggggaggaggugcaggucaucgcgguggagcccggcaagaaccccaagaacuuccagaccaugcccggcaccuuccagaccacgaccggggagaucggcgccaucgcccuggacuucaagcccgggaccagcggcucccccaucaucaaccgcgagggcaagguggucgggcuguacggcaacgggguggugaccaagaacggcggguacgucagcggcaucgcccagacgaacgccgagccggacggccccacccccgagcuggaggaggagauguucaagaagcggaaccucaccaucauggaccugcaccccggguccggcaagacccgcaaguaccugccggcgaucgugcgggaggccaucaagcgccggcuccgcacgcugauccuggcccccacccggguggucgccgccgagauggaggaggcgcucaaggggcugcccauccgcuaccagaccaccgccaccaagagcgagcacaccggccgggagaucguggaccugaugugccacgccaccuucaccaugcgccuccugucccccgugcgggucccgaacuacaaccugaucaucauggacgaggcccacuucacggaccccgccagcaucgcggcccgcggguacaucuccacccgggugggcaugggcgaggccgccgcgaucuucaugaccgccacgccgcccgggacggccgacgccuucccgcagagcaacgcccccauccaggacgaggagcgcgacauccccgagcgcuccuggaacagcggcaacgaguggaucaccgacuucgcggggaagaccgugugguucguccccuccaucaaggccggcaacgacaucgccaacugccuccggaagaacgggaagaaggugauccagcugagccgcaagaccuucgacacggaguaccagaagaccaagcugaacgacugggacuucguggucaccaccgacaucuccgagaugggcgccaacuucaaggccgaccgggugaucgacccgcgccggugccucaagcccgugauccugacggacggccccgagcgcgucauccuggcggggcccaugccggugaccgccgccagcgccgcccagcggcgcggccggguggggcgcaacccccagaaggagaacgaccaguacaucuucaccggccagccccucaacaacgacgaggaccacgcgcacuggaccgaggccaagaugcugcuggacaacaucaacacccccgaggggaucaucccggcccucuucgagcccgagcgggagaaguccgccgcgaucgacggcgaguaccgccugaagggcgagagccggaagacguucgucgagcugaugcgccgcggggaccuccccguguggcuggcccacaaggucgccuccgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcaccuacagcgacccgcuggcccucaaggaguucaaggacuucgcggccggccgcaaguccaucgcccuggaccuggugacggagaucgggcggguccccagccaccucgcccaccgcacccggaacgcccuggacaaccuggugaugcuccacaccagcgagcacggcgggaaggcguaccgccacgccguggaggagcugcccgagaccauggagacgcugcuccugcugggccucaugauccugcugaccgggggcgccaugcuguuccugaucuccggcaaggggaucggcaagaccagcaucgggcugaucugcgucaucgccuccagcggcaugcucuggauggccgagaucccgcugcaguggaucgcguccgccaucgugcuggaguucuucaugauggugcuccugauccccgagcccgagaagcagcggacgccccaggacaaccagcuggccuacgucgugaucgggauccucacgcuggccgccaucaucgcggccaacgagaugggccugcucgagaccaccaagcgcgaccugggcaugagcaaggagccggggguggucucccccaccagcuaccuggacguggaccuccaccccgccuccgccuggacgcuguacgcgguggccaccaccgucaucacccccaugcugcggcacacgaucgagaacagcaccgccaacgugucccucgccgccaucgcgaaccaggccgugguccugaugggccuggacaagggguggccgaucagcaagauggaccucggcgugccccugcuggcccucgggugcuacucccaggugaacccccugacccugaccgccgccguccuccugcugaucacgcacuacgcgaucaucggccccggccuccaggccaaggccacccgcgaggcccagaagcggaccgccgcggggaucaugaagaacccgaccguggacggcaucaugacgaucgaccuggaccccgugaucuacgacagcaaguucgagaagcagcuggggcaggucaugcuccuggugcugugcgccgugcagcuccugcugaugcgcaccuccugggcccucugcgaggcccugacccuggcgaccggccccaucacgacccucugggagggcagccccgggaaguucuggaacaccaccaucgccgucuccauggccaacaucuuccggggcagcuaccuggccggggccggccuggcguucuccaucaugaaguccguggggacgggcaagcgcggcaccgggacccagggcgagacccucggggagaaguggaagaagaagcugaaccagcugagccggaaggaguucgaccucuacaagaaguccggcaucaccgagguggaccgcacggaggccaaggaggggcugaagcggggcgagaucacccaccacgccgucagccgcggcuccgccaagcugcagugguucguggagcggaacauggugaucccggaggggcgcgucaucgaccucggcugcgggcggggcggguggagcuacuacugcgccggccugaagaaggugaccgaggugcgcggcuacaccaagggcgggcccgggcacgaggagcccguccccauguccacguacggcuggaacaucgugaagcugaugagcgggaaggacguguucuaccucccgcccgagaagugcgacacccugcugugcgacaucggcgaguccagccccucccccaccgucgaggagagccggaccauccgcgugcugaagaugguggagccguggcucaagaacaaccaguucugcaucaagguccugaaccccuacaugcccacggugaucgagcaccuggagcgccuccagcggaagcacggcgggaugcuggugcgcaacccccugucccggaacagcacccacgagauguacuggaucuccaacggcaccgggaacaucgucgcgagcgugaacauggugucccgccuccugcugaaccgguucaccaugacgcaccgccggccgaccaucgagaaggacgucgaccucggcgccggcacccgccacgugaacgccgagcccgagacccccaacauggacgugaucggggagcggaucaagcgcaucaaggaggagcacaacagcacguggcacuacgacgacgagaacccguacaagaccugggccuaccacggcuccuacgaggucaaggccaccgggagcgcguccagcaugaucaacggcguggucaagcugcugaccaagcccugggacguggugcccauggucacgcagauggccaugaccgacaccacccccuucgggcagcagcggguguucaaggagaagguggacacgcgcaccccgcggagcaugcccggcacccgccgggucaugggcaucaccgccgaguggcucuggcgcacgcuggggcggaacaagaagccccgccugugcacccgggaggaguucaccaagaaggugcgcaccaacgccgcgaugggcgccguguucacggaggagaaccagugggacuccgccaaggccgccgucgaggacgaggacuucuggaagcucguggaccgcgagcgggagcugcacaagcuggggaagugcggcagcugcguguacaacaugauggggaagcgcgagaagaagcucggcgaguucggcaaggcgaaggggucccgggccaucugguacauguggcugggcgcccgcuaccuggaguucgaggcccucggguuccugaacgaggaccacugguucagccgggagaacuccuacagcggcgucgagggggagggccugcacaagcucggcuacauccugcgcgacaucuccaagauccccgggggcgccauguacgcggacgacaccgccgggugggacacccggaucaccgaggacgaccugcacaacgaggagaagaucacgcagcagauggacccggagcaccgccagcucgccaacgccaucuucaagcugaccuaccagaacaagguggugaagguccagcggcccacccccaccggcaccgugauggacaucaucagccgcaaggaccagcggggcuccggccaggugggcacguacgggcugaacaccuucaccaacauggaggcccagcucauccgccagauggagggcgaggggguccugagcaaggcggaccuggagaacccccaccucuccgagaagaagaucacccaguggcuggagacgaagggcguggagcggcugaagcgcauggccaucagcggcgacgacugcguggucaagccgaucgacgaccgguucgccaacgcccuccuggcccugaacgacauggggaaggugcgcaaggacaucccccaguggcagcccuccaagggcuggcacgacuggcagcagguccccuucugcagccaccacuuccacgagcucaucaugaaggacgggcggaagcuggucgugccgugccgcccccaggacgagcugaucggccgggcgcgcaucucccagggggccggcuggagccuccgggagaccgccugccugggcaaggccuacgcgcagauguggucccugauguacuuccaccgccgcgaccuccggcuggccagcaacgccaucugcuccgccgugcccguccacugggugcccaccagccgcaccacguggagcauccacgcccaccaccaguggaugaccaccgaggacaugcugaccguguggaaccgggucuggaucgaggacaacccguggauggaggacaagacgcccgugaccaccugggagaacgugcccuaccucgggaagcgcgaggaccaguggugcggcucccugaucgggcugaccagccgggcgacgugggcccagaacauccccaccgccauccagcagguccgcucccucaucggcaacgaggaguuccuggacuacaugccgagcaugaagcgguuccgcaaggaggaggaguccgagggggccaucugguga

SEQ ID NO: 10175 - RNA, 9873 nt, Artificial Sequence
  derived and/or modified CDS sequence (opt1) from DENV-3__FJ390371__SS-prME
accagccugugccucaugaugauccugcccgccgcccuggccuuccaccucaccagccgggacggggagccccggaugaucguggggaagaacgagcgcggcaagagccugcuguucaagaccgccagcgggaucaacaugugcacccucaucgccauggaccugggggagaugugcgacgacaccgugaccuacaagugcccccacaucgccgagguggagcccgaggacaucgacugcuggugcaaccugaccagcaccugggugaccuacgggaccugcaaccaggccggcgagcaccggcgcgacaagcgguccguggcgcucgcgccccacgugggcauggggcuggacacgcgcacccagaccuggaugagcgccgagggcgccuggcgccagguggagaagguggagaccugggcgcugcgccacccgggguucacgauccucgcccuguuccuggcccacuacaucggcaccucccucacccagaagguggugaucuucauccugcugaugcucgugacccccagcaugacgaugcggugcgugggggugggcaaccgcgacuucgucgagggccuguccggggccaccuggguggacgugguccuggagcacggcgggugcgugaccaccauggccaagaacaagcccacgcucgacaucgagcugcagaagaccgaggcgacccagcuggccacccuccggaagcugugcaucgagggcaagaucacgaacaucaccaccgacagccgcugccccacccagggcgaggccgugcugccggaggagcaggaccagaacuacgucugcaagcacacguacguggaccggggguggggcaacgggugcggccucuucgggaagggcucccuggugaccugcgccaaguuccagugccuggagcccaucgagggcaaggucgugcaguacgagaaccucaaguacaccgugaucaucaccguccacacgggggaccagcaccaggugggcaacgagacccagggggucaccgccgagaucacgccccaggcgagcacgaccgaggccauccugcccgaguacggcacccuggggcucgagugcuccccgcgcaccggccuggacuucaacgagaugauccugcucaccaugaagaacaaggccuggauggugcaccggcagugguucuucgaccugccccugcccuggacgagcggcgccaccaccgagacccccacguggaaccgcaaggagcuccuggugaccuucaagaacgcccacgcgaagaagcaggaggucguggugcuggggucccaggagggcgccaugcacaccgcccucaccggggccacggagauccagaacagcggcgggaccuccaucuucgccggccaccugaagugccggcugaagauggacaagcucgagcugaagggcaugagcuacgcgaugugcaccaacaccuucguccugaagaaggagguguccgagacgcagcacgggaccauccucaucaagguggaguacaagggcgaggacgccccgugcaagauccccuucagcaccgaggacgggcagggcaaggcccacaacggccgccugaucaccgccaaccccgucgugacgaagaaggaggagcccgugaacaucgaggcggagccgcccuucggggagagcaacaucgucaucggcaucggggacaacgcccugaagaucaacugguacaagaagggcuccagcaucgggaagauguucgaggccaccgcccggggcgcccgccggauggcgauccugggcgacaccgccugggacuucggguccgugggcggggugcucaacagccugggcaagaugguccaccagaucuucggguccgccuacaccgcccuguucagcggcguguccugggugaugaagaucggcaucgggguccuccugacguggaucggccugaacagcaagaacaccuccaugagcuucuccugcaucgccaucgggaucaucacccucuaccugggcgcgguggugcaggccgacaccgggugcgucaucaacuggaagggcaaggagcugaagugcggcagcgggaucuucgugacgaacgaggugcacaccuggaccgagcaguacaaguuccaggccgacucccccaagcgccucgccaccgccaucgcgggcgccugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgcggagacccagaacagcuccuucaucaucgacggccccaacacgcccgagugccccagcgccucccgggccuggaacgucugggagguggaggacuacggguucggcguguucaccaccaacaucuggcucaagcugcgcgaggucuacacccagcugugcgaccaccggcucaugagcgccgccgugaaggacgagcgcgcggugcacgccgacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccguggucaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgcgggcagcgggaagguggacaacuucacgaugggcgugcugugccucgccauccuguucgaggaggucaugcgggggaaguucggcaagaagcacaugaucgccgggguguucuucaccuucgugcugcuccuguccggccagaucaccuggcgcgacauggcccacacccugaucaugaucggcagcaacgccuccgaccggauggggaugggcgucacguaccucgcgcugaucgccaccuucaagauccagcccuuccuggcccucggguucuuccugcgcaagcugaccagccgggagaaccuccugcugggcgugggccucgccauggcgaccacgcugcagcugcccgaggacaucgagcagauggccaacgggaucgcccucggccugauggcccugaagcucaucacccaguucgagaccuaccagcuguggaccgcccugaucagccucacgugcuccaacaccaucuucacccugaccguggcguggcgcacggccacccugauccucgccggggucagccugcugccggugugccaguccagcuccaugcggaaguccgacuggcuccccaugaccgucgccgccaugggcgugccgccccucccgcuguucaucuucucccucaaggacacccugaagcgccgcagcuggccccugaacgagggggugauggcggucggccucguguccauccuggccagcucccugcuccggaacgacgugcccauggccggcccccuggucgccgggggccugcucaucgccugcuacgugaucacggggaccagcgcggaccugaccguggagaaggccgccgacgucaccugggaggaggaggccgagcagacgggcgugucccacaaccugaugaucaccguggacgacgacgggaccaugcgcaucaaggacgacgagaccgagaacauccucaccguccugcugaagacggcccuccugaucgugagcggcaucuucccguacuccauccccgcgacccugcucguguggcacaccuggcagaagcagacccggcgcagcggcguccugugggacgugcccagcccgcccgagacgcagaaggccgagcuggaggaggggguguaccggaucaagcagcagggcaucuucgggaagacccaggucggcgugggggugcagaaggagggcgucuuccacaccauguggcacgugacccgcggcgccgugcucacguacaacgggaagcggcuggagcccaacugggccagcgucaagaaggaccugaucuccuacggcgggggcuggcgccucagcgcgcaguggcagaagggggaggagguccaggugaucgccgucgagcccggcaagaaccccaagaacuuccagaccaugcccggcaccuuccagaccacgaccggggagaucggcgccaucgcccuggacuucaagcccgggaccagcggcucccccaucaucaaccgggagggcaaggugguggggcuguacggcaacggggucgugaccaagaacggcggguacgugagcggcaucgcccagacgaacgcggagccggacggccccacccccgagcuggaggaggagauguucaagaagcgcaaccucaccaucauggaccugcaccccggguccggcaagacccggaaguaccugccggccaucguccgcgaggccaucaagcggcgccuccggacgcugauccuggcccccacccgcgugguggccgcggagauggaggaggcccucaaggggcugcccauccgguaccagaccaccgccaccaagagcgagcacaccggccgcgagaucgucgaccugaugugccacgccaccuucaccaugcggcuccugucccccgugcgcgugccgaacuacaaccugaucaucauggacgaggcccacuucacggaccccgcgagcaucgccgcccggggguacaucuccacccgcgucggcaugggcgaggccgcggccaucuucaugaccgccacgccgcccgggacggccgacgccuucccgcagagcaacgcgcccauccaggacgaggagcgcgacauccccgagcgguccuggaacagcggcaacgaguggaucaccgacuucgccgggaagaccgugugguucgugcccuccaucaaggccggcaacgacaucgccaacugccuccgcaagaacgggaagaaggucauccagcugagccggaagaccuucgacacggaguaccagaagaccaagcugaacgacugggacuucguggugaccaccgacaucuccgagaugggcgccaacuucaaggcggaccgcgucaucgacccgcggcgcugccucaagcccgugauccugacggacggccccgagcgggugauccuggccgggcccaugccggucaccgccgccagcgccgcgcagcgccggggccgcguggggcggaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgcgagaaguccgcggccaucgacggcgaguaccggcugaagggcgagagccgcaagacguucguggagcugaugcggcgcggggaccuccccgucuggcuggcccacaagguggccuccgagggcaucaaguacaccgaccggaaguggugcuucgacgggcagcgcaacaaccagauccuggaggagaacauggacgucgagaucuggaccaaggagggcgagaagaagaagcuccggccccgcuggcuggacgcccgcaccuacagcgacccgcuggcgcucaaggaguucaaggacuucgccgccggccggaaguccaucgcccuggaccuggugacggagaucgggcgcgugcccagccaccucgcccaccggacccgcaacgcgcuggacaaccuggucaugcuccacaccagcgagcacggcgggaaggccuaccggcacgccguggaggagcugcccgagaccauggagacgcugcuccugcugggccucaugauccugcugaccgggggcgccaugcuguuccugaucuccggcaaggggaucggcaagaccagcaucgggcugaucugcgugaucgccuccagcggcaugcucuggauggcggagaucccgcugcaguggaucgccuccgccaucguccuggaguucuucaugauggugcuccugauccccgagcccgagaagcagcgcacgccccaggacaaccagcuggccuacguggucaucgggauccucacgcuggccgcgaucaucgccgccaacgagaugggccugcucgagaccaccaagcgggaccugggcaugagcaaggagccggggguggugucccccaccagcuaccuggacgucgaccuccaccccgccuccgcguggacgcuguacgccguggccaccaccgugaucacccccaugcugcgccacacgaucgagaacagcaccgccaacgucucccucgccgcgaucgccaaccaggccguggugcugaugggccuggacaagggguggccgaucagcaagauggaccucggcgucccccugcuggcccucgggugcuacucccaggugaacccccugacccugaccgccgcggugcuccugcugaucacgcacuacgccaucaucggccccggccuccaggccaaggccacccgggaggcccagaagcgcaccgcggccgggaucaugaagaacccgaccgucgacggcaucaugacgaucgaccuggaccccgugaucuacgacagcaaguucgagaagcagcugggccaggugaugcuccugguccugugcgccgugcagcuccugcugaugcggaccuccugggcccucugcgaggcgcugacccuggccaccggccccaucacgacccucugggagggcagccccgggaaguucuggaacaccaccaucgccguguccauggccaacaucuuccgcggcagcuaccuggccggggcgggccuggccuucuccaucaugaaguccgucgggacgggcaagcggggcaccgggagccagggcgagacccucggggagaaguggaagaagaagcugaaccagcugucccgcaaggaguucgaccucuacaagaaguccggcaucaccgagguggaccggaccgaggccaaggaggggcugaagcgcggcgagaucacgcaccacgccgugucccggggcagcgccaagcugcagugguucgucgagcgcaacauggugaucccggaggggcgggugaucgaccucggcugcgggcgcggcgggugguccuacuacugcgcgggccugaagaaggucaccgaggugcggggcuacaccaagggcgggcccgggcacgaggagcccgugcccaugagcaccuacggcuggaacaucgucaagcugauguccgggaaggacguguucuaccucccgcccgagaagugcgacacgcugcugugcgacaucggcgagagcucccccagccccaccguggaggagucccgcaccauccgcguccugaagaugguggagccguggcucaagaacaaccaguucugcaucaaggugcugaaccccuacaugcccaccgucaucgagcaccuggagcggcuccagcgcaagcacggcgggaugcuggugcggaacccccugagccgcaacuccacgcacgagauguacuggaucagcaacggcaccgggaacaucguggccuccgucaacauggugagccggcuccugcugaaccgcuucaccaugacccaccggcgcccgacgaucgagaaggacguggaccucggcgccggcacccggcacgucaacgccgagcccgagacccccaacauggacgugaucggggagcgcaucaagcggaucaaggaggagcacaacuccaccuggcacuacgacgacgagaacccguacaagacgugggccuaccacggcagcuacgaggugaaggcgaccggguccgccagcagcaugaucaacggcgucgugaagcugcugaccaagcccugggacgucgugcccauggugacccagauggccaugacggacaccacccccuucgggcagcagcgcgucuucaaggagaagguggacacccggacgccgcgcuccaugcccggcacccggcgcgugaugggcaucaccgccgaguggcucuggcggacccuggggcgcaacaagaagccccggcugugcacgcgcgaggaguucaccaagaagguccgcaccaacgcggccaugggcgccguguucaccgaggagaaccagugggacagcgccaaggccgcgguggaggacgaggacuucuggaagcucgucgaccgggagcgcgagcugcacaagcuggggaagugcggcuccugcguguacaacaugauggggaagcgggagaagaagcucggcgaguucggcaaggccaaggggagccgcgccaucugguacauguggcugggcgcccgguaccuggaguucgaggcccucggguuccugaacgaggaccacugguucucccgcgagaacagcuacuccggcguggagggggagggccugcacaagcucggcuacauccugcgggacaucagcaagauccccgggggcgcgauguacgccgacgacacggccgggugggacacccgcaucaccgaggacgaccugcacaacgaggagaagaucacccagcagauggacccggagcaccggcagcucgccaacgccaucuucaagcugacguaccagaacaaggucgugaaggugcagcgccccacccccaccggcaccgucauggacaucaucucccggaaggaccagcgcggcagcggccaggugggcaccuacgggcugaacacguucaccaacauggaggcgcagcucauccggcagauggagggcgagggggugcugaccaaggccgaccuggagaacccccaccucuccgagaagaagaucacccaguggcuggagacgaagggcgucgagcgccugaagcggauggccaucagcggcgacgacugcguggugaagccgaucgacgaccgcuucgccaacgcccuccuggcgcugaacgacauggggaagguccggaaggacaucccccaguggcagcccuccaagggcuggcacgacuggcagcagguccccuucugcagccaccacuuccacgagcucaucaugaaggacgggcgcaagcugguggucccgugccggccccaggacgagcugaucggccgcgcccggaucucccagggggccggcuggagccuccgcgagaccgccugccugggcaaggcguacgcccagauguggucccugauguacuuccaccgccgggaccuccgccuggccagcaacgccaucugcuccgccgugcccgugcacuggguccccaccagccggaccacguggagcauccacgcgcaccaccaguggaugaccaccgaggacaugcugaccguguggaaccgcguguggaucgaggacaacccguggauggaggacaagacgcccgucaccaccugggagaacgugcccuaccucgggaagcgggaggaccaguggugcggcucccugaucgggcugaccagccgcgccacgugggcccagaacauccccaccgccauccagcagguccggucccucaucggcaacgaggaguuccuggacuacaugccgagcaugaagcgcuuccggaaggaggaggaguccgagggggccaucugguga

SEQ ID NO: 10176 - RNA, 9873 nt, Artificial Sequence
  derived and/or modified CDS sequence (opt1) from DENV-3__FJ390372__SS-prME
accagccugugccucaugauggugcugcccgccgcccuggcguuccaccucaccagccgcgacggcgagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaagguggagacgugggcccugcgccacccgggguucaccauccucgcgcuguuccuggcccacuacaucggcaccucccucacccagaagguggucaucuucauccugcugaugcucgugacgcccagcaugaccaugcggugcgugggggucggcaaccgcgacuucguggagggccuguccggggccaccuggguggacgucgugcuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccguccugccggaggagcaggaccagaacuacgugugcaagcacaccuacguggaccggggguggggcaacgggugcggccucuucgggaagggcucccuggugaccugcgccaaguuccagugccuggagcccaucgagggcaagguggugcaguacgagaaccucaaguacaccgucaucaucacggugcacaccggggaccagcaccaggucggcaacgagacccagggggugaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggucaccuucaagaacgcccacgccaagaagcaggagguggugguccuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucgugcugaagaaggagguguccgagacccagcacgggaccauccucaucaaggucgaguacaagggcgaggacgcgccgugcaagauccccuucagcaccgaggacgggcagggcaaggcccacaacggccgccugaucacggccaaccccguggugaccaagaaggaggagcccgucaacaucgaggccgagccgcccuucggggagagcaacaucgugaucggcaucggggacaacgcgcugaagaucaacugguacaagaagggcuccagcaucgggaagauguucgaggccaccgcccggggcgcccgccggauggccauccugggcgacaccgcgugggacuucggguccgugggcgggguccucaacagccugggcaagauggugcaccagaucuucggguccgccuacacggcccuguucagcggcguguccugggucaugaagaucggcaucggggugcuccugaccuggaucggccugaacagcaagaacaccuccaugagcuucuccugcaucgccaucggggugaucacccucuaccugggcgccgucgugcaggcggacauggggugcgugaucaacuggaagggcaaggagcugaagugcggcagcgggaucuucgucacgaacgaggugcacaccuggaccgagcaguacaaguuccaggccgacucccccaagcgccucgccaccgccaucgccggcgcgugggagaacggggugugcggcauccgcagcacgacccggauggagaaccugcuguggaagcagaucgccaacgagcucaacuacauccugugggagaacaacaucaagcugaccgucguggugggggacaucaucggcguccucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgcgucccgggccuggaacgugugggaggucgaggacuacggguucggcguguucaccaccaacaucuggcucaagcugcgcgagguguacacccagcugugcgaccaccggcucaugagcgccgccgucaaggacgagcgcgccgugcacgcggacaugggcuacuggaucgagagccagaagaacggguccuggaagcuggagaaggccagccugaucgaggugaagaccugcacguggccgaagucccacacccucuggagcaacggcguccuggaguccgacaugaucauccccaagagccuggccgggcccaucucccagcacaaccaccggccgggcuaccacacccagaccgccgggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaaggucgacaacuucacgaugggcgugcugugccucgcgauccuguucgaggaggugaugcgggggaaguucggcaagaagcacaugaucgccggggucuucuucaccuucgugcugcuccuguccggccagaucaccuggcgcgacauggcccacacccugaucaugaucggcagcaacgccuccgaccggauggggaugggcgugacguaccucgcccugaucgcgaccuucaagauccagcccuuccuggcccucggguucuuccugcgcaagcugaccagccgggagaaccuccugcugggcgucggccucgccauggccaccacgcugcagcugcccgaggacaucgagcagauggcgaacgggaucgcccucggccugauggcccugaagcucaucacccaguucgagaccuaccagcuguggaccgcccugaucagccucacgugcuccaacaccauguucacccugaccguggccuggcgcacggcgacccugauccucgccggggucagccugcugccggugugccaguccagcuccaugcggaagaccgacuggcuccccauggccguggccgccaugggcgugccgccccucccgcuguucaucuucagccucaaggacacccugaagcgccgcuccuggccccugaacgagggggugauggcggugggccucgucagcauccuggccuccagccugcuccggaacgacgugcccauggccggcccccugguggccgggggccugcucaucgccugcuacgucaucacggggaccuccgcggaccugaccguggagaaggccgccgacaucaccugggaggaggaggccgagcagacgggcgugagccacaaccugaugaucaccgucgacgacgacgggaccaugcgcaucaaggacgacgagaccgagaacauccucaccgugcugcugaagacggcccuccugaucguguccggcgucuucccguacagcauccccgcgacccugcucguguggcacaccuggcagaagcagacccagcgguccggcgugcugugggacguccccagcccgcccgagacgcagaaggccgagcuggaggaggggguguaccgcaucaagcagcagggcaucuucgggaagacccaggugggcgucggggugcagaaggagggcguguuccacaccauguggcacgucacccggggcgccgugcucacguacaacgggaagcgccuggagcccaacugggccuccgugaagaaggaccugaucagcuacggcgggggcuggcggcucuccgcgcaguggcagaagggggaggagguccaggugaucgccguggagcccggcaagaaccccaagaacuuccagaccaugcccggcaccuuccagaccacgaccggggagaucggcgccaucgcccuggacuucaagcccgggaccagcggcagccccaucaucaaccgcgagggcaaggucguggggcuguacggcaacgggguggucaccaagaacggcggguacguguccggcaucgcccagacgaacgcggagccggacggccccacccccgagcuggaggaggagauguucaagaagcggaaccucaccaucauggaccugcaccccgggagcggcaagacccgcaaguaccugccggccaucgugcgggaggccaucaagcgccggcuccgcacgcugauccuggcccccacccgggucguggccgcggagauggaggaggcccucaaggggcugcccauccgcuaccagaccaccgccacgaaguccgagcacaccggccgggagaucguggaccugaugugccacgccaccuucaccaugcgccuccugagccccguccgggugccgaacuacaaccugaucaucauggacgaggcccacuucacggaccccgcguccaucgccgcccgcggguacaucagcacccgggugggcaugggcgaggccgcggccaucuucaugaccgccacgccgcccgggacggccgacgccuucccgcaguccaacgcgcccauccaggacgaggagaaggacauccccgagcgcagcuggaacuccggcaacgaguggaucaccgacuucgccgggaagaccgucugguucgugcccagcaucaaggccggcaacgacaucgccaacugccuccgcaagaacgggaagaaggugauccagcugucccggaagaccuucgacacggaguaccagaagaccaagcugaacgacugggacuucgucgugaccaccgacaucagcgagaugggcgccaacuucaaggcggaccgcgugaucgacccgcggcgcugccucaagcccgucauccugacggacggccccgagcgggugauccuggccgggcccaugccggugaccgccgccuccgccgcgcagcgccggggccgcgucgggcggaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgcgagaaguccgcggccaucgacggcgaguaccggcugaagggcgagucccgcaagacguucguggagcugaugcggcgcggggaccuccccgucuggcuggcccacaagguggccagcgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcccggaccuacuccgacccgcuggcgcucaaggaguucaaggacuucgccgccggccgcaagagcaucgcccuggaccuggucacggagaucgggcgcgugcccucccaccucgcccaccggacccgcaacgcgcuggacaaccuggugaugcuccacaccagcgagcacggcgggcgggccuaccgccacgccgucgaggagcugcccgagaccauggagacgcugcuccugcugggccucaugauccugcugaccgggggcgccaugcuguuccugaucagcggcaaggggaucggcaagaccuccaucgggcugaucugcgugaucgccagcuccggcaugcucuggauggcggagaucccgcugcaguggaucgccagcgccaucgugcuggaguucuucaugaugguccuccugauccccgagcccgagaagcagcggacgccccaggacaaccagcuggccuacguggugaucgggauccucacgcuggccgcgaucaucgccgccaacgagaugggccugcucgagaccaccaagcgcgaccugggcauguccaaggagccgggggucgugagccccaccuccuaccuggacguggaccuccaccccgccagcgcguggacgcuguacgccgucgccaccaccgugaucacccccaugcugcggcacacgaucgagaacuccaccgccaacgugagccucgccgcgaucgccaaccaggccgucgugcugaugggccuggacaagggguggccgaucuccaagauggaccucggcgugccccugcuggcccucgggugcuacagccaggucaacccccugacccugaccgccgcggugcuccugcugaucacgcacuacgccaucaucggccccggccuccaggccaaggccacccgcgaggcccagaagcggaccgcggccgggaucaugaagaacccgaccguggacggcaucaugacgaucgaccuggaccccgucaucuacgacuccaaguucgagaagcagcuggggcaggucaugcuccuggugcugugcgccguccagcuccugcugaugcgcaccagcugggcccucugcgaggcgcugacccuggccaccggccccaucacgacccucugggagggcucccccgggaaguucuggaacaccaccaucgccgugagcauggccaacaucuuccggggcuccuaccuggccggggcgggccuggccuucagcaucaugaaguccguggggacgggcaagcgcggcaccgggagccagggcgagacccucggggagaaguggaagaagaagcugaaccagcugagccggaaggaguucgaccucuacaagaaguccggcaucaccgaggucgaccgcaccgaggccaaggaggggcugaagcggggcgagacgacccaccacgccgugagccgcggcaccgccaagcugcagugguucguggagcggaacauggucaucccggaggggcgcgugaucgaccucggcugcgggcggggcgggugguccuacuacugcgcgggccugaagaaggugaccgagguccgcggcuacacgaagggcgggcccgggcacgaggagcccgugcccaugagcaccuacggcuggaacaucgugaagcugauguccgggaaggacgucuucuaccucccgcccgagaagugcgacacccugcugugcgacaucggcgagagcucccccagccccaccguggaggagucccggacgauccgcgugcugaagauggucgagccguggcucaagaacaaccaguucugcaucaaggugcugaaccccuacaugcccaccgugaucgagcaccuggagcgccuccagcggaagcacggcgggaugcugguccgcaacccccugagccggaacuccacccacgagauguacuggaucagcaacggcaccgggaacaucguggccuccgugaacauggucagccgccuccugcugaaccgguucacgaugacccaccgccggccgaccaucgagaaggacguggaccucggcgccggcacccgccacgugaacgccgagcccgagacgcccaacauggacgucaucggggagcggaucaagcgcaucaaggaggagcacaacuccaccuggcacuacgacgacgagaacccguacaagaccugggccuaccacggcagcuacgaggugaaggcgaccggguccgccagcuccaugaucaacggcgucgugaagcugcugacgaagcccugggacgugguccccauggugacccagauggccaugaccgacaccacgcccuucgggcaccagcggguguucaaggagaaggucgacacccgcaccccgcggagcaugcccggcccccgccgggccaugggcaucaccgcggaguggcucuggcgcacgcuggggcggaacaagaagccccgccugugcacccgggaggaguucaccaagaagggccgcaccaacgccgccaugggggccguguucacggaggagaaccagugggacagcgccaaggcggccguggaggacgaggacuucuggaagcucgucgaccgcgagcgggagcugcacaagcugggcaagugcggguccugcguguacaacaugaugggcaagcgcgagaagaagcucggcgaguucgggaaggccaagggcagccgggccaucugguacauguggcugggggcccgcuaccuggaguucgaggcgcucggcuuccugaacgaggaccacugguucucccgggagaacagcuacuccgggguggagggcgagggccugcacaagcucggguacauccugcgcgacaucagcaagaucccgggcggggccauguacgccgacgccaccgccggcugggacacccggaucaccgaggacgaccugcacaacgaggagaagaucacgcagcagauggaccccgaccaccgccagcucgcgaccgccaucuucaagcugaccuaccagaacaaggucgugaaggugcagcggcccacccccaccggcacggucauggacaucaucucccgcaaggaccagcgggggagcggccagguggggaccuacggccugaacaccuucaccaacauggaggcccagcucauccgccagauggagggggagggcgugcuguccaaggccgaccuggagaacccgcaccuccccgagaagaagaucacgcaguggcuggagaccaagggcgucgagcggcugcgccggauggccaucagcggggacgacugcguggugaagcccaucgacgaccgcuucgcgaacgcccuccuggcccugaacgacaugggcaagguccggaaggacaucccccaguggcagccguccaagggguggcacgacuggcagcagguccccuucugcagccaccacuuccacgagcucaucaugaaggacggccgcaagcuggugguccccugccggccccaggacgagcugaucgggcgcgcccggaucucccagggcgcgggcuggagccuccgcgagaccgccugccuggggaaggccuacgcccagauguggucccugauguacuuccaccgccgggaccuccgccuggccagcaacgcgaucugcuccgccgugccggugcacuggguccccaccagccggacgaccugguccauccacgcccaccaccaguggaugaccaccgaggacaugcugacgguguggaaccgcguguggaucgaggacaaccccuggauggaggacaagacccccgucaccaccugggagaacgugccguaccucggcaagcgggaggaccaguggugcgggagccugaucggccugacgagccgcgccaccugggcccagaacauccccaccgcgauccagcagguccggucccucaucgggaacgaggaguuccuggacuacaugcccagcaugaagcgcuuccggaaggaggaggaguccgagggcgccaucugguga

SEQ ID NO: 10177 - RNA, 9873 nt, Artificial Sequence
  derived and/or modified CDS sequence (opt1) from DENV-3__FJ205870__SS-prME
accagccugugccucaugaugauccugcccgccgcccuggccuuccaccucaccagccgggacggggagccgcggaugaucguggggaagaacgagcgcggcaagagccugcuguucaagaccgccagcgggaucaacaugugcacccucaucgccauggaccugggcgagaugugcgacgacaccgugaccuacaagugcccccacaucgccgagguggagcccgaggacaucgacugcuggugcaaccugaccagcaccugggugaccuacgggaccugcaaccaggccggcgagcaccggcgcgacaagcgguccguggcgcucgcgccccacgugggcauggggcuggacacgcgcacccagaccuggaugagcgccgagggcgccuggcgccagguggagaagguggagaccugggcgcugcgccacccgggguucacgauccucgcccuguuccuggcccacuacaucggcaccucccucacccagaagguggugaucuucauccugcugaugcucgugacccccagcaugacgaugcggugcgugggggugggcaaccgcgacuucgucgagggccuguccggggccaccuggguggacgugguccuggagcacggcgggugcgugaccaccauggccaagaacaagcccacgcucgacaucgagcugcagaagaccgaggcgacccagcuggccacccuccggaagcugugcaucgagggcaagaucacgaacaucaccaccgacagccgcugccccacccagggcgaggccgugcugccggaggagcaggaccagaacuacgucugcaagcacacguacguggaccggggguggggcaacgggugcggccucuucgggaagggcucccuggugaccugcgccaaguuccagugccuggagcccaucgagggcaaggucgugcaguacgagaaccucaaguacaccgugaucaucaccguccacacgggggaccagcaccaggugggcaacgagacccagggggucaccgccgagaucacgccccaggcgagcacgaccgaggccauccugcccgaguacggcacccuggggcucgagugcuccccgcgcaccggccuggacuucaacgagaugauccugcucaccaugaagaacaaggccuggauggugcaccggcagugguucuucgaccugccccugcccuggacgagcggcgccaccaccgagacccccacguggaaccgcaaggagcuccuggugaccuucaagaacgcccacgcgaagaagcaggaggucguggugcuggggucccaggagggcgccaugcacaccgcccucaccggggccacggagauccagaacagcggcgggaccuccaucuucgccggccaccugaagugccggcugaagauggacaagcucgagcugaagggcaugagcuacgcgaugugcaccaacaccuucguccugaagaaggagguguccgagacgcagcacgggaccauccucaucaagguggaguacaagggcgaggacgucccgugcaagauccccuucagcaccgaggacgggcagggcaaggcccacaacggccgccugaucaccgccaaccccguggugacgaagaaggaggagcccgucaacaucgaggccgagccgcccuucggggagagcaacaucgugaucggcaucggggacaacgcgcugaagaucaacugguacaagaagggcuccagcaucgggaagauguucgaggccaccgcccggggcgcccgccggauggccauccugggcgacaccgcgugggacuucggguccgugggcgggguccucaacagccugggcaagauggugcaccagaucuucggguccgccuacaccgcccuguucagcggcguguccugggucaugaagaucggcaucggggugcuccugacguggaucggccugaacagcaagaacaccuccaugagcuucuccugcaucgccaucgggaucaucacccucuaccugggcgccgugguccaggcggacaccgggugcgugaucaacuggaagggcaaggagcugaagugcggcagcgggaucuucgugacgaacgagguccacaccuggaccgagcaguacaaguuccaggccgacucccccaagcgccucgccaccgccaucgccggcgcgugggagaacggggugugcggcauccgcagcacgacccggauggagaaccugcuguggaagcagaucgccaacgagcucaacuacauccugugggagaacaacaucaagcugaccguggucgugggggacaucaucggcauccucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgcgucccgggccuggaacgucugggagguggaggacuacggguucggcguguucaccaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccguggucaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcgggaagguggacaacuucacgaugggcgugcugugccucgcgauccuguucgaggaggucaugcgggggaaguucggcaagaagcacaugaucgccgggguguucuucaccuucgugcugcuccuguccggccagaucaccuggcgcgacauggcccacacccugaucaugaucggcagcaacgccuccgaccggauggggaugggcgucacguaccucgcccugaucgcgaccuucaagauccagcccuuccuggcccucggguucuuccugcgcaagcugaccagccgggagaaccuccugcugggcgugggccucgccauggccaccacgcugcagcugcccgaggacaucgagcagauggcgaacgggaucgcccucggccugauggcccugaagcucaucacccaguucgagaccuaccagcuguggaccgcccugaucagccucacgugcuccaacaccaucuucacccugaccguggccuggcgcacggcgacccugauccucgccggggucagcauccugccggugugccaguccagcuccaugcggaaguccgacuggcugcccaugaccgucgccgccaugggcgugccgccccucccgcuguucaucuucucccugaaggacacccucaagcgccgcagcuggccccugaacgagggggugauggccgucggccugguguccauccucgcgagcucccugcugcggaacgacgugcccauggccggcccccucgucgccgggggccugcugaucgccugcuacgugaucacggggaccagcgccgaccucaccguggagaaggcggccgacgucaccugggaggaggaggccgagcagacgggcgugucccacaaccugaugaucaccguggacgacgacgggaccaugcgcaucaaggacgacgagaccgagaacauccugaccguccuccugaagacggcccugcucaucgugagcggcaucuucccguacuccauccccgccacccugcugguguggcacaccuggcagaagcagacccggcgcagcggcguccucugggacgugcccagcccgcccgagacgcagaaggcggagcuggaggaggggguguaccggaucaagcagcagggcaucuucgggaagacccaggucggcgugggggugcagaaggagggcgucuuccacaccauguggcacgugacccgcggcgccgugcugacguacaacgggaagcggcucgagcccaacugggccagcgucaagaaggaccugaucuccuacggcgggggcuggcgccugagcgcccaguggcagaagggggaggagguccaggugaucgcggucgagcccggcaagaaccccaagaacuuccagaccaugcccggcaccuuccagaccacgaccggggagaucggcgccaucgcccucgacuucaagcccgggaccagcggcucccccaucaucaaccgggagggcaaggugguggggcuguacggcaacggggucgugaccaagaacggcggguacgugagcggcaucgcccagacgaacgccgagccggacggccccacccccgagcuggaggaggagauguucaagaagcgcaaccugaccaucauggaccuccaccccggguccggcaagacccggaaguaccugccggcgaucguccgcgaggccaucaagcggcgccugcggacgcucauccuggcccccacccgcgugguggccgccgagauggaggaggcgcugaaggggcuccccauccgguaccagaccaccgccaccaagagcgagcacaccggccgcgagaucgucgaccugaugugccacgccaccuucaccaugcggcugcucucccccgugcgcgugccgaacuacaaccugaucaucauggacgaggcccacuucacggaccccgccagcaucgcggcccggggguacaucuccacccgcgucggcaugggcgaggccgccgcgaucuucaugaccgccacgccgcccgggacggccgacgccuucccgcagagcaacgcccccauccaggacgaggagcgcgacauccccgagcgguccuggaacagcggcaacgaguggaucaccgacuucgcggggaagaccgugugguucgugcccuccaucaaggccggcaacgacaucgccaacugccugcgcaagaacgggaagaaggucauccagcucagccggaagaccuucgacacggaguaccagaagaccaagcugaacgacugggacuucguggugaccaccgacaucuccgagaugggcgccaacuucaaggccgaccgcgucaucgacccgcggcgcugccugaagcccgugauccucacggacggccccgagcgggugauccuggcggggcccaugccggucaccgccgccagcgccgcccagcgccggggccgcguggggcggaacccccagaaggagaacgaccaguacaucuucaccggccagccccugaacaacgacgaggaccacgcgcacuggaccgaggccaagaugcuccuggacaacaucaacacccccgaggggaucaucccggcccuguucgagcccgagcgcgagaaguccgccgcgaucgacggcgaguaccggcucaagggcgagagccgcaagacguucguggagcugaugcggcgcggggaccugcccgucuggcucgcccacaagguggccuccgagggcaucaaguacaccgaccggaaguggugcuucgacgggcagcgcaacaaccagauccuggaggagaacauggacgucgagaucuggaccaaggagggcgagaagaagaagcugcggccccgcuggcucgacgcccgcaccuacagcgacccgcuggcccugaaggaguucaaggacuucgcggccggccggaaguccaucgcccucgaccuggugacggagaucgggcgcgugcccagccaccuggcccaccggacccgcaacgcccucgacaaccuggucaugcugcacaccagcgagcacggcgggaaggcguaccggcacgccguggaggagcuccccgagaccauggagacgcugcugcuccugggccugaugauccuccugaccgggggcgccaugcuguuccucaucuccggcaaggggaucggcaagaccagcaucgggcugaucugcgugaucgccuccagcggcaugcuguggauggccgagaucccgcuccaguggaucgcguccgccaucguccuggaguucuucaugauggugcugcucauccccgagcccgagaagcagcgcacgccccaggacaaccagcuggccuacguggucaucgggauccugacgcucgccgccaucaucgcggccaacgagaugggccugcuggagaccaccaagcgggaccucggcaugagcaaggagccggggguggugucccccaccagcuaccuggacgucgaccugcaccccgccuccgccuggacgcucuacgcgguggccaccaccgugaucacccccaugcugcgccacacgaucgagaacagcaccgccaacgucucccuggccgccaucgcgaaccaggccguggugcucaugggccuggacaagggguggccgaucagcaagauggaccugggcgucccccuccuggcccuggggugcuacucccaggugaacccccucacccugaccgccgccgugcugcuccugaucacgcacuacgcgaucaucggccccggccugcaggccaaggccacccgggaggcccagaagcgcaccgccgcggggaucaugaagaacccgaccgucgacggcaucaugacgaucgaccucgaccccgugaucuacgacagcaaguucgagaagcagcugggccaggugaugcugcucguccugugcgccgugcagcugcuccugaugcggaccuccugggcccugugcgaggcccucacccuggcgaccggccccaucacgacccugugggagggcagccccgggaaguucuggaacaccaccaucgccguguccauggccaacaucuuccgcggcagcuaccucgccggggccggccuggcguucuccaucaugaaguccgucgggacgggcaagcggggcaccgggagccagggcgagacccugggggagaaguggaagaagaagcucaaccagcugucccgcaaggaguucgaccuguacaagaaguccggcaucaccgagguggaccggaccgaggccaaggaggggcucaagcgcggcgagaucacgcaccacgccgugucccggggcagcgccaagcugcagugguucgucgagcgcaacauggugaucccggaggggcgggugaucgaccugggcugcgggcgcggcgggugguccuacuacugcgccggccucaagaaggucaccgaggugcggggcuacaccaagggcgggcccgggcacgaggagcccgugcccaugagcaccuacggcuggaacaucgucaagcugauguccgggaaggacguguucuaccugccgcccgagaagugcgacacgcuccugugcgacaucggcgagagcucccccagccccaccguggaggagucccgcaccauccgcguccugaagaugguggagccguggcugaagaacaaccaguucugcaucaaggugcucaaccccuacaugcccaccgucaucgagcaccuggagcggcugcagcgcaagcacggcgggaugcucgugcggaacccccugagccgcaacuccacgcacgagauguacuggaucagcaacggcaccgggaacaucguggcguccgucaacauggugagccggcugcuccugaaccgcuucaccaugacccaccggcgcccgacgaucgagaaggacguggaccugggcgccggcacccggcacgucaacgccgagcccgagacccccaacauggacgugaucggggagcgcaucaagcggaucaaggaggagcacaacuccaccuggcacuacgacgacgagaacccguacaagacgugggccuaccacggcagcuacgaggugaaggccaccggguccgcgagcagcaugaucaacggcgucgugaagcuccugaccaagcccugggacgucgugcccauggugacccagauggccaugacggacaccacccccuucgggcagcagcgcgucuucaaggagaagguggacacccggacgccgcgcuccaugcccggcacccggcgcgugaugggcaucaccgccgaguggcuguggcggacccucgggcgcaacaagaagccccggcugugcacgcgcgaggaguucaccaagaagguccgcaccaacgccgcgaugggcgccguguucaccgaggagaaccagugggacagcgccaaggccgccguggaggacgaggacuucuggaagcuggucgaccgggagcgcgagcuccacaagcuggggaagugcggcuccugcguguacaacaugauggggaagcgggagaagaagcugggcgaguucggcaaggcgaaggggagccgcgccaucugguacauguggcucggcgcccgguaccuggaguucgaggcccugggguuccucaacgaggaccacugguucucccgcgagaacagcuacuccggcguggagggggagggccugcccaagcugggcuacauccuccgggacaucagcaagauccccggcggggccauguacgcggacgacacggccgggugggacacccgcaucaccgaggacgaccugcacaacgaggagaagaucacccagcagauggaccccgagcaccggcagcuggccaacgccaucuucaagcucacguaccagaacaaggucgugaaggugcagcgccccacccccaccgggaccgucauggacaucaucucccggaaggaccagcgcggcagcggccaggugggcaccuacgggcugaacacguucaccaacauggaggcccagcugauccggcagauggagggcgagggggugcucuccaaggcggaccuggagaacccgcaccugagcgagaagaagaucacccaguggcucgagaccaagggcgucgagcgccugaagcggauggccaucuccggcgacgacugcguggugaagcccaucgacgaccgcuucgccaacgcccugcucgcccugaacgacauggggaagguccggaaggacaucccccaguggcagcccagcaagggcuggcacgacuggcagcaggucccguucugcucccaccacuuccacgagcugaucaugaaggacgggcgcaagcucgugguccccugccggccccaggacgagcugaucggccgcgcgcggaucagccagggggccggcuggucccugcgcgagacggccugccucggcaaggccuacgcgcagauguggagccugauguacuuccaccgccgggaccugcgccucgccuccaacgccaucugcagcgccgugcccgugcacugggucccgaccagccggaccaccugguccauccacgcccaccaccaguggaugacgaccgaggacaugcugaccguguggaaccgcguguggaucgaggacaaccccuggauggaggacaagacccccgucacgaccugggagaacgugcccuaccuggggaagcgggaggaccaguggugcggcagccucaucgggcugaccucccgcgcgaccugggcccagaacaucccgacggccauccagcagguccggagccugaucggcaacgaggaguuccucgacuacaugcccuccaugaagcgcuuccggaaggaggaggagagcgagggggccaucugguga

SEQ ID NO: 10178 - RNA, 9873 nt, Artificial Sequence
  derived and/or modified CDS sequence (opt1) from DENV-3__FJ390373__SS-prME
accagccucugccucaugaugauccugcccgccgcccuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcgcggcaaggcgcacaacggccggcugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccgcggcgcccggcgcauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccggagcacgacccgcauggagaaccugcuguggaagcagaucgcgaacgagcucaacuacauccugugggagaacaacaucaagcugaccguggucgugggggacaccaucggcgugcucgagcagggcaagcggacgcugacgccccagccgauggagcugaaguacuccuggaagaccugggggaaggccaagaucgucaccgccgagacgcagaacagcuccuucaucaucgacggccccaacacccccgagugccccagcgccucccgcgcguggaacgugugggagguggaggacuacggguucggcgucuucaccaccaacaucuggcucaagcugcgggagguguacacccagcugugcgaccaccgccucaugagcgccgccgugaaggacgagcgggccguccacgccgacaugggcuacuggaucgagagccagaagaacggguccuggaagcuggagaaggcgagccugaucgaggugaagacgugcaccuggccgaagucccacacccucuggagcaacggcgugcuggaguccgacaugaucauccccaagagccuggccgggcccaucucccagcacaacuaccgcccgggcuaccacacccagacggccgggcccuggcaccucggcaagcuggagcuggacuucaacuacugcgagggcaccaccgucgugaucaccgagaacugcgggacgcggggccccagccuccgcaccaccaccguguccgggaagcugauccacgaguggugcugccggagcugcacgcugcccccgcuccgcuacaugggcgaggacgggugcugguacggcauggagauccggcccaucuccgagaaggaggagaacauggucaagagccugguguccgccggcagcgggaagguggacaacuucaccaugggcguccugugccucgccauccuguucgaggaggugaugcgcgggaaguucggcaagaagcacaugaucgcggggguguucuucaccuucguccugcuccuguccggccagaucaccuggcgggacauggcccacacgcugaucaugaucggcagcaacgccuccgaccgcauggggaugggcgugaccuaccucgcccugaucgccaccuucaagauccagcccuuccuggcgcucggguucuuccugcggaagcugaccagccgcgagaaccuccugcugggcgugggccucgccauggccacgacccugcagcugcccgaggacaucgagcagauggccaacgggaucgcgcucggccugauggcccugaagcucaccacccaguucgagacguaccagcuguggaccgcccugaucagccugaccugcuccaacaccaucuucacgcugaccgucgccuggcggaccgccacccugauccucgcgggggugagccugcugccggucugccaguccagcuccaugcgcaagacggacuggcuccccaugaccguggccgccaugggcgugccgccccucccgcuguucaucuucagccucaaggacacccugaagcgccgguccuggccccugaacgagggggucauggccgugggccucgugagcauccuggccuccagccugcuccgcaacgacguccccauggcgggcccccugguggccgggggccugcucaucgccugcuacgugaucaccgggacguccgccgaccugaccgucgagaaggccgcggacgugaccugggaggaggaggccgagcagaccggcgugagccacaaccugaugaucaccgucgacgacgacgggacgaugcggaucaaggacgacgagaccgagaacauccucaccgugcugcugaagaccgcccuccugaucguguccggcaucuucccguacagcauccccgccacgcugcucgucuggcacaccuggcagaagcagacccagcgcuccggcgugcugugggacgugcccagcccgcccgagacccagaaggccgagcuggaggagggggucuaccggaucaagcagcagggcaucuucgggaagacccaggugggcguggggguccagaaggagggcguguuccacaccauguggcacgugacccgcggcgcgguccucaccuacaacgggaagcggcuggagcccaacugggccuccgugaagaaggaccugaucagcuacggcgggggcuggcgccucuccgcccaguggcagaagggggaggaggugcaggucaucgccguggagcccggcaagaaccccaagaacuuccagacgaugcccggcaccuuccagaccaccacgggggagaucggcgcgaucgcccuggacuucaagcccgggaccagcggcagccccaucaucaaccgggagggcaagguggucgggcuguacggcaacgggguggugaccaagaacggcggguacgucuccggcaucgcccagaccaacgccgagccggacggccccacgcccgagcuggaggaggagauguucaagaagcgcaaccucaccaucauggaccugcaccccgggagcggcaagacccggaaguaccugccggccaucgugcgcgaggcgaucaagcggcgccuccggacccugauccuggcccccacgcgcguggucgccgccgagauggaggaggcccucaaggggcugcccauccgguaccagaccaccgcgaccaaguccgagcacacgggccgcgagaucguggaccugaugugccacgccaccuucaccaugcggcuccugagccccgugcgcgucccgaacuacaaccugaucaucauggacgaggcccacuucaccgaccccgccuccaucgccgcgcggggguacaucagcacgcgcgugggcaugggcgaggccgccgccaucuucaugaccgcgacgccgcccgggaccgccgacgccuucccgcaguccaacgcccccauccaggacgaggagcgcgacauccccgagcggagcuggaacuccggcaacgaguggaucacggacuucgccgggaagaccgugugguucguccccagcaucaaggcgggcaacgacaucgccaacugccuccgcaagaacgggaagaaggugauccagcugucccggaagaccuucgacaccgaguaccagaagacgaagcugaacgacugggacuucguggucaccaccgacaucagcgagaugggcgccaacuucaaggccgaccgcgugaucgacccgcggcgcugccucaagcccgugauccugaccgacggccccgagcgggucauccuggccgggcccaugccggugaccgcggccuccgccgcccagcgccggggccgcguggggcggaacccccagaaggagaacgaccaguacaucuucacgggccagccccucaacaacgacgaggaccacgcccacuggaccgaggcgaagaugcugcuggacaacaucaacacccccgaggggaucaucccggcccucuucgagcccgagcgcgagaaguccgccgccaucgacggcgaguaccggcugaagggcgagucccgcaagaccuucgucgagcugaugcggcgcggggcgcuccccguguggcuggcccacaaggucgccagcgagggcaucaaguacacggaccggaaguggugcuucgacgggcagcgcaacaaccagauccuggaggagaacauggacguggagaucuggaccaaggagggcgagaagaagaagcuccggccccgcuggcuggacgcccgcaccuacuccgacccgcuggcccucaaggaguucaaggacuucgcggccggccgcaagagcaucgcccuggaccuggugaccgagaucgggcgcguccccucccaccucgcccaccggacgcgcaacgcccuggacaaccuggugaugcuccacaccagcgagcacggcgggaaggcguaccggcacgccguggaggagcugcccgagaccauggagacccugcuccugcugggccucaugauccugcugaccggcggggccaugcuguuccugaucagcgggaaggggaucggcaagaccuccaucgggcugaucugcgucaucgccagcuccggcaugcucuggauggccgagaucccgcugcaguggaucgcgagcgccaucgugcuggaguucuucaugauggugcuccugauccccgagcccgagaagcagcgcacgccccaggacaaccagcuggccuacgucgugaucgggauccucacccuggccgccaucaucgcggccaacgagaugggccugcucgagacgaccaagcgggaccugggcauguccaaggagccggggguggucagccccaccuccuaccuggacguggaccuccaccccgccagcgccuggacccuguacgcgguggccacgaccgucaucacccccaugcugcgccacaccaucgagaacuccacggccaacgugagccucgccgccaucgcgaaccaggccgugguccugaugggccuggacaagggguggccgaucuccaagauggaccucggcgugccccugcuggcccucgggugcuacagccaggugaacccccugacccugaccgccgccguccuccugcugaucacccacuacgcgaucaucggccccggccuccaggccaaggccacgcgggaggcccagaagcgcaccgccgcggggaucaugaagaacccgaccguggacggcaucaugaccaucgaccuggaccccgugaucuacgacuccaaguucgagaagcagcuggggcaggucaugcuccuggugcugugcgccgugcagcuccugcugaugcggacgagcugggcccucugcgaggcccugacccuggcgaccggccccaucaccacgcucugggagggcucccccgggaaguucuggaacaccaccaucgccgucagcauggccaacaucuuccgcggcuccuaccuggccggggccggccuggcguucagcaucaugaaguccguggggaccggcaagcggggcaccgggagccagggcgagacgcucggggagaaguggaagaagaagcugaaccagcugagccgcaaggaguucgaccucuacaagaaguccggcaucaccgagguggaccggaccgaggccaaggaggggcugaagcgcggcgagaucacccaccacgccgucagccggggcuccgccaagcugcagugguucguggagcgcaacauggugaucccggaggggcgggucaucgaccucggcugcgggcgcggcggguggagcuacuacugcgccggccugaagaaggugacggaggugcggggcuacaccaagggcgggcccgggcacgaggagcccguccccauguccaccuacggcuggaacaucgugaagcugaugagcgggaaggacguguucuaccucccgcccgagaagugcgacacccugcugugcgacaucggcgaguccagccccucccccacggucgaggagagccgcaccauccgcgugcugaagaugguggagccguggcucaagaacaaccaguucugcaucaagguccugaaccccuacaugcccaccgugaucgagcaccuggagcggcuccagcgcaagcacggcgggaugcuggugcggaacccccugucccgcaacagcacccacgagauguacuggaucuccaacggcacggggaacaucgucgcgagcgugaacauggugucccggcuccugcugaaccgcuucaccaugacccaccggcgcccgaccaucgagaaggacgucgaccucggcgccggcacgcggcacgugaacgccgagcccgagacccccaacauggacgugaucggggagcgcaucaagcggaucaaggaggagcacaacagcaccuggcacuacgacgacgagaacccguacaagaccugggccuaccacggcuccuacgaggucaaggccacggggagcgcguccagcaugaucaacggcguggucaagcugcugaccaagcccugggacguggugcccauggucacccagauggccaugaccgacacgacccccuucgggcagcagcgcguguucaaggagaagguggacacccggaccccgcgcagcaugcccggcacgcggcgcgucaugggcaucaccgccgaguggcucuggcggacccuggggcgcaacaagaagccccggcugugcacccgcgaggaguucacgaagaaggugcgcaccaacgccgcgaugggcgccguguucaccgaggagaaccagugggacuccgccaaggccgccgucgaggacgaggacuucuggaagcucguggaccgggagcgcgagcugcacaagcuggggaagugcggcagcugcguguacaacaugauggggaagcgggagaagaagcucggcgaguucggcaaggcgaaggggucccgcgccaucugguacauguggcugggcgcccgguaccuggaguucgaggcccucggguuccugaacgaggaccacugguucagccgcgagaacuccuacagcggcgucgagggggagggccugcacaagcucggcuacauccugcgggacaucuccaagauccccgggggcgccauguacgcggacgacaccgccgggugggacacgcgcaucaccgaggacgaccugcacaacgaggagaagaucacccagcagauggacccggagcaccggcagcucgccaacgccaucuucaagcugaccuaccagaacaagguggugaagguccagcgccccacccccacgggcaccgugauggacaucaucagccggaaggaccagcgcggcuccggccaggugggcaccuacgggcugaacaccuucacgaacauggaggcccagcucauccggcagauggagggcgaggggguccugagcaaggcggaccuggagaacccccaccucccggagaagaagaucacccaguggcuggagaccaagggcguggagcgccugaagcggauggccaucuccggcgacgacugcguggucaagcccaucgacgaccgcuucgccaacgcccuccuggcccugaacgacauggggaaggugcggaaggacaucccccaguggcagcccagcaagggcuggcacgacuggcagcaggucccguucugcucccaccacuuccacgagcucaucaugaaggacgggcgcaagcuggucgugcccugccggccccaggacgagcugaucggccgcgcgcggaucagccagggggccggcuggucccuccgcgagaccgccugccugggcaaggccuacgcgcagauguggagccugauguacuuccaccgccgggaccuccgccuggccuccaacgccaucugcagcgccgugcccguccacugggugccgacgucccggaccaccuggagcauccacgcccaccaccaguggaugaccacggaggacaugcugaccguguggaaccgcgucuggaucgaggacaaccccuggauggaggacaagacccccgugaccacgugggagaacgugcccuaccucgggaagcgggaggaccaguggugcggcagccugaucgggcugaccucccgcgcgaccugggcccagaacaucccgaccgccauccagcagguccggagccucaucggcaacgaggaguuccuggacuacaugcccuccaugaagcgcuuccggaaggaggaggagagcgagggggccaucugguga

SEQ ID NO: 10179 - RNA, 9873 nt, Artificial Sequence
  derived and/or modified CDS sequence (opt1) from DENV-3__FJ205871__SS-prME
accagccucugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgugacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaccaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgccucccgggcguggaacgugugggagguggaggacuacggguucggcgucuucaccaccaacaucuggcucaagcugcgcgaggccuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagacgugcaccuggccgaagucccacacccucuggagcaacggcgugcuggaguccgacaugaucauccccaagagccuggccgggcccaucucccagcacaacuaccggccgggcuaccacacccagacggccgggcccuggcaccucggcaagcuggagcuggacuucaacuacugcgagggcaccaccguggucaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccuggucuccgccggcagcgggaagguggacaacuucaccaugggcgugcugugccucgcgauccuguucgaggaggucaugcgggggaaguucggcaagaagcacaugaucgccgggguguucuucaccuucgugcugcuccuguccggccagaucaccuggcgcgacauggcccacacgcugaucaugaucggcagcaacgccuccgaccggauggggaugggcgucaccuaccucgcccugaucgcgaccuucaagauccagcccuuccuggcccucggguucuuccugcgcaagcugaccagccgggagaaccuccugcugggcgugggccucgccauggccacgacccugcagcugcccgaggacaucgagcagauggcgaacgggaucgcccucggccugauggcccugaagcucaccacccaguucgagacguaccagcuguggaccgcccugaucagccugaccugcuccaacaccaucuucacgcugaccguggccuggcgcaccgcgacccugauccucgccggggucagccugcugccggugugccaguccagcuccaugcggaagacggacuggcuccccaugaccgucgccgccaugggcgugccgccccucccgcuguucaucuucagccucaaggacacccugaagcgccgcuccuggccccugaacgagggggugauggccgucggccucgugagcauccuggcguccagccugcuccggaacgacgugcccauggccggcccccuggucgccgggggccugcucaucgccugcuacgugaucaccgggacguccgccgaccugaccguggagaaggcggccgacgucaccugggaggaggaggccgagcagaccggcgugagccacaaccugaugaucaccguggacgacgacgggacgaugcgcaucaaggacgacgagaccgagaacauccucaccguccugcugaagaccgcccuccugaucguguccggcaucuucccguacagcauccccgccacgcugcucguguggcacaccuggcagaagcagacccagcgguccggcguccugugggacgugcccagcccgcccgagacccagaaggcggagcuggaggaggggguguaccgcaucaagcagcagggcaucuucgggaagacgcaggucggcgugggggugcagaaggagggcgucuuccacaccauguggcacgugacccggggcgccgugcucaccuacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagacgaugcccggcaccuuccagaccaccacgggggagaucggcgccaucgcccuggacuucaagcccgggaccagcggcagccccaucaucaaccgcgagggcaaggugguggggcuguacggcaacggggucgugaccaagaacggcggguacguguccggcaucgcccagaccaacgccgagccggacggccccacgcccgagcuggaggaggagauguucaagaagcggaaccucaccaucauggaccugcaccccgggagcggcaagacccgcaaguaccugccggcgaucguccgggaggccaucaagcgccggcuccgcacccugauccuggcccccacgcgggugguggccgccgagauggaggaggcgcucaaggggcugcccauccgcuaccagaccaccgccaccaaguccgagcacacgggccgggagaucgucgaccugaugugccacgccaccuucaccaugcgccuccugagccccgugcgggugccgaacuacaaccugaucaucauggacgaggcccacuucaccgaccccgccuccaucgcggcccgcggguacaucagcacgcgggucggcaugggcgaggccgccgcgaucuucaugaccgccacgccgcccgggaccgccgacgccuucccgcaguccaacgcccccauccaggacgaggagcgcgacauccccgagcgcagcuggaacuccggcaacgaguggaucacggacuucgcggggaagaccgugugguucgugcccagcaucaaggccggcaacgacaucgccaacugccuccggaagaacgggaagaaggucauccagcugucccgcaagaccuucgacaccgaguaccagaagacgaagcugaacgacugggacuucguggugaccaccgacaucagcgagaugggcgccaacuucaaggccgaccgggucaucgacccgcgccggugccucaagcccgugauccugaccgacggccccgagcgcgugauccuggcggggcccaugccggucaccgccgccuccgccgcccagcggcgcggccggguggggcgcaacccccagaaggagaacgaccaguacaucuucacgggccagccccucaacaacgacgaggaccacgcgcacuggaccgaggccaagaugcugcuggacaacaucaacacccccgaggggaucaucccggcccucuucgagcccgagcgggagaaguccgccgcgaucgacggcgaguaccgccugaagggcgagucccggaagaccuucguggagcugaugcgccgcggggaccuccccgucuggcuggcccacaagguggccagcgagggcaucaaguacacggaccgcaaguggugcuucgacgggcagcggaacaaccagauccuggaggagaacauggacgucgagaucuggaccaaggagggcgagaagaagaagcuccgcccccgguggcuggacgcccgcaccuacuccgacccgcuggcccucaaggaguucaaggacuucgcggccggccgcaagagcaucgcccuggaccuggugaccgagaucgggcgggugcccucccaccucgcccaccgcacgcggaacgcccuggacaaccuggucaugcuccacaccagcgagcacggcgggaaggcguaccgccacgccguggaggagcugcccgagaccauggagacccugcuccugcugggccucaugauccugcugaccggcggggccaugcuguuccugaucagcgggaaggggaucggcaagaccuccaucgggcugaucugcgugaucgccagcuccggcaugcucuggauggccgagaucccgcugcaguggaucgcgagcgccaucguccuggaguucuucaugauggugcuccugauccccgagcccgagaagcagcggacgccccaggacaaccagcuggccuacguggucaucgggauccucacccuggccgccaucaucgcggccaacgagaugggccugcucgagacgaccaagcgcgaccugggcauguccaaggagccggggguggugagccccaccuccuaccuggacgucgaccuccaccccgccagcgccuggacccuguacgcgguggccacgaccgugaucacccccaugcugcggcacaccaucgagaacuccacggccaacgucagccucgccgccaucgcgaaccaggccguggugcugaugggccuggacaagggguggccgaucuccaagauggaccucggcgucccccugcuggcccucgggugcuacagccaggugaacccccugacccugaccgccgccgugcuccugcugaucacccacuacgcgaucaucggccccggccuccaggccaaggccacgcgcgaggcccagaagcggaccgccgcggggaucaugaagaacccgaccgucgacggcaucaugaccaucgaccuggaccccgugaucuacgacuccaaguucgagaagcagcugggccaggugaugcuccugguccugugcgccgugcagcuccugcugaugcgcacgagcugggcccucugcgaggcccugacccuggcgaccggccccaucaccacgcucugggagggcucccccgggaaguucuggaacaccaccaucgccgugagcauggccaacaucuuccggggcuccuaccuggccggggccggccuggcguucagcaucaugaaguccgucgggaccggcaagcgcggcaccgggagccagggcgagacgcucggggagaaguggaagaagaagcugaaccagcugagccggaaggaguucgaccucuacaagaaguccggcaucaccgagguggaccgcaccgaggccaaggaggggcugaagcggggcgagaucacccaccacgccgugagccgcggcuccgccaagcugcagugguucgucgagcggaacauggugaucccggaggggcgcgugaucgaccucggcugcgggcggggcggguggagcuacuacugcgccggccugaagaaggucacggaggugcgcggcuacaccaagggcgggcccgggcacgaggagcccgugcccauguccaccuacggcuggaacaucgucaagcugaugagcgggaaggacguguucuaccucccgcccgagaagugcgacacccugcugugcgacaucggcgaguccagccccucccccacgguggaggagagccggaccauccgcguccugaagaugguggagccguggcucaagaacaaccaguucugcaucaaggugcugaaccccuacaugcccaccgucaucgagcaccuggagcgccuccagcggaagcacggcgggaugcuggugcgcaacccccugucccggaacagcacccacgagauguacuggaucuccaacggcacggggaacaucguggcgagcgucaacauggugucccgccuccugcugaaccgguucaccaugacccaccgccggccgaccaucgagaaggacguggaccucggcgccggcacgcgccacgucaacgccgagcccgagacccccaacauggacgugaucggggagcggaucaagcgcaucaaggaggagcacaacagcaccuggcacuacgacgacgagaacccguacaagaccugggccuaccacggcuccuacgaggugaaggccacggggagcgcguccagcaugaucaacggcgucgugaagcugcugaccaagcccugggacgucgugcccauggugacccagauggccaugaccgacacgacccccuucgggcagcagcgggucuucaaggagaagguggacacccgcaccccgcggagcaugcccggcacgcgccgggugaugggcaucaccgccgaguggcucuggcgcacccuggggcggaacaagaagccccgccugugcacccgggaggaguucacgaagaagguccgcaccaacgccgcgaugggcgccguguucaccgaggagaaccagugggacuccgccaaggccgccguggaggacgaggacuucuggaagcucgucgaccgcgagcgggagcugcacaagcuggggaagugcggcagcugcguguacaacaugauggggaagcgcgagaagaagcucggcgaguucggcaaggcgaaggggucccgggccaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgcggacgacaccgccgggugggacacgcggaucaccgaggacgaccugcacaacgaggagaagaucacccagcagauggacccggagcaccgccagcucgccaacgccaucuucaagcugaccuaccagaacaaggucgugaaggugcagcggcccacccccacgggcaccgucauggacaucaucagccgcaaggaccagcggggcuccggccaggugggcaccuacgggcugaacaccuucacgaacauggaggcccagcucauccgccagauggagggcgagggggugcugagcaaggcggaccuggagaacccccaccucccggagaagaagaucacccaguggcuggagaccaagggcgucgagcggcugaagcgcauggccaucuccggcgacgacugcguggugaagcccaucgacgaccgguucgccaacgcccuccuggcccugaacgacauggggaagguccgcaaggacaucccccaguggcagcccagcaagggcuggcacgacuggcagcaggucccguucugcucccaccacuuccacgagcucaucaugaaggacgggcggaagcuggugguccccugccgcccccaggacgagcugaucggccgggcgcgcaucagccagggggccggcuggucccuccgggagaccgccugccugggcaaggccuacgcgcagauguggagccugauguacuuccaccgccgcgaccuccggcuggccuccaacgccaucugcagcgccgugcccgugcacugggucccgacgucccgcaccaccuggagcauccacgcccaccaccaguggaugaccacggaggacaugcugaccguguggaaccggguguggaucgaggacaaccccuggauggaggacaagacccccgucaccacgugggagaacgugcccuaccucgggaagcgcgaggaccaguggugcggcagccugaucgggcugaccucccgggcgaccugggcccagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10180 - RNA, 9873 nt, Artificial Sequence
  derived and/or modified CDS sequence (opt1) from DENV-3__FJ390375__SS-prME
accagccucugccucaugaugauccugcccgccgcccuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaccaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagacgugcaccuggccgaagucccacacccucuggagcaacggcgugcuggaguccgacaugaucauccccaagagccuggccgggcccaucucccagcacaacuaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgcggggguguucuucaccuucguccugcuccuguccggccagaucaccuggcgcgacauggcccacacgcugaucaugaucggcagcaacgccuccgaccggauggggaugggcgugaccuaccucgcccugaucgccaccuucaagauccagcccuuccuggcgcucggguucuuccugcgcaagcugaccagccgggagaaccuccugcugggcgugggccucgccauggccacgacccugcagcugcccgaggacaucgagcagauggccaacgggaucgcgcucggccugauggcccugaagcucaccacccaguucgagacguaccagcuguggaccgcccugaucagccugaccugcuccaacaccaucuucacgcugaccgucgccuggcgcaccgccacccugauccucgcgggggugagccugcugccggucugccaguccagcuccaugcggaagacggacuggcuccccaugaccguggccgccaugggcgugccgccccucccgcuguucaucuucagccucaaggacacccugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggacguccgccgaccugaccgucgagaaggccgcggacgugaccugggaggaggaggccgagcagaccggcgugagccacaaccugaugaucaccgucgacgacgacgggacgaugcgcaucaaggacgacgagaccgagaacauccucaccgugcugcugaagaccgcccuccugaucguguccggcaucuucccguacagcauccccgccacgcugcucgucuggcacaccuggcagaagcagacccagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacccggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagacgaugcccggcaccuuccagaccaccacgggggagaucggcgcgaucgcccuggacuucaagcccgggaccagcggcagccccaucaucaaccgcgagggcaagguggucgggcuguacggcaacgggguggugaccaagaacggcggguacgucuccggcaucgcccagaccaacgccgagccggacggccccacgcccgagcuggaggaggagauguucaagaagcggaaccucaccaucauggaccugcaccccgggagcggcaagacccgcaaguaccugccggccaucgugcgggaggcgaucaagcgccggcuccgcacccugauccuggcccccacgcggguggucgccgccgagauggaggaggcccucaaggggcugcccauccgcuaccagaccaccgcgaccaaguccgagcacacgggccgggagaucguggaccugaugugccacgccaccuucaccaugcgccuccugagccccgugcgggucccgaacuacaaccugaucaucauggacgaggcccacuucaccgaccccgccuccaucgccgcgcgcggguacaucagcacgcgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucacggacuucgccgggaagaccgugugguucguccccagcaucaaggcgggcaacgacaucgccaacugccuccggaagaacgggaagaaggugauccagcugucccgcaagaccuucgacaccgaguaccagaagacgaagcugaacgacugggacuucguggucaccaccgacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucacgggccagccccucaacaacgacgaggaccacgcccacuggaccgaggcgaagaugcugcuggacaacaucaacacccccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacacggaccgcaaguggugcuucgacgggcagcggaacaaccagauccuggaggagaacauggacguggagaucuggaccaaggagggcgagaagaagaagcuccgcccccgguggcuggacgcccgcaccuacuccgacccgcuggcccucaaggaguucaaggacuucgccgcgggccgcaagagcaucgcccuggaccuggugaccgagaucgggcggguccccucccaccucgcccaccgcacgcggaacgcccuggacaaccuggugaugcuccacaccagcgagcacggcgggaaggccuaccgccacgcgguggaggagcugcccgagaccauggagacccugcuccugcugggccucaugauccugcugaccggcggggccaugcuguuccugaucagcgggaaggggaucggcaagaccuccaucgggcugaucugcgucaucgccagcuccggcaugcucuggauggccgagaucccgcugcaguggaucgccagcgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagacgaccaagcgcgaccugggcauguccaaggagccggggguggucagccccaccuccuaccuggacguggaccuccaccccgccagcgccuggacccuguacgccguggcgacgaccgucaucacccccaugcugcggcacaccaucgagaacuccacggccaacgugagccucgccgccaucgccaaccaggcggugguccugaugggccuggacaagggguggccgaucuccaagauggaccucggcgugccccugcuggcccucgggugcuacagccaggugaacccccugacccugaccgccgccguccuccugcugaucacccacuacgccaucaucggccccggccuccaggcgaaggccacgcgcgaggcccagaagcggaccgccgccgggaucaugaagaacccgaccguggacggcaucaugaccaucgaccuggaccccgugaucuacgacuccaaguucgagaagcagcuggggcaggucaugcuccuggugcugugcgcggugcagcuccugcugaugcgcacgagcugggcccucugcgaggcccugacccuggccaccggccccaucaccacgcucugggagggcucccccgggaaguucuggaacaccaccaucgcggucagcauggccaacaucuuccggggcuccuaccuggccggggccggccuggccuucagcaucaugaaguccguggggaccggcaagcgcggcaccgggagccagggcgagacgcucggggagaaguggaagaagaagcugaaccagcugagccggaaggaguucgaccucuacaagaaguccggcaucaccgagguggaccgcaccgaggcgaaggaggggcugaagcggggcgagaucacccaccacgccgucagccgcggcuccgccaagcugcagugguucguggagcggaacauggugaucccggaggggcgcgucaucgaccucggcugcgggcggggcggguggagcuacuacugcgccggccugaagaaggugacggaggugcgcggcuacaccaagggcgggcccgggcacgaggagcccguccccauguccaccuacggcuggaacaucgugaagcugaugagcgggaaggacguguucuaccucccgcccgagaagugcgacacccugcugugcgacaucggcgaguccagccccucccccacggucgaggagagccggaccauccgcgugcugaagaugguggagccguggcucaagaacaaccaguucugcaucaagguccugaaccccuacaugcccaccgugaucgagcaccuggagcgccuccagcggaagcacggcgggaugcuggugcgcaacccccugucccggaacagcacccacgagauguacuggaucuccaacggcacggggaacaucgucgccagcgugaacauggugucccgccuccugcugaaccgguucaccaugacccaccgccggccgaccaucgagaaggacgucgaccucggcgcgggcacgcgccacgugaacgccgagcccgagacccccaacauggacgugaucggggagcggaucaagcgcaucaaggaggagcacaacagcaccuggcacuacgacgacgagaacccguacaagaccugggccuaccacggcuccuacgaggucaaggccacggggagcgccuccagcaugaucaacggcguggucaagcugcugaccaagcccugggacguggugcccauggucacccagauggcgaugaccgacacgacccccuucgggcagcagcggguguucaaggagaagguggacacccgcaccccgcggagcaugcccggcacgcgccgggucaugggcaucaccgccgaguggcucuggcgcacccuggggcggaacaagaagccccgccugugcacccgggaggaguucacgaagaaggugcgcaccaacgccgccaugggcgcgguguucaccgaggagaaccagugggacuccgccaaggccgccgucgaggacgaggacuucuggaagcucguggaccgcgagcgggagcugcacaagcuggggaagugcggcagcugcguguacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcgucgagggggagggccugcacaagcucggcuacauccugcgcgacaucuccaagauccccgggggcgccauguacgccgacgacaccgcggggugggacacgcggaucaccgaggacgaccugcacaacgaggagaagaucacccagcagauggacccggagcaccgccagcucgccaacgccaucuucaagcugaccuaccagaacaagguggugaagguccagcggcccacccccacgggcaccgugauggacaucaucagccgcaaggaccagcggggcuccggccaggugggcaccuacgggcugaacaccuucacgaacauggaggcccagcucauccgccagauggagggcgaggggguccugagcaaggccgaccuggagaacccccaccucccggagaagaagaucacccaguggcuggagaccaagggcguggagcggcugaagcgcauggcgaucuccggcgacgacugcguggucaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcuggucgugcccugccgcccccaggacgagcugaucggccgggcccgcaucagccagggggcgggcuggucccuccgggagaccgccugccugggcaaggccuacgcccagauguggagccugauguacuuccaccgccgcgaccuccggcuggcguccaacgccaucugcagcgccgugcccguccacugggugccgacgucccgcaccaccuggagcauccacgcccaccaccaguggaugaccacggaggacaugcugaccguguggaaccgggucuggaucgaggacaaccccuggauggaggacaagacccccgugaccacgugggagaacgugcccuaccucgggaagcgcgaggaccaguggugcggcagccugaucgggcugaccucccgggccaccugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10181 - RNA, 9873 nt, Artificial Sequence
  derived and/or modified CDS sequence (opt1) from DENV-3__FJ390376__SS-prME
accagccugugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucacgcugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggcgacccuccggaagcugugcaucgagggcaagaucaccaacaucaccacggacagccgcugccccacccagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacacggugaucaucaccguccacaccggggaccagcaccaggugggcaacgagacccagggggucacggccgagaucacgccccaggccagcaccaccgaggcgauccugcccgaguacggcacccuggggcucgagugcuccccgcgcacgggccuggacuucaacgagaugauccugcucaccaugaagaacaaggccuggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgucccgugcaagauccccuucagcacggaggacgggcagggcaaggcgcacaacggccgccugaucaccgccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacacggccugggacuucggguccgugggcgggguccucaacagccugggcaagauggugcaccagaucuucggguccgcguacaccgcccuguucagcggcguguccugggucaugaagaucggcaucggggugcuccugaccuggaucggccugaacagcaagaacaccuccaugagcuucuccugcaucgccaucgggaucaucacgcucuaccugggcgccgugguccaggccgacauggggugcgugaucaacuggaagggcaaggagcugaagugcggcagcgggaucuucgugaccaacgagguccacaccuggaccgagcaguacaaguuccaggcggacucccccaagcgccucgccacggccaucgccggcgccugggagaacggggugugcggcauccgcagcaccacccggauggagaaccugcuguggaagcagaucgcgaacgagcucaacuacauccugugggagaacaacaucaagcugaccguggucgugggggacaucaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagacgugcaccuggccgaagucccacacccucuggagcaacggcgugcuggaguccgacaugaucauccccaagagccuggccgggcccaucucccagcacaacuaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagcgggaggagaacauggucaagagccugguguccgccggcagcgggaagguggacaacuucaccaugggcguccugugccucgccauccuguucgaggaggugaugcgcgggaaguucggcaagaagcacaugaucgcggggguguucuucaccuucguccugcuccuguccggccagaucaucuggcgggacauggcccacacccugaucaugaucggcagcaacgccuccgaccgcauggggaugggcgugacguaccucgcccugaucgccaccuucaagauccagcccuuccuggcgcucggguucuuccugcggaagcugaccagccgcgagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcggacggccacccugauccucgcgggggugagccugcugccggucugccaguccagcuccaugcgcaagaccgacuggcuccccaugaccguggccgccaugggcgugccgccccucccgcuguucaucuucagccucaaggacacgcugaagcgccgguccuggccccugaacgagggggucauggccgugggccucgugagcauccuggccuccagccugcuccgcaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcggaucaaggacgacgagaccgagaacauccucacggugcugcugaagaccgcccuccugaucguguccggcaucuucccguacagcauccccgccacccugcucgucuggcacaccuggcagaagcagacgcagcgcuccggcgugcugugggacgugcccagcccgcccgagacccagaaggccgagcuggaggagggggucuaccggaucaagcagcagggcaucuucgggaagacccaggugggcguggggguccagaaggagggcguguuccacaccauguggcacgugacgcgcggcgcgguccucaccuacaacgggaagcggcuggagcccaacugggccuccgugaagaaggaccugaucagcuacggcgggggcuggcgccucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgggagggcaagguggucgggcuguacggcaacgggguggugacgaagaacggcggguacgucuccggcaucgcccagaccaacgccgagccggacggccccacccccgagcuggaggaggagauguucaagaagcgcaaccucaccaucauggaccugcaccccgggagcggcaagacgcggaaguaccugccggccaucgugcgcgaggcgaucaagcggcgccuccggacccugauccuggcccccacccgcguggucgccgccgagauggaggaggcccucaaggggcugcccauccgguaccagaccacggcgaccaaguccgagcacaccggccgcgagaucguggaccugaugugccacgccaccuucacgaugcggcuccugagccccgugcgcgucccgaacuacaaccugaucaucauggacgaggcccacuucaccgaccccgccuccaucgccgcgcggggguacaucagcacccgcgugggcaugggcgaggccgccgccaucuucaugaccgcgacgccgcccgggaccgccgacgccuucccgcaguccaacgcccccauccaggacgaggagcgcgacauccccgagcggagcuggaacuccggcaacgaguggaucaccgacuucgccgggaagaccgugugguucguccccagcaucaaggcgggcaacgacaucgccaacugccuccgcaagaacgggaagaaggugauccagcugucccggaagacguucgacaccgaguaccagaagaccaagcugaacgacugggacuucguggucaccacggacaucagcgagaugggcgccaacuucaaggccgaccgcgugaucgacccgcggcgcugccucaagcccgugauccugaccgacggccccgagcgggucauccuggccgggcccaugccggugaccgcggccuccgccgcccagcgccggggccgcguggggcggaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgcgagaaguccgccgccaucgacggcgaguaccggcugaagggcgagucccgcaagaccuucgucgagcugaugcggcgcggggaccuccccguguggcuggcgcacaaggucgccagcgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcccgcacguacuccgacccgcuggcccucaaggaguucaaggacuucgccgcgggccgcaagagcaucgcccuggaccuggugaccgagaucgggcgcguccccucccaccucgcccaccggacccgcaacgcccuggacaaccuggugaugcuccacaccagcgagcacggcgggaaggccuaccggcacgcgguggaggagcugcccgagacgauggagacccugcuccugcugggccucaugauccugcugaccgggggcgccaugcuguuccugaucagcggcaaggggaucggcaagaccuccaucgggcugaucugcgucaucgccagcuccggcaugcucuggauggccgagaucccgcugcaguggaucgccagcgcgaucgugcuggaguucuucaugauggugcuccugauccccgagcccgagaagcagcgcacgccccaggacaaccagcuggccuacgucgugaucgggauccucacccuggccgccaucaucgccgcgaacgagaugggccugcucgagaccaccaagcgggaccugggcauguccaaggagccggggguggucagccccacguccuaccuggacguggaccuccaccccgccagcgccuggacccuguacgccguggcgaccaccgucaucacgcccaugcugcgccacaccaucgagaacuccaccgccaacgugagccucgccgccaucgccaaccaggcggugguccugaugggccuggacaagggguggccgaucuccaagauggaccucggcgugccccugcuggcccucgggugcuacagccaggugaacccccugacccugacggccgccguccuccugcugaucacccacuacgccaucaucggccccggccuccaggcgaaggccacccgggaggcccagaagcgcaccgccgccgggaucaugaagaacccgacgguggacggcaucaugaccaucgaccuggaccccgugaucuacgacuccaaguucgagaagcagcuggggcaggucaugcuccuggugcugugcgcggugcagcuccugcugaugcggaccagcugggcccucugcgaggcccugacccuggccacgggccccaucaccacccucugggagggcucccccgggaaguucuggaacaccacgaucgcggucagcauggccaacaucuuccgcggcuccuaccuggccggggccggccuggccuucagcaucaugaaguccguggggaccggcaagcggggcaccgggagccagggcgagacccucggggagaaguggaagaagaagcugaaccagcugagccgcaaggaguucgaccucuacaagaaguccggcaucaccgagguggaccggacggaggcgaaggaggggcugaagcgcggcgagaucacccaccacgccgucagccggggcuccgccaagcugcagugguucguggagcgcaacauggugaucccggaggggcgggucaucgaccucggcugcgggcgcggcggguggagcuacuacugcgccggccugaagaaggugaccgaggugcggggcuacaccaagggcgggcccgggcacgaggagcccguccccauguccacguacggcuggaacaucgugaagcugaugagcgggaaggacguguucuaccucccgcccgagaagugcgacacccugcugugcgacaucggcgaguccagccccucccccaccgucgaggagagccgcaccauccgcgugcugaagaugguggagccguggcucaagaacaaccaguucugcaucaagguccugaaccccuacaugcccacggugaucgagcaccuggagcggcuccagcgcaagcacggcgggaugcuggugcggaacccccugucccgcaacagcacccacgagauguacuggaucuccaacggcaccgggaacaucgucgccagcgugaacauggugucccggcuccugcugaaccgcuucaccaugacgcaccggcgcccgaccaucgagaaggacgucgaccucggcgcgggcacccggcacgugaacgccgagcccgagacccccaacauggacgugaucggggagcgcaucaagcggaucaaggaggagcacaacagcacguggcacuacgacgacgagaacccguacaagaccugggccuaccacggcuccuacgaggucaaggccaccgggagcgccuccagcaugaucaacggcguggucaagcugcugaccaagcccugggacguggugcccauggucacgcagauggcgaugaccgacaccacccccuucgggcagcagcgcguguucaaggagaagguggacacgcggaccccgcgcagcaugcccggcacccggcgcgucaugggcaucaccgccgaguggcucuggcggacgcuggggcgcaacaagaagccccggcugugcacccgcgaggaguucaccaagaaggugcgcaccaacgccgccaugggcgcgguguucacggaggagaaccagugggacuccgccaaggccgccgucgaggacgaggacuucuggaagcucguggaccgggagcgcgagcugcacaagcuggggaagugcggcagcugcguguacaacaugauggggaagcgggagaagaagcucggcgaguucggcaaggccaaggggucccgcgcgaucugguacauguggcugggcgcccgguaccuggaguucgaggcccucggguuccugaacgaggaccacugguucagccgcgagaacuccuacagcggcgucgagggggagggccugcacaagcucggcuacauccugcgggacaucuccaagauccccgggggcgccauguacgccgacgacaccgcggggugggacacccgcaucaccgaggacgaccugcacaacgaggagaagaucacgcagcagauggacccggagcaccggcagcucgccaacgccaucuucaagcugaccuaccagaacaagguggugaagguccagcgccccacccccaccggcaccgugauggacaucaucagccggaaggaccagcgcggcuccggccaggugggcacguacgggcugaacaccuucaccaacauggaggcccagcucauccggcagauggagggcgaggggguccugagcaaggccgaccuggagaacccccaccucccggagaagaagaucacccaguggcuggagacgaagggcguggagcgccugaagcggauggcgaucuccggcgacgacugcguggucaagcccaucgacgaccgcuucgccaacgcccuccuggcccugaacgacauggggaaggugcggaaggacaucccccaguggcagcccagcaagggcuggcacgacuggcagcaggucccguucugcucccaccacuuccacgagcucaucaugaaggacgggcgcaagcuggucgugcccugccggccccaggacgagcugaucggccgcgcccggaucagccagggggcgggcuggucccuccgcgagaccgccugccugggcaaggccuacgcccagauguggagccugauguacuuccaccgccgggaccuccgccuggcguccaacgccaucugcagcgccgugcccguccacugggugccgaccucccggaccacguggagcauccacgcccaccaccaguggaugaccaccgaggacaugcugaccguguggaaccgcgucuggaucgaggacaaccccuggauggaggacaagacgcccgugaccaccugggagaacgugcccuaccucgggaagcgggaggaccaguggugcggcagccugaucgggcugaccucccgcgccacgugggcgcagaacaucccgaccgccauccagcagguccggagccucaucggcaacgaggaguuccuggacuacaugcccuccaugaagcgcuuccggaaggaggaggagagcgagggggccaucugguga

SEQ ID NO: 10182 - RNA, 9873 nt, Artificial Sequence
  derived and/or modified CDS sequence (opt1) from DENV-3__FJ390377__SS-prME
accagccucugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccgucgcccucgcgccccacgugggcauggggcuggacacccgcacccagaccuggaugagcgccgagggcgccuggcgccagguggagaaggucgagaccugggcccugcgccacccgggguucaccauccucgcgcuguuccuggcccacuacaucggcaccucccucacccagaagguggugaucuucacgcugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggcgacccuccggaagcugugcaucgagggcaagaucaccaacaucaccacggacagccgcugccccacccagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacacggugaucaucaccguccacaccggggaccagcaccaggugggcaacgagacccagggggucacggccgagaucacgccccaggccagcaccaccgaggcgauccugcccgaguacggcacccuggggcucgagugcuccccgcgcacgggccuggacuucaacgagaugauccugcucaccaugaagaacaaggccuggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgucccgugcaagauccccuucagcacggaggacgggcagggcaaggcgcacaacggccgccugaucaccgccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacacggccugggacuucggguccgugggcgggguccucaacagccugggcaagauggugcaccagaucuucggguccgcguacaccgcccuguucagcggcguguccugggucaugaagaucggcaucggggugcuccugaccuggaucggccugaacagcaagaacaccuccaugagcuucuccugcaucgccaucgggaucaucacgcucuaccugggcgccgugguccaggccgacauggggugcgugaucaacuggaagggcaaggagcugaagugcggcagcgggaucuucgugaccaacgagguccacaccuggaccgagcaguacaaguuccaggcggacucccccaagcgccucgccacggccaucgccggcgccugggagaacggggugugcggcauccgcagcaccacccggauggagaaccugcuguggaagcagaucgcgaacgagcucaacuacauccugugggagaacaacaucaagcugaccguggucgugggggacaucaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagacgugcaccuggccgaagucccacacccucuggagcaacggcgugcuggaguccgacaugaucauccccaagagccuggccgggcccaucucccagcacaacuaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgccauccuguucgaggaggugaugcgggggaaguucggcaagaagcacaugaucgcggggguguucuucaccuucguccugcuccuguccggccagaucaccuggcgcgacauggcccacacgcugaucaugaucggcagcaacgccuccgaccggauggggaugggcgugaccuaccucgcccugaucgccaccuucaagauccagcccuuccuggcgcucggguucuuccugcgcaagcugaccagccgggagaaccuccugcugggcgugggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccaucuucacccugacggucgccuggcgcaccgccacccugauccucgcgggggugagccugcugccggucugccaguccagcuccaugcggaagaccgacuggcuccccaugacgguggccgccaugggcgugccgccccucccgcuguucaucuucagccucaaggacacccugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugacggucgagaaggccgcggacgugaccugggaggaggaggccgagcagaccggcgugagccacaaccugaugaucaccgucgacgacgacgggaccaugcgcaucaaggacgacgagacggagaacauccucaccgugcugcugaagaccgcccuccugaucguguccggcaucuucccguacagcauccccgccacccugcucgucuggcacacguggcagaagcagacccagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacacgauguggcacgugacccggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcacguuccagaccaccaccggggagaucggcgcgaucgcccuggacuucaagcccgggacgagcggcagccccaucaucaaccgcgagggcaagguggucgggcuguacggcaacgggguggugaccaagaacggcggguacgucuccggcaucgcccagaccaacgccgagccggacggccccacccccgagcuggaggaggagauguucaagaagcggaaccucacgaucauggaccugcaccccgggagcggcaagacccgcaaguaccugccggccaucgugcgggaggcgaucaagcgccggcuccgcacccugauccuggcccccacccggguggucgccgccgagauggaggaggcccucaaggggcugcccauccgcuaccagacgaccgcgaccaaguccgagcacaccggccgggagaucguggaccugaugugccacgccacguucaccaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugacggcgacgccgcccgggaccgccgacgccuucccgcaguccaacgcccccauccaggacgaggagcgcgacauccccgagcgcagcuggaacuccggcaacgaguggaucaccgacuucgccgggaagacggugugguucguccccagcaucaaggcgggcaacgacaucgccaacugccuccggaagaacgggaagaaggugauccagcugucccgcaagaccuucgacaccgaguaccagaagaccaagcugaacgacugggacuucguggucacgaccgacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggacggaggcgaagaugcugcuggacaacaucaacacccccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggacgaaggagggcgagaagaagaagcuccgcccccgguggcuggacgcccgcaccuacuccgacccgcuggcccucaaggaguucaaggacuucgccgcgggccgcaagagcaucgcccuggaccuggugaccgagaucgggcggguccccucccaccucgcccaccgcacccggaacgcccuggacaaccuggugaugcuccacacgagcgagcacggcgggaaggccuaccgccacgcgguggaggagcugcccgagaccauggagacccugcuccugcugggccucaugauccugcugaccgggggcgccaugcuguuccugaucagcggcaaggggaucggcaagacguccaucgggcugaucugcgucaucgccagcuccggcaugcucuggauggccgagaucccgcugcaguggaucgccagcgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccacgaagcgcgaccugggcauguccaaggagccggggguggucagccccaccuccuaccuggacguggaccuccaccccgccagcgccuggacccuguacgccguggcgaccacggucaucacccccaugcugcggcacaccaucgagaacuccaccgccaacgugagccucgccgccaucgccaaccaggcggugguccugaugggccuggacaagggguggccgaucuccaagauggaccucggcgugccccugcuggcccucgggugcuacagccaggugaacccccugacgcugaccgccgccguccuccugcugaucacccacuacgccaucaucggccccggccuccaggcgaaggccacccgcgaggcccagaagcggacggccgccgggaucaugaagaacccgaccguggacggcaucaugaccaucgaccuggaccccgugaucuacgacuccaaguucgagaagcagcuggggcaggucaugcuccuggugcugugcgcggugcagcuccugcugaugcgcaccagcugggcccucugcgaggcccugacgcuggccaccggccccaucaccacccucugggagggcucccccgggaaguucuggaacacgaccaucgcggucagcauggccaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggaguucgaccucuacaagaaguccggcaucacggagguggaccgcaccgaggcgaaggaggggcugaagcggggcgagaucacccaccacgccgucagccgcggcuccgccaagcugcagugguucguggagcggaacauggugaucccggaggggcgcgucaucgaccucggcugcgggcggggcggguggagcuacuacugcgccggccugaagaaggugaccgaggugcgcggcuacacgaagggcgggcccgggcacgaggagcccguccccauguccaccuacggcuggaacaucgugaagcugaugagcgggaaggacguguucuaccucccgcccgagaagugcgacacccugcugugcgacaucggcgaguccagccccucccccaccgucgaggagagccggacgauccgcgugcugaagaugguggagccguggcucaagaacaaccaguucugcaucaagguccugaaccccuacaugcccaccgugaucgagcaccuggagcgccuccagcggaagcacggcgggaugcuggugcgcaacccccugucccggaacagcacccacgagauguacuggaucuccaacggcaccgggaacaucgucgccagcgugaacauggugucccgccuccugcugaaccgguucacgaugacccaccgccggccgaccaucgagaaggacgucgaccucggcgcgggcacccgccacgugaacgccgagcccgagacgcccaacauggacgugaucggggagcggaucaagcgcaucaaggaggagcacaacagcaccuggcacuacgacgacgagaacccguacaagaccugggccuaccacggcuccuacgaggucaaggccaccgggagcgccuccagcaugaucaacggcguggucaagcugcugacgaagcccugggacguggugcccauggucacccagauggcgaugaccgacaccacgcccuucgggcagcagcggguguucaaggagaagguggacacccgcaccccgcggagcaugcccggcacccgccgggucaugggcaucacggccgaguggcucuggcgcacccuggggcggaacaagaagccccgccugugcacccgggaggaguucaccaagaaggugcgcacgaacgccgccaugggcgcgguguucaccgaggagaaccagugggacuccgccaaggccgccgucgaggacgaggacuucuggaagcucguggaccgcgagcgggagcugcacaagcuggggaagugcggcagcugcguguacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcgucgagggggagggccugcacaagcucggcuacauccugcgcgacaucuccaagauccccgggggcgccauguacgccgacgacaccgcggggugggacacccggaucacggaggacgaccugcacaacgaggagaagaucacccagcagauggacccggagcaccgccagcucgccaacgccaucuucaagcugaccuaccagaacaagguggugaagguccagcggcccacccccaccggcacggugauggacaucaucagccgcaaggaccagcggggcuccggccaggugggcaccuacgggcugaacaccuucaccaacauggaggcccagcucauccgccagauggagggcgaggggguccugagcaaggccgaccuggagaacccccaccucccggagaagaagaucacgcaguggcuggagaccaagggcguggagcggcugaagcgcauggcgaucuccggcgacgacugcguggucaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcuggucgugcccugccgcccccaggacgagcugaucggccgggcccgcaucagccagggggcgggcuggucccuccgggagaccgccugccugggcaaggccuacgcccagauguggagccugauguacuuccaccgccgcgaccuccggcuggcguccaacgccaucugcagcgccgugcccguccacugggugccgaccucccgcacgaccuggagcauccacgcccaccaccaguggaugaccaccgaggacaugcugacgguguggaaccgggucuggaucgaggacaaccccuggauggaggacaagacccccgugaccaccugggagaacgugcccuaccucgggaagcgcgaggaccaguggugcggcagccugaucgggcugacgucccgggccaccugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10183 - RNA, 9873 nt, Artificial Sequence
  derived and/or modified CDS sequence (opt1) from DENV-3__FJ547069__SS-prME
accagccugugccucaugaugauccugcccgccgcccuggcguuccaccucaccagccgggacggggagccgcggaugaucguggggaagaacgagcggggcaagagccugcuguucaagacggccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaaccugggcgggaccagcaucuucgccggccaccugaagugccggcucaagauggacaagcuggagcugaagggcauguccuacgccaugugcaccaacacguucguccucaagaaggaggugagcgagacccagcacgggaccauccugaucaagguggaguacaagggcgaggacgucccgugcaagauccccuucuccaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcagcuccaucgggaagauguucgaggcgaccgcccggggcgcccgccggauggccauccucggcgacaccgccugggacuucgggagcgugggcgggguccugaacucccugggcaagauggugcaccagaucuucgggagcgcguacacggcccucuucuccggcgugagcugggucaugaagaucggcaucggggugcugcugaccuggaucggccucaacuccaagaacaccagcauguccuucagcugcaucgccaucgggaucaucacccuguaccugggcgccgugguccaggccgacauggggugcgugaucaacuggaagggcaaggagcucaagugcggcuccgggaucuucgugacgaacgagguccacaccuggaccgagcaguacaaguuccaggcggacagccccaagcgccuggccaccgccaucgccggcgccugggagaacggggugugcggcauccgcuccacgacccggauggagaaccugcucuggaagcagaucgcgaacgagcugaacuacauccugugggagaacaacaucaagcucaccguggucgugggggacaucaucggcgugcuggagcagggcaagcgcacccugacgccccagccgauggagcucaaguacagcuggaagaccugggggaaggccaagaucgucaccgccgagacccagaacuccagcuucaucaucgacggccccaacacgcccgagugccccuccgccagccgggcguggaacgugugggagguggaggacuacggguucggcgucuucaccaccaacaucuggcugaagcugcgcgagguguacacccagcucugcgaccaccggcugauguccgccgccgugaaggacgagcgcgccguccacgccgacaugggcuacuggaucgagagccagaagaacgggagcuggaagcuggagaaggcgucccucaucgaggugaagaccugcacguggcccaagagccacacccugugguccaacggcgugcuggagagcgacaugaucauccccaagucccucgccgggcccaucagccagcacaacuaccggccgggcuaccacacccagaccgccgggcccuggcaccugggcaagcuggagcucgacuucaacuacugcgagggcacgaccgucgugaucaccgagaacugcgggacccgcggccccucccugcggacgaccaccgugagcgggaagcugauccacgaguggugcugccgcuccugcacccugccgccccugcgguacaugggcgaggacgggugcugguacggcauggagauccgccccaucagcgagaaggaggagaacauggucaagucccuggugagcgccggcuccgggaagguggacaacuucacgaugggcguccucugccuggccauccuguucgaggaggugaugcgggggaaguucggcaagaagcacaugaucgcggggguguucuucaccuucguccuccugcugagcggccagaucaccuggcgcgacauggcccacacccucaucaugaucggcuccaacgccagcgaccggauggggaugggcgugacguaccuggcccugaucgccaccuucaagauccagcccuuccucgcgcugggguucuuccugcgcaagcucaccucccgggagaaccugcugcucggcgugggccuggccauggccaccacgcugcagcuccccgaggacaucgagcagauggccaacgggaucgcgcugggccugauggcccucaagcugaucacccaguucgagaccuaccagcuguggaccgcccucaucagccugacgugcagcaacaccaucuucacccugaccgucgccuggcgcacggccacccucauccuggcgggggugucccugcucccggucugccagagcuccagcaugcggaagaccgacuggcugcccaugaccguggccgccaugggcgugccgccccucccccuguucaucuucucccugaaggacacgcugaagcgccgcagcuggccccucaacgagggggucauggccgugggccugguguccauccuggccagcucccuccugcggaacgacguccccauggcgggcccccugguggccgggggccuccugaucgccugcuacgugaucaccgggaccagcgccgaccugaccgucgagaaggccgcggacgugacgugggaggaggaggccgagcagaccggcgugucccacaaccucaugaucaccgucgacgacgacgggaccaugcgcaucaaggacgacgagaccgagaacauccugacggugcugcucaagaccgcccugcugaucgugagcggcaucuucccguacuccauccccgccacccuccuggucuggcacaccuggcagaagcagacgcagcggagcggcgugcugugggacgugcccagcccgcccgagacccagaaggccgagcucgaggagggggucuaccgcaucaagcagcagggcaucuucgggaagacccaggugggcguggggguccagaaggagggcguguuccacaccauguggcacgugacgcggggcgcgguccugaccuacaacgggaagcgccuggagcccaacugggccagcgugaagaaggaccucaucuccuacggcgggggcuggcggcugagcgcccaguggcagaagggggaggaggugcaggucaucgccguggagcccggcaagaaccccaagaacuuccagaccaugccgggcaccuuccagacgaccaccggggagaucggcgcgaucgcccuggacuucaagcccgggaccuccggcagccccaucaucaaccgcgagggcaagguggucgggcuguacggcaacgggguggugacgaagaacggcggguacgucagcggcaucgcccagaccaacgccgagccggacggccccacccccgagcucgaggaggagauguucaagaagcggaaccugaccaucauggaccugcaccccggguccggcaagacgcgcaaguaccucccggccaucgugcgggaggcgaucaagcgccggcugcgcacccugauccucgcccccacccggguggucgccgccgagauggaggaggcccugaaggggcugcccauccgcuaccagaccacggcgaccaagagcgagcacaccggccgggagaucguggaccucaugugccacgccaccuucacgaugcgccugcugucccccgugcgggucccgaacuacaaccucaucaucauggacgaggcccacuucaccgaccccgccagcaucgccgcgcgcggguacaucuccacccgggugggcaugggcgaggccgccgccaucuucaugaccgcgacgccgcccgggaccgccgacgccuucccgcagagcaacgcccccauccaggacgaggagcgcgacauccccgagcgcuccuggaacagcggcaacgaguggaucaccgacuucgccgggaagaccgugugguucguccccuccaucaaggcgggcaacgacaucgccaacugccugcggaagaacgggaagaaggugauccagcugagccgcaagacguucgacaccgaguaccagaagaccaagcucaacgacugggacuucguggucaccacggacaucuccgagaugggcgccaacuucaaggccgaccgggugaucgacccgcgccggugccugaagcccgugauccugaccgacggccccgagcgcgucauccucgccgggcccaugccggugaccgcggccagcgccgcccagcggcgcggccggguggggcgcaacccccagaaggagaacgaccaguacaucuucaccggccagccccugaacaacgacgaggaccacgcccacuggaccgaggcgaagaugcugcucgacaacaucaacacgcccgaggggaucaucccggcccuguucgagcccgagcgggagaaguccgccgccaucgacggcgaguaccgccugaagggcgagagccggaagaccuucgucgagcucaugcgccgcggggaccugcccguguggcuggcgcacaaggucgccuccgagggcaucaaguacaccgaccgcaaguggugcuucgacgggcagcggaacaaccagauccucgaggagaacauggacguggagaucuggaccaaggagggcgagaagaagaagcugcgcccccgguggcuggacgcccgcacguacagcgacccgcucgcccugaaggaguucaaggacuucgccgcgggccgcaaguccaucgcccuggaccucgugaccgagaucgggcggguccccagccaccuggcccaccgcacccggaacgcccuggacaaccucgugaugcugcacaccuccgagcacggcgggaaggccuaccgccacgcgguggaggagcugcccgagacgauggagacccuccugcugcucggccugaugauccugcucaccgggggcgccaugcuguuccugaucagcggcaaggggaucggcaagaccagcaucgggcucaucugcgucaucgccuccagcggcaugcuguggauggccgagaucccgcugcaguggaucgccuccgcgaucgugcucgaguucuucaugauggugcugcugauccccgagcccgagaagcagcggacgccccaggacaaccagcucgccuacgucgugaucgggauccugacccuggccgccaucaucgccgcgaacgagaugggccuccuggagaccaccaagcgcgaccugggcaugagcaaggagccggggguggucucccccacgagcuaccucgacguggaccugcaccccgccuccgccuggacccuguacgccguggcgaccaccgucaucacgcccaugcuccggcacaccaucgagaacagcaccgccaacgugucccuggccgccaucgccaaccaggcggugguccugaugggccucgacaagggguggccgaucagcaagauggaccugggcgugccccugcucgcccuggggugcuacucccaggugaacccccugacccucacggccgccguccugcugcucaucacccacuacgccaucaucggccccggccugcaggcgaaggccacccgcgaggcccagaagcggaccgccgccgggaucaugaagaacccgacgguggacggcaucaugaccaucgaccuggaccccgugaucuacgacagcaaguucgagaagcagcucgggcaggucaugcugcuggugcucugcgcggugcagcugcugcucaugcgcaccuccugggcccugugcgaggcccugacccucgccacgggccccaucaccacccugugggagggcagccccgggaaguucuggaacaccacgaucgcggucuccauggccaacaucuuccggggcagcuaccuggccggggccggccucgccuucuccaucaugaaguccguggggaccggcaagcgcggcaccgggucccagggcgagacccugggggagaaguggaagaagaagcugaaccagcucagccggaaggaguucgaccuguacaagaaguccggcaucaccgagguggaccgcacggaggcgaaggaggggcugaagcggggcgagaucacccaccacgccgucucccgcggcagcgccaagcuccagugguucguggagcggaacauggugaucccggaggggcgcgucaucgaccugggcugcgggcggggcgggugguccuacuacugcgccggccugaagaaggugaccgaggugcgcggcuacaccaagggcgggcccgggcacgaggagcccguccccaugagcacguacggcuggaacaucgugaagcucauguccgggaaggacguguucuaccugccgcccgagaagugcgacacccugcugugcgacaucggcgagagcucccccagccccaccgucgaggagucccggaccauccgcgugcucaagaugguggagccguggcugaagaacaaccaguucugcaucaagguccugaaccccuacaugcccacggugaucgagcaccucgagcgccugcagcggaagcacggcgggaugcuggugcgcaacccccucagccggaacuccacccacgagauguacuggaucagcaacggcaccgggaacaucgucgccuccgugaacauggugagccgccugcugcucaaccgguucaccaugacgcaccgccggccgaccaucgagaaggacgucgaccugggcgcgggcacccgccacgugaacgccgagcccgagacccccaacauggacgugaucggggagcggaucaagcgcaucaaggaggagcacaacuccacguggcacuacgacgacgagaacccguacaagaccugggccuaccacggcagcuacgaggucaaggccaccggguccgccagcuccaugaucaacggcguggucaagcugcucaccaagcccugggacguggugcccauggucacgcagauggcgaugaccgacaccacccccuucgggcagcagcggguguucaaggagaagguggacacgcgcaccccgcggagcaugcccggcacccgccgggucaugggcaucaccgccgaguggcuguggcgcacgcuggggcggaacaagaagccccgccucugcacccgggaggaguucaccaagaaggugcgcaccaacgccgccaugggcgcgguguucacggaggagaaccagugggacagcgccaaggccgccgucgaggacgaggacuucuggaagcugguggaccgcgagcgggagcugcacaagcucgggaagugcggcuccugcguguacaacaugauggggaagcgcgagaagaagcugggcgaguucggcaaggccaaggggagccgggcgaucugguacauguggcugggcgcccgcuaccucgaguucgaggcccugggguuccugaacgaggaccacugguucucccgggagaacagcuacuccggcgucgagggggagggccuccacaagcugggcuacauccugcgcgacaucagcaagauccccgggggcgccauguacgccgacgacaccgcggggugggacacccggaucaccgaggacgaccuccacaacgaggagaagaucacgcagcagauggacccggagcaccgccagcuggccaacgccaucuucaagcugaccuaccagaacaagguggugaagguccagcggcccacccccaccggcaccgugauggacaucaucucccgcaaggaccagcggggcagcggccaggugggcacguacgggcucaacaccuucaccaacauggaggcccagcugauccgccagauggagggcgaggggguccuguccaaggccgaccucgagaacccccaccucccggagaagaagaucacccaguggcuggagacgaagggcguggagcggcucaagcgcauggcgaucagcggcgacgacugcguggucaagcccaucgacgaccgguucgccaacgcccugcuggcccucaacgacauggggaaggugcgcaaggacaucccccaguggcagcccuccaagggcuggcacgacuggcagcaggucccguucugcagccaccacuuccacgagcugaucaugaaggacgggcggaagcuggucgugcccugccgcccccaggacgagcucaucggccgggcccgcaucucccagggggcgggcuggagccugcgggagaccgccugccugggcaaggccuacgcccagauguggucccucauguacuuccaccgccgcgaccugcggcuggcgagcaacgccaucugcuccgccgugcccguccacugggugccgaccagccgcaccacgugguccauccacgcccaccaccaguggaugaccaccgaggacaugcucaccguguggaaccgggucuggaucgaggacaaccccuggauggaggacaagacgcccgugaccaccugggagaacgugcccuaccuggggaagcgcgaggaccaguggugcggcagccugaucgggcucaccagccgggccacgugggcgcagaacaucccgaccgccauccagcagguccgcucccugaucggcaacgaggaguuccuggacuacaugcccagcaugaagcgguuccgcaaggaggaggaguccgagggggccaucugguga

SEQ ID NO: 10184 - RNA, 9873 nt, Artificial Sequence
  derived and/or modified CDS sequence (opt1) from DENV-3__FJ562107__SS-prME
accagccugugccucaugaugauccugcccgcggcgcuggcguuccaccucaccagccgggacggcgagccccggaugaucguggggaagaacgagcgcggcaagagccugcuguucaagacggccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgugaucgggaucaucacccucuaccugggcgccgucgugcaggccgacauggggugcgugaucaacuggaagggcaaggagcugaagugcggcagcgggaucuucgucacgaacgaggugcacaccuggaccgagcaguacaaguuccaggccgacucccccaagcgccucgcgaccgccaucgccggcgccugggagaacggggugugcggcauccgcagcacgacccggauggagaaccugcuguggaagcagaucgccaacgagcucaacuacauccugugggagaacaacaucaagcugaccgucguggugggggacaucaucggcguccucgagcagggcaagcgcacccugacgccccagccgauggagcugaaguacuccuggaagaccugggggaaggcgaagaucgugaccgccgagacccagaacagcuccuucaucaucgacggccccaacacgcccgagugccccagcgccucccgggccuggaacgugugggaggucgaggacuacggguucggcguguucaccaccaacaucuggcucaagcugcgcgagguguacacccagcugugcgaccaccggcucaugagcgcggccgucaaggacgagcgcgccgugcacgccgacaugggcuacuggaucgagagccagaagaacggguccuggaagcuggagaaggccagccugaucgaggugaagaccugcacguggccgaagucccacacccucuggagcaacggcguccuggaguccgacaugaucauccccaagagccuggcggggcccaucucccagcacaacuaccggccgggcuaccacacccagaccgccgggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaaggucgacaacuucacgaugggcgugcugugccucgccauccuguucgaggaggugaugcgggggaaguucggcaagaagcacaugaucgccggggucuucuucaccuucgugcugcuccuguccggccagaucaccuggcgcgacauggcgcacacccugaucaugaucggcagcaacgccuccgaccggauggggaugggcgugacguaccucgcccugaucgccaccuucaagauccagcccuuccuggcccucggguucuuccugcgcaagcugaccagccgggagaaccuccugcugggcgucggccucgcgauggccaccacgcugcagcugcccgaggacaucgagcagauggccaacgggaucgcccucggccugauggcgcugaagcucaucacccaguucgagaccuaccagcuguggaccgcccugaucagccucacgugcuccaacaccaucuucacccugaccguggccuggcgcacggccacccugauccucgccggggucagccugcugccggugugccaguccagcuccaugcggaagaccgacuggcuccccaugaccguggcggccaugggcgugccgccccucccgcuguucaucuucagccucaaggacacgcugaagcgccgcuccuggccccugaacgagggggugauggccgugggccucgucagcauccuggccuccagccugcuccggaacgacgugcccauggccggcccccugguggccggcgggcugcucaucgccugcuacgucaucaccgggaccuccgccgaccugaccguggagaaggccgccgacgugacgugggaggaggaggcggagcagaccggggucagccacaaccugaugaucaccguggacgacgacgggaccaugcgcaucaaggacgacgagaccgagaacauccucacggugcugcugaagaccgcccuccugaucgucuccggcaucuucccguacagcauccccgccacccugcucguguggcacaccuggcagaagcagacgcagcgguccggcgugcugugggacguccccagcccgcccgagacccagaaggccgagcuggaggaggggguguaccgcaucaagcagcagggcaucuucgggaagacccaggugggcgucggggugcagaaggagggcguguuccacaccauguggcacgucacgcggggcgccgugcucaccuacaacgggaagcgccuggagcccaacugggcguccgugaagaaggaccugaucagcuacggcgggggcuggcggcucuccgcccaguggcagaagggggaggagguccaggugaucgccguggagcccggcaagaaccccaagaacuuccagaccaugcccggcaccuuccagacgaccaccggggagaucggcgccaucgcgcuggacuucaagcccgggaccagcggcagccccaucaucaaccgcgagggcaaggucguggggcuguacggcaacgggguggucacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggccaucaagcgccggcuccgcacccugauccuggcgcccacccgggucguggccgccgagauggaggaggcccucaaggggcugcccauccgcuaccagaccacggccaccaaguccgagcacaccggccgggagaucguggaccugaugugccacgcgaccuucacgaugcgccuccugagccccguccgggugccgaacuacaaccugaucaucauggacgaggcccacuucaccgaccccgccuccaucgccgcccgcggguacaucagcacccgggugggcaugggcgaggcggccgccaucuucaugaccgccacgccgcccgggaccgcggacgccuucccgcaguccaacgcccccauccaggacgaggagcgcgacauccccgagcgcagcuggaacuccggcaacgaguggaucaccgacuucgccgggaagaccgucugguucgugcccagcaucaaggccggcaacgacaucgcgaacugccuccggaagaacgggaagaaggugauccagcugucccgcaagacguucgacaccgaguaccagaagaccaagcugaacgacugggacuucgucgugaccacggacaucagcgagaugggcgccaacuucaaggccgaccgggugaucgacccgcgccggugccucaagcccgucauccugaccgacggccccgagcgcgugauccuggccgggcccaugccggugaccgccgcguccgccgcccagcggcgcggccgggucgggcgcaacccccagaaggagaacgaccaguacaucuucaccggccagccccucaacaacgacgaggaccacgcccacuggaccgaggccaagaugcugcuggacaacaucaacacgcccgaggggaucaucccggcccucuucgagcccgagcgggagaaguccgccgccaucgacggcgaguaccgccugaagggcgagucccggaagaccuucguggagcugaugcgccgcggggaccuccccgucuggcuggccuacaagguggcgagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgccggccgcaagagcaucgcgcuggaccuggucaccgagaucgggcgggugcccucccaccucgcccaccgcacccggaacgcccuggacaaccuggugaugcuccacaccagcgagcacggcgggaaggccuaccgccacgccgucgaggagcugcccgagacgauggagacccugcuccugcugggccucaugauccugcugaccgggggcgcgaugcuguuccugaucagcggcaaggggaucggcaagaccuccaucgggcugaucugcgugaucgccagcuccggcaugcucuggauggccgagaucccgcugcaguggaucgccagcgccaucgugcuggaguucuucaugaugguccuccugauccccgagcccgagaagcagcggacgccccaggacaaccagcuggcguacguggugaucgggauccucacccuggccgccaucaucgccgccaacgagaugggccugcucgagaccaccaagcgcgaccugggcauguccaaggagccgggggucgugagccccacguccuaccuggacguggaccuccaccccgcgagcgccuggacccuguacgccgucgccaccaccgugaucacgcccaugcugcggcacaccaucgagaacuccaccgcgaacgugagccucgccgccaucgccaaccaggccgucgugcugaugggccuggacaagggguggccgaucuccaagauggaccucggcgugccccugcuggcgcucgggugcuacagccaggucaacccccugacccugacggccgccgugcuccugcugaucacccacuacgccaucaucggccccggccuccaggccaaggcgacccgcgaggcccagaagcggaccgccgccgggaucaugaagaacccgacgguggacggcaucaugaccaucgaccuggaccccgucaucuacgacuccaaguucgagaagcagcugggccaggugaugcuccuggugcugugcgccguccagcuccugcugaugcgcaccagcugggcgcucugcgaggcccugacccuggccacgggccccaucaccacccucugggagggcucccccgggaaguucuggaacaccacgaucgccgugagcauggcgaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggaguucgaccucuacaagaaguccggcaucaccgaggucgaccgcacggaggccaaggaggggcugaagcggggcgagaucacccaccacgcggugagccgcggcuccgccaagcugcagugguucguggagcggaacauggucaucccggaggggcgcgugaucgaccucggcugcgggcggggcggguggagcuacuacugcgccggccugaagaaggugaccgagguccgcggcuacaccaagggcgggcccgggcacgaggagcccgugcccauguccacguacggcuggaacaucgugaagcugaugagcgggaaggacgucuucuaccucccgcccgagaagugcgacacccugcugugcgacaucggcgaguccagccccucccccaccguggaggagagccggaccauccgcgugcugaagauggucgagccguggcucaagaacaaccaguucugcaucaaggugcugaaccccuacaugcccacggugaucgagcaccuggagcgccuccagcggaagcacggcgggaugcugguccgcaacccccugucccggaacagcacccacgagauguacuggaucuccaacggcaccgggaacaucguggccagcgugaacauggucucccgccuccugcugaaccgguucaccaugacgcaccgccggccgaccaucgagaaggacguggaccucggcgccggcacccgccacgugaacgcggagcccgagacccccaacauggacgucaucggggagcggaucaagcgcaucaaggaggagcacaacagcacguggcacuacgacgacgagaacccguacaagaccugggccuaccacggcuccuacgaggugaaggccaccgggagcgccuccagcaugaucaacggcgucgugaagcugcugaccaagcccugggacgugguccccauggugacgcagauggccaugaccgacaccacccccuucgggcagcagcggguguucaaggagaaggucgacacgcgcaccccgcggagcaugcccggcacccgccgggugaugggcaucaccgcggaguggcucuggcgcacgcuggggcggaacaagaagccccgccugugcacccgggaggaguucaccaagaaggugcgcaccaacgccgccaugggcgccgucuucacggaggagaaccagugggacuccgcgaaggccgccguggaggacgaggacuucuggauccucguggaccgcgagcgggagcugcacaagcuggggaagugcggcagcugcgucuacaacaugauggggaagcgcgagaagaagcucggcgaguucggcaaggccaaggggucccgggccaucugguacauguggcugggcgcgcgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgccgacgacaccgccgggugggacacccggaucaccgaggacgaccugcacaacgaggagaagaucacgcagcagauggacccggagcaccgccagcucgcgaacgccaucuucaagcugaccuaccagaacaagguggucaaggugcagcggcccacccccaccggcaccgugauggacaucaucagccgcaaggaccagcggggcuccgggcaggucggcacguacgggcugaacaccuucaccaacauggaggcccagcucauccgccagauggagggcgagggggugcugagcaaggccgaccuggagaacccccaccucccggagaagaagaucacccaguggcuggagacgaagggcguggagcggcugaagcgcauggccaucuccggcgacgacugcgucgugaagcccaucgacgaccgguucgcgaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcugguggugcccugccgcccccaggacgagcugaucggccgggcccgcaucagccagggggccggcuggucccuccgggagaccgcgugccugggcaaggccuacgcccagauguggagccugauguacuuccaccgccgcgaccuccggcuggccuccaacgcgaucugcagcgccguccccgugcacugggugccgaccucccgcaccacguggagcauccacgcccaccaccaguggaugaccaccgaggacaugcugaccgucuggaaccggguguggaucgaggacaaccccuggauggaggacaagacgcccgugaccaccugggagaacguccccuaccucgggaagcgcgaggaccaguggugcggcagccugaucgggcugaccucccgggccacgugggcccagaacaucccgaccgcgauccagcagguccgcagccucaucggcaacgaggaguuccuggacuacaugcccuccaugaagcgguuccgcaaggaggaggagagcgagggggccaucugguga

SEQ ID NO: 10185 - RNA, 9873 nt, Artificial Sequence
  derived and/or modified CDS sequence (opt1) from DENV-3__FJ547071__SS-prME
accagccugugccucaugaugauccugcccgcggcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaagacggccgacgugaccugggaggaggaggcggagcagaccggcgugagccacaaccugaugaucaccgucgacgacgacgggaccaugcgcaucaaggacgacgagacggagaacauccucaccgugcugcugaagaccgcccuccugaucguguccggcaucuucccguacagcauccccgccacccugcucgucuggcacacguggcagaagcagacccagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacacgauguggcacgugacccggggcgccguccucaccuacaacgggaagcgccuggagcccaacugggcguccgugaagaaggaccugaucagcuacggcgggggcuggcggcucuccgcccaguggcagaagggggaggaggugcaggucaucgccguggagcccggcaagaaccccaagaacuuccagaccaugcccggcacguuccagaccaccaccggggagaucggcgccaucgcgcuggacuucaagcccgggacgagcggcagccccaucaucaaccgcgagggcaagguggucgggcuguacggcaacgggguggugaccaagaacggcggguacgucuccggcaucgcccagaccaacgccgagccggacggccccacccccgagcuggaggaggagauguucaagaagcggaaccucacgaucauggaccugcaccccgggagcggcaagacccgcaaguaccugccggccaucgugcgggaggccaucaagcgccggcuccgcacccugauccuggcgcccacccggguggucgccgccgagauggaggaggcccucaaggggcugcccauccgcuaccagacgaccgccaccaaguccgagcacaccggccgggagaucguggaccugaugugccacgcgacguucaccaugcgccuccugagccccgugcgggucccgaacuacaaccugaucaucauggacgaggcccacuucaccgaccccgccuccaucgccgcccgcggguacaucagcacccgggugggcaugggcgaggcggccgccaucuucaugacggccacgccgcccgggaccgcggacgccuucccgcaguccaacgcccccauccaggacgaggagcgcgacauccccgagcgcagcuggaacuccggcaacgaguggaucaccgacuucgccgggaagacggugugguucguccccagcaucaaggccggcaacgacaucgcgaacugccuccggaagaacgggaagaaggugauccagcugucccgcaagaccuucgacaccgaguaccagaagaccaagcugaacgacugggacuucguggucacgaccgacaucagcgagaugggcgccaacuucaaggccgaccgggugaucgacccgcgccggugccucaagcccgugauccugaccgacggccccgagcgcgucauccuggccgggcccaugccggugaccgccgcguccgccgcccagcggcgcggccggguggggcgcaacccccagaaggagaacgaccaguacaucuucaccggccagccccucaacaacgacgaggaccacgcccacuggacggaggccaagaugcugcuggacaacaucaacacccccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcccacaaggucgcgagcgagggcaucaaguacaccgaccgcaaguggugcuucgacgggcagcggaacaaccagauccuggaggagaacauggacguggagaucuggacgaaggagggcgagaagaagaagcuccgcccccgguggcuggacgcccgcaccuacuccgacccgcuggcccucaaggaguucaaggacuucgccgccggccgcaagagcaucgcgcuggaccuggugaccgagaucgggcggguccccucccaccucgcccaccgcacccggaacgcccuggacaaccuggugaugcuccacacgagcgagcacggcgggaaggccuaccgccacgccguggaggagcugcccgagaccauggagacccugcuccugcugggccucaugauccugcugaccgggggcgcgaugcuguuccugaucagcggcaaggggaucggcaagacguccaucgggcugaucugcgucaucgccagcuccggcaugcucuggauggccgagaucccgcugcaguggaucgccagcgccaucgugcuggaguucuucaugauggugcuccugauccccgagcccgagaagcagcggacgccccaggacaaccagcuggcguacgucgugaucgggauccucacccuggccgccaucaucgccgccaacgagaugggccugcucgagaccacgaagcgcgaccugggcauguccaaggagccggggguggucagccccaccuccuaccuggacguggaccuccaccccgcgagcgccuggacccuguacgccguggccaccacggucaucacccccaugcugcggcacaccaucgagaacuccaccgcgaacgugagccucgccgccaucgccaaccaggccgugguccugaugggccuggacaagggguggccgaucuccaagauggaccucggcgugccccugcuggcgcucgggugcuacagccaggugaacccccugacgcugaccgccgccguccuccugcugaucacccacuacgccaucaucggccccggccuccaggccaaggcgacccgcgaggcccagaagcggacggccgccgggaucaugaagaacccgaccguggacggcaucaugaccaucgaccuggaccccgugaucuacgacuccaaguucgagaagcagcuggggcaggucaugcuccugauccugugcgccgugcagcuccugcugaugcgcaccagcugggcgcucugcgaggcccugacgcuggccaccggccccaucaccacccucugggagggcucccccgggaaguucuggaacacgaccaucgccgugagcauggcgaacaucuuccggggcuccuaccuggccggggccggccuggccuucagcaucaugaaguccgucgggaccggcaagcgcggcaccgggagccagggcgagacccucggggagaaguggaagaagaagcugaaccagcugagccggaaggaguucgaccucuacaagaaguccggcaucacggagguggaccgcaccgaggccaaggaggggcugaagcggggcgagaucacccaccacgcggugagccgcggcuccgccaagcugcagugguucgucgagcggaacauggugaucccggaggggcgcgugaucgaccucggcugcgggcggggcggguggagcuacuacugcgccggccugaagaaggucaccgaggugcgcggcuacacgaagggcgggcccgggcacgaggagcccgugcccauguccaccuacggcuggaacaucgucaagcugaugagcgggaaggacguguucuaccucccgcccgagaagugcgacacccugcugugcgacaucggcgaguccagccccucccccaccguggaggagagccggacgauccgcguccugaagaugguggagccguggcucaagaacaaccaguucugcaucaaggugcugaaccccuacaugcccaccgucaucgagcaccuggagcgccuccagcggaagcacggcgggaugcuggugcgcaacccccugucccggaacagcacccacgagauguacuggaucuccaacggcaccgggaacaucguggccagcgucaacauggugucccgccuccugcugaaccgguucacgaugacccaccgccggccgaccaucgagaaggacguggaccucggcgccggcacccgccacgucaacgcggagcccgagacgcccaacauggacgugaucggggagcggaucaagcgcaucaaggaggagcacaacagcaccuggcacuacgacgacgagaacccguacaagaccugggccuaccacggcuccuacgaggugaaggccaccgggagcgccuccagcaugaucaacggcgucgugaagcugcugacgaagcccugggacgucgugcccauggugacccagauggccaugaccgacaccacgcccuucgggcagcagcgggucuucaaggagaagguggacacccgcaccccgcggagcaugcccggcacccgccgggugaugggcaucacggcggaguggcucuggcgcacccuggggcggaacaagaagccccgccugugcacccgggaggaguucaccaagaagguccgcacgaacgccgccaugggcgccguguucaccgaggagaaccagugggacuccgcgaaggccgccguggaggacgaggacuucuggaagcucgucgaccgcgagcgggagcugcacaagcuggggaagugcggcagcugcguguacaacaugauggggaagcgcgagaagaagcucggcgaguucggcaaggccaaggggucccgggccaucugguacauguggcugggcgcgcgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgccgacgacaccgccgggugggacacccggaucacggaggacgaccugcacaacgaggagaagaucacccagcagauggacccggagcaccgccagcucgcgaacgccaucuucaagcugaccuaccagaacaaggucgugaaggugcagcggcccacccccaccggcacggucauggacaucaucagccgcaaggaccagcggggcuccggccaggugggcaccuacgggcugaacaccuucaccaacauggaggcccagcucauccgccagauggagggcgagggggugcugagcaaggccgaccuggagaacccccaccucccggagaagaagaucacgcaguggcuggagaccaagggcgucgagcggcugaagcgcauggccaucuccggcgacgacugcguggugaagcccaucgacgaccgguucgcgaacgcccuccuggcccugaacgacauggggaagguccgcaaggacaucccccaguggcagcccagcaagggcuggcacgacuggcagcaggucccguucugcucccaccacuuccacgagcucaucaugaaggacgggcggaagcuggugguccccugccgcccccaggacgagcugaucggccgggcccgcaucagccagggggccggcuggucccuccgggagaccgcgugccugggcaaggccuacgcccagauguggagccugauguacuuccaccgccgcgaccuccggcuggccuccaacgcgaucugcagcgccgugcccgugcacugggucccgaccucccgcacgaccuggagcauccacgcccaccaccaguggaugaccaccgaggacaugcugacgguguggaaccggguguggaucgaggacaaccccuggauggaggacaagacccccgucaccaccugggagaacgugcccuaccucgggaagcgcgaggaccaguggugcggcagccugaucgggcugacgucccgggccaccugggcccagaacaucccgaccgcgauccagcagguccgcagccucaucggcaacgaggaguuccuggacuacaugcccuccaugaagcgguuccgcaaggaggaggagagcgagggggccaucugguga

SEQ ID NO: 10186 - RNA, 9873 nt, Artificial Sequence
  derived and/or modified CDS sequence (opt1) from DENV-3__FJ410176__SS-prME
accagccugugccucaugaugauccugcccgccgcccuggcguuccaccucaccucccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccaccccggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugcccgaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcagcccccgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaccaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagacgugcaccuggccgaagucccacacccucuggagcaacggcgugcuggaguccgacaugaucauccccaagagccuggccgggcccaucucccagcacaacuaccggccgggcuaccacacccagacggccgggcccuggcaccucggcaagcuggagcuggacuucaacuacugcgagggcaccaccgucgugaucaccgagaacugcgggacgcgcggcagcucccuccggaccaccaccgugagcgggaagcugauccacgaguggugcugccgcuccugcacgcugccgccccugcgguacaugggcgaggacgggugcugguacggcauggagauccgcccgaucagcgagaaggaggagaacauggucaagucccuggugagcgccggcuccgggaagguggacaacuucaccaugggcguccugugccucgccauccuguucgaggaggugaugcgggggaaguucggcaagaagcacaugaucgcgggggugcuguucaccuucguccuccugcugagcggccagaucaccuggcgcgacauggcccacacgcucaucaugaucggcuccaacgccagcgaccggauggggaugggcgugaccuaccuggcccugaucgccaccuucaagauccagcccuuccucgcgcugggguucuuccugcgcaagcucaccagccgggagaaccugcugcucggcgugggccuggccauggccacgacccugcagcuccccgaggacaucgagcagauggccaacgggaucgcgcugggccugauggcccucaagcugaccacccaguucgagacguaccagcuguggaccgcccucaucucccugaccugcagcaacaccaucuucacgcugaccgucgccuggcgcaccgccacccucauccuggcgggggugucccugcuccccgucugccagagcuccagcaugcggaagacggacuggcugccgaugaccguggccgccaugggcgugccgccccugccccucuucaucuucucccugaaggacacccugaagcgccgcagcuggccgcucaacgagggggucauggccgugggccugguguccauccuggccagcucccuccugcggaacgacguccccauggcgggcccccugguggccgggggccuccugaucgccugcuacgugaucaccgggacgagcgccgaccugaccgucgagaaggccgcggacgugaccugggaggaggaggccgagcagaccggcgugucccacaaccucaugaucaccgucgacgacgacgggacgaugcgcaucaaggacgacgagaccgagaacauccugaccgugcugcucaagaccgcccugcugaucgugagcggcaucuuccccuacuccaucccggccacgcuccuggucuggcacaccuggcagaagcagacccagcggagcggcgugcugugggacgugcccagcccgcccgagacccagaaggccgagcucgaggagggggucuaccgcaucaagcagcagggcaucuucgggaagacccaggugggcguggggguccagaaggagggcguguuccacaccauguggcacgugacccggggcgcgguccugaccuacaacgggaagcgccuggagccgaacugggccagcgugaagaaggaccucaucuccuacggcgggggcuggcggcugagcgcccaguggcagaagggggaggaggugcaggucaucgccguggagcccggcaagaaccccaagaacuuccagacgaugcccggcaccuuccagaccaccacgggggagaucggcgcgaucgcccuggacuucaagccggggaccagcggcucccccaucaucaaccgcgagggcaagguggucgggcuguacggcaacgggguggugaccaagaacggcggguacgucagcggcaucgcccagaccaacgccgagcccgacggcccgacgcccgagcucgaggaggagauguucaagaagcggaaccugaccaucauggaccugcaccccggguccggcaagacccgcaaguaccuccccgccaucgugcgggaggcgaucaagcgccggcugcgcacccugauccucgccccgacgcggguggucgccgccgagauggaggaggcccugaaggggcugcccauccgcuaccagaccaccgcgaccaagagcgagcacacgggccgggagaucguggaccucaugugccacgccaccuucaccaugcgccugcugucccccgugcggguccccaacuacaaccucaucaucauggacgaggcccacuucaccgacccggccagcaucgccgcgcgcggguacaucuccacgcgggugggcaugggcgaggccgccgccaucuucaugaccgcgacgccgcccgggaccgccgacgccuucccccagagcaacgccccgauccaggacgaggagcgcgacauccccgagcgcuccuggaacagcggcaacgaguggaucacggacuucgccgggaagaccgugugguucguccccuccaucaaggcgggcaacgacaucgccaacugccugcggaagaacgggaagaaggugauccagcugagccgcaagaccuucgacaccgaguaccagaagacgaagcucaacgacugggacuucguggucaccaccgacaucuccgagaugggcgccaacuucaaggccgaccgggugaucgacccccgccggugccugaagccggugauccugaccgacggccccgagcgcgucauccucgccgggcccaugcccgugaccgcggccagcgccgcccagcggcgcggccggguggggcgcaacccgcagaaggagaacgaccaguacaucuucacgggccagccccugaacaacgacgaggaccacgcccacuggaccgaggcgaagaugcugcucgacaacaucaacacccccgaggggaucauccccgcccuguucgagccggagcgggagaaguccgccgccaucgacggcgaguaccgccugaagggcgagagccggaagaccuucgucgagcucaugcgccgcggggaccugcccguguggcuggcgcacaaggucgccuccgagggcaucaaguacacggaccgcaaguggugcuucgacgggcagcggaacaaccagauccucgaggagaacauggacguggagaucuggaccaaggagggcgagaagaagaagcugcgcccccgguggcuggacgcccgcaccuacagcgacccccucgcccugaaggaguucaaggacuucgccgcgggccgcaaguccaucgcccuggaccucgugaccgagaucgggcgggucccgagccaccuggcccaccgcacgcggaacgcccuggacaaccucgugaugcugcacaccagcgagcacggcgggaaggccuaccgccacgcgguggaggagcugcccgagaccauggagacccuccugcugcucggccugaugauccugcucaccggcggggccaugcuguuccugaucuccgggaaggggaucggcaagaccagcaucgggcucaucugcgucaucgccuccagcggcaugcuguggauggccgagaucccccugcaguggaucgccuccgcgaucgugcucgaguucuucaugauggugcugcugaucccggagcccgagaagcagcggacgccccaggacaaccagcucgccuacgucgugaucgggauccugacccuggccgccaucaucgccgcgaacgagaugggccuccuggagacgaccaagcgcgaccugggcaugagcaaggagcccgggguggucuccccgaccagcuaccucgacguggaccugcaccccgccuccgccuggacccuguacgccguggcgacgaccgucaucacccccaugcuccggcacaccaucgagaacagcacggccaacgugucccuggccgccaucgccaaccaggcggugguccugaugggccucgacaagggguggcccaucagcaagauggaccugggcgugccgcugcucgcccuggggugcuacucccaggugaacccccugacccucaccgccgccguccugcugcucaucacccacuacgccaucaucggccccggccugcaggcgaaggccacgcgcgaggcccagaagcggaccgccgccgggaucaugaagaaccccaccguggacggcaucaugaccaucgaccuggacccggugaucuacgacagcaaguucgagaagcagcucgggcaggucaugcugcuggugcucugcgcggugcagcugcugcucaugcgcacguccugggcccugugcgaggcccugacccucgccaccggccccaucaccacgcugugggagggcagccccgggaaguucuggaacaccaccaucgcggucuccauggccaacaucuuccggggcagcuaccuggccggggccggccucgccuucuccaucaugaaguccguggggaccggcaagcgcggcaccgggagccagggcgagacgcugggggagaaguggaagaagaagcugaaccagcucucccggaaggaguucgaccuguacaagaaguccggcaucaccgagguggaccgcaccgaggcgaaggaggggcugaagcggggcgagaucacccaccacgccgucucccgcggcagcgccaagcuccagugguucguggagcggaacauggugauccccgaggggcgcgucaucgaccugggcugcgggcggggcgggugguccuacuacugcgccggccugaagaaggugacggaggugcgcggcuacaccaagggcgggccggggcacgaggagcccguccccaugagcaccuacggcuggaacaucgugaagcucauguccgggaaggacguguucuaccugcccccggagaagugcgacacccugcugugcgacaucggcgagagcucccccagccccacggucgaggagucccggaccauccgcgugcucaagaugguggagcccuggcugaagaacaaccaguucugcaucaagguccugaacccguacaugcccaccgugaucgagcaccucgagcgccugcagcggaagcacggcgggaugcuggugcgcaacccccucagccggaacuccacccacgagauguacuggaucagcaacggcacggggaacaucgucgccuccgugaacauggugagccgccugcugcucaaccgguucaccaugacccaccgccggcccaccaucgagaaggacgucgaccugggcgcgggcacgcgccacgugaacgccgagccggagacccccaacauggacgugaucggggagcggaucaagcgcaucaaggaggagcacaacuccaccuggcacuacgacgacgagaaccccuacaagaccugggccuaccacggcagcuacgaggucaaggccacgggguccgccagcagcaugaucaacggcguggucaagcugcucaccaagccgugggacguggugcccauggucacccagauggcgaugaccgacacgacccccuucgggcagcagcggguguucaaggagaagguggacacccgcacgccccgguccaugccgggcacgcgccgggucaugggcaucaccgccgaguggcuguggcgcacccuggggcggaacaagaagccccgccucugcacccgggaggaguucacgaagaaggugcgcaccaacgccgccaugggcgcgguguucaccgaggagaaccagugggacagcgccaaggccgccgucgaggacgaggacuucuggaagcugguggaccgcgagcgggagcugcacaagcucgggaagugcggcuccugcguguacaacaugauggggaagcgcgagaagaagcugggcgaguucggcaaggccaaggggagccgggcgaucugguacauguggcugggcgcccgcuaccucgaguucgaggcccugggguuccugaacgaggaccacugguucucccgggagaacagcuacuccggcgucgagggggagggccuccacaagcugggcuacauccugcgcgacaucagcaagauccccgggggcgccauguacgccgacgacaccgcggggugggacacgcggaucaccgaggacgaccuccacaacgaggagaagaucacccagcagauggaccccgagcaccgccagcuggccaacgccaucuucaagcugaccuaccagaacaagguggugaagguccagcggccgacccccacgggcaccgugauggacaucaucucccgcaaggaccagcggggcagcggccaggugggcaccuacgggcucaacaccuucacgaacauggaggcccagcugauccgccagauggagggcgaggggguccuguccaaggccgaccucgagaacccccaccuccccgagaagaagaucacccaguggcuggagaccaagggcguggagcggcucaagcgcauggcgaucagcggcgacgacugcguggucaagccgaucgacgaccgguucgccaacgcccugcuggcccucaacgacauggggaaggugcgcaaggacaucccccaguggcagcccuccaagggcuggcacgacuggcagcagguccccuucugcagccaccacuuccacgagcugaucaugaaggacgggcggaagcuggucgugccgugccgcccccaggacgagcucaucggccgggcccgcaucucccagggggcgggcuggagccugcgggagaccgccugccugggcaaggccuacgcccagauguggucccucauguacuuccaccgccgcgaccugcggcuggcgagcaacgccaucugcuccgccgugcccguccacugggugcccacgagccgcaccaccuggagcauccacgcccaccaccaguggaugaccacggaggacaugcucaccguguggaaccgggucuggaucgaggacaacccguggauggaggacaagacccccgugaccacgugggagaacgugcccuaccuggggaagcgcgaggaccaguggugcggcucccugaucgggcucaccagccgggccaccugggcgcagaacauccccaccgccauccagcagguccgcucccugaucggcaacgaggaguuccuggacuacaugccgagcaugaagcgguuccgcaaggaggaggaguccgagggggccaucugguga

SEQ ID NO: 10187 - RNA, 9873 nt, Artificial Sequence
  derived and/or modified CDS sequence (opt1) from DENV-3__FJ410177__SS-prME
accagccucugccucaugaugauccugcccgccgcccuggcguuccaccucaccagccgggacggcgagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaccaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagacgugcaccuggccgaagucccacacccucuggagcaacggcgugcuggaguccgacaugaucauccccaagagccuggccgggcccaucucccagcacaacuaccggccgggcuaccacacccagacggccgggcccuggcaccucggcaagcuggagcuggacuucaacuacugcgagggcaccaccgucgugaucaccgagaacugcgggacgggcgggcccagccuccgcaccaccaccguguccggcaagcugauccacgaguggugcugccggagcugcacgcugcccccgcuccgcuacaugggggaggacggcugcugguacggcauggagauccggcccaucuccgagaaggaggagaacauggucaagagccugguguccgccgggagcggcaagguggacaacuucaccauggggguccugugccucgccauccuguucgaggaggugaugcgcggcaaguucgggaagaagcacaugaucgcgggcguguucuucaccuucguccugcuccuguccggccagaucaccuggcgggacauggcccacacgcugaucaugaucgggagcaacgccuccgaccgcaugggcaugggggugaccuaccucgcccugaucgccaccuucaagauccagcccuuccuggcgcucggcuucuuccugcggaagcugaccagccgcgagaaccuccugcugggcguggggcucgccauggccacgacccugcagcugcccgaggacaucgagcagauggccaacggcaucgcgcucgggcugauggcccugaagcucaccacccaguucgagacguaccagcuguggaccgcccugaucagccugaccugcuccaacaccaucuucacgcugaccgucgccuggcggaccgccacccugauccucgcgggcgugagccugcugccggucugccaguccagcuccaugcgcaagacggacuggcuccccaugaccguggccgccaugggggugccgccccucccgcuguucaucuucagccucaaggacacccugaagcggcgcuccuggccccugaacgagggcgucauggccgugggccucgugagcauccuggccuccagccugcuccgcaacgacguccccauggcggggccccugguggccggcgggcugcucaucgccugcuacgugaucaccggcacguccgccgaccugaccgucgagaaggccgcggacgugaccugggaggaggaggccgagcagaccggggugagccacaaccugaugaucaccgucgacgacgacggcacgaugcggaucaaggacgacgagaccgagaacauccucaccgugcugcugaagaccgcccuccugaucguguccggcaucuucccguacagcauccccgccacgcugcucgucuggcacaccuggcagaagcagacccagcgcuccggggugcugugggacgugcccagcccgcccgagacccagaaggccgagcuggaggagggcgucuaccggaucaagcagcaggggaucuucggcaagacccaggugggggugggcguccagaaggagggcguguuccacaccauguggcacgugacccgcggggcgguccucaccuacaacggcaagcggcuggagcccaacugggccuccgugaagaaggaccugaucagcuacgggggcggguggcgccucuccgcccaguggcagaagggcgaggaggugcaggucaucgccguggagcccggcaagaaccccaagaacuuccagacgaugcccgggaccuuccagaccaccacgggcgagaucggggcgaucgcccuggacuucaagcccggcaccagcggcagccccaucaucaaccgggaggggaagguggucggccuguacgggaacggcguggugaccaagaacgggggcuacgucuccggcaucgcccagaccaacgccgagccggacgggcccacgcccgagcuggaggaggagauguucaagaagcgcaaccucaccaucauggaccugcaccccggcagcgggaagacccggaaguaccugccggccaucgugcgcgaggcgaucaagcggcgccuccggacccugauccuggcccccacgcgcguggucgccgccgagauggaggaggcccucaagggccugcccauccgguaccagaccaccgcgaccaaguccgagcacacggggcgcgagaucguggaccugaugugccacgccaccuucaccaugcggcuccugagccccgugcgcgucccgaacuacaaccugaucaucauggacgaggcccacuucaccgaccccgccuccaucgccgcgcggggcuacaucagcacgcgcgugggcaugggggaggccgccgccaucuucaugaccgcgacgccgcccggcaccgccgacgccuucccgcaguccaacgcccccauccaggacgaggagcgggacauccccgagcgcagcuggaacuccgggaacgaguggaucacggacuucgccggcaagaccgugugguucguccccagcaucaaggcggggaacgacaucgccaacugccuccgcaagaacggcaagaaggugauccagcugucccggaagaccuucgacaccgaguaccagaagacgaagcugaacgacugggacuucguggucaccaccgacaucagcgagaugggcgccaacuucaaggccgaccgcgugaucgacccgcggcgcugccucaagcccgugauccugaccgacgggcccgagcgggucauccuggccggccccaugccggugaccgcggccuccgccgcccagcgccgggggcgcgugggccggaacccccagaaggagaacgaccaguacaucuucacggggcagccccucaacaacgacgaggaccacgcccacuggaccgaggcgaagaugcugcuggacaacaucaacacccccgagggcaucaucccggcccucuucgagcccgagcgcgagaaguccgccgccaucgacggcgaguaccggcugaagggggagucccgcaagaccuucgucgagcugaugcggcgcggcgaccuccccguguggcuggcgcacaaggucgccagcgaggggaucaaguacacggaccggaaguggugcuucgacggccagcgcaacaaccagauccuggaggagaacauggacguggagaucuggaccaaggagggcgagaagaagaagcuccggccccgcuggcuggacgcccggaccuacuccgacccgcuggcccucaaggaguucaaggacuucgccgcggggcgcaagagcaucgcccuggaccuggugaccgagaucggccgcguccccucccaccucgcccaccggacgcgcaacgcccuggacaaccuggugaugcuccacaccagcgagcacgggggcaaggccuaccggcacgcgguggaggagcugcccgagaccauggagacccugcuccugcuggggcucaugauccugcugacgggcggcgccaugcuguuccugaucagcgggaagggcaucgggaagaccuccaucggccugaucugcgucaucgccagcuccgggaugcucuggauggccgagaucccgcugcaguggaucgccagcgcgaucgugcuggaguucuucaugauggugcuccugauccccgagcccgagaagcagcgcacgccccaggacaaccagcuggccuacgucgugaucggcauccucacccuggccgccaucaucgccgcgaacgagaugggccugcucgagacgaccaagcgggaccuggggauguccaaggagccgggcguggucagccccaccuccuaccuggacguggaccuccaccccgccagcgccuggacccuguacgccguggcgacgaccgucaucacccccaugcugcgccacaccaucgagaacuccacggccaacgugagccucgccgccaucgccaaccaggcggugguccugauggggcuggacaagggcuggccgaucuccaagauggaccucggggugccccugcuggcccucggcugcuacagccaggugaacccccugacccugaccgccgccguccuccugcugaucacccacuacgccaucaucggccccgggcuccaggcgaaggccacgcgggaggcccagaagcgcaccgccgccggcaucaugaagaacccgaccguggacgggaucaugaccaucgaccuggaccccgugaucuacgacuccaaguucgagaagcagcugggccaggucaugcuccuggugcugugcgcggugcagcuccugcugaugcggacgagcugggcccucugcgaggcccugacccuggccaccggccccaucaccacgcucugggaggggucccccggcaaguucuggaacaccaccaucgcggucagcauggccaacaucuuccgcggguccuaccuggccggcgccgggcuggccuucagcaucaugaaguccgugggcaccggcaagcgggggaccggcagccagggggagacgcucggcgagaaguggaagaagaagcugaaccagcugagccgcaaggaguucgaccucuacaagaaguccgggaucaccgagguggaccggaccgaggcgaaggagggccugaagcgcggcgagaucacccaccacgccgucagccggggguccgccaagcugcagugguucguggagcgcaacauggugaucccggagggccgggucaucgaccucgggugcggccgcgggggcuggagcuacuacugcgccggccugaagaaggugacggaggugcggggguacaccaagggcgggcccggccacgaggagcccguccccauguccaccuacggguggaacaucgugaagcugaugagcggcaaggacguguucuaccucccgcccgagaagugcgacacccugcugugcgacaucggcgaguccagccccucccccacggucgaggagagccgcaccauccgggugcugaagaugguggagccguggcucaagaacaaccaguucugcaucaagguccugaaccccuacaugcccaccgugaucgagcaccuggagcgccuccagcgcaagcacgggggcaugcuggugcggaacccccugucccgcaacagcacccacgagauguacuggaucuccaacgggacgggcaacaucgucgccagcgugaacauggugucccggcuccugcugaaccgcuucaccaugacccaccggcgcccgaccaucgagaaggacgucgaccucggcgcggggacgcggcacgugaacgccgagcccgagacccccaacauggacgugaucggcgagcgcaucaagcggaucaaggaggagcacaacagcaccuggcacuacgacgacgagaacccguacaagaccugggccuaccacggguccuacgaggucaaggccacgggcagcgccuccagcaugaucaacgggguggucaagcugcugaccaagcccugggacguggugcccauggucacccagauggcgaugaccgacacgacccccuucggccagcagcgcguguucaaggagaagguggacacccggaccccgcgcagcaugcccggcacgcggcgcgucauggggaucaccgccgaguggcucuggcggacccugggccgcaacaagaagccccggcugugcacccgcgaggaguucacgaagaaggugcggaccaacgccgccaugggggcgguguucaccgaggagaaccagugggacuccgccaaggccgccgucgaggacgaggacuucuggaagcucguggaccgcgagcgcgagcugcacaagcugggcaagugcgggagcugcguguacaacaugaugggcaagcgggagaagaagcucggcgaguucgggaaggccaagggcucccgcgcgaucugguacauguggcugggggcccgguaccuggaguucgaggcccucggcuuccugaacgaggaccacugguucagccgcgagaacuccuacagcggggucgagggcgagggccugcacaagcucggguacauccugcgggacaucuccaagauccccggcggggccauguacgccgacgacaccgcgggcugggacacgcgcaucaccgaggacgaccugcacaacgaggagaagaucacccagcagauggacccggagcaccggcagcucgccaacgccaucuucaagcugaccuaccagaacaagguggugaagguccagcgccccacccccacgggcaccgugauggacaucaucagccggaaggaccagcgcggguccggccagguggggaccuacggccugaacaccuucacgaacauggaggcccagcucauccggcagauggagggggagggcguccugagcaaggccgaccuggagaacccccaccucccggagaagaagaucacccaguggcuggagaccaagggcguggagcgccugaagcggauggcgaucuccggggacgacugcguggucaagcccaucgacgaccgcuucgccaacgcccuccuggcccugaacgacaugggcaaggugcggaaggacaucccccaguggcagcccagcaagggguggcacgacuggcagcaggucccguucugcucccaccacuuccacgagcucaucaugaaggacggccgcaagcuggucgugcccugccggccccaggacgagcugaucgggcgcgcccggaucagccagggcgcgggcuggucccuccgcgagaccgccugccuggggaaggccuacgcccagauguggagccugauguacuuccaccggcgcgaccuccgccuggcguccaacgccaucugcagcgccgugcccguccacugggugccgacgucccggaccaccuggagcauccacgcccaccaccaguggaugaccacggaggacaugcugaccguguggaaccgcgucuggaucgaggacaaccccuggauggaggacaagacccccgugaccacgugggagaacgugcccuaccucggcaagcgggaggaccaguggugcgggagccugaucggccugaccucccgcgccaccugggcgcagaacaucccgaccgccauccagcagguccggagccucaucgggaacgaggaguuccuggacuacaugcccuccaugaagcgcuuccggaaggaggaggagagcgagggcgccaucugguga

SEQ ID NO: 10188 - RNA, 9873 nt, Artificial Sequence
  derived and/or modified CDS sequence (opt1) from DENV-3__FJ547072__SS-prME
accagccugugccucaugaugauccugcccgcggcgcuggcguuccaccucaccagccgggacggcgagccccggaugaucguggggaagaacgagcgcggccggagccugcuguucaagacggccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccgccgggacaagcgcuccgucgcccucgcgccccacgugggcauggggcuggacacccggacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccgugcugccggaggagcaggaccagaacuacgucugcaagcacaccuacguggaccgcggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcggaccggccuggacuucaacgagaugauccugcucacgaugaagaacaaggccuggauggugcaccgccagugguucuucgaccugccccugcccuggaccagcggcgccaccaccgagacgcccaccuggaaccggaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccgccugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccggcugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccgcggcgcccggcgcauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgugaucgggaucaucacccucuaccugggcgccgucgugcaggccgacauggggugcgugaucaacuggaagggcaaggagcugaagugcggcagcgggaucuucgucacgaacgaggugcacaccuggaccgagcaguacaaguuccaggccgacucccccaagcgccucgcgaccgccaucgccggcgccugggagaacggggugugcggcauccggagcacgacccgcauggagaaccugcuguggaagcagaucgccaacgagcucaacuacauccugugggagaacaacaucaagcugaccgucguggugggggacaucaucggcguccucgagcagggcaagcggacccugacgccccagccgauggagcugaaguacuccuggaagaccugggggaaggcgaagaucgugaccgccgagacccagaacagcuccuucaucaucgacggccccaacacgcccgagugccccagcgccucccgcgccuggaacgugugggaggucgaggacuacggguucggcguguucaccaccaacaucuggcucaagcugcgggagguguacacccagcugugcgaccaccgccucaugagcgcggccgucaaggacgagcgggccgugcacgccgacaugggcuacuggaucgagagccagaagaacggguccuggaagcuggagaaggccagccugaucgaggugaagaccugcacguggccgaagucccacacccucuggagcaacggcguccuggaguccgacaugaucauccccaagagccuggcggggcccaucucccagcacaacuaccgcccgggcuaccacacccagaccgccgggcccuggcaccucggcaagcuggagcuggacuucaacuacugcgagggcacgaccguggugaucaccgagaacugcgggacccggggccccagccuccgcacgaccaccgucuccgggaagcugauccacgaguggugcugccggagcugcacccugcccccgcuccgcuacaugggcgaggacgggugcugguacggcauggagauccggcccaucuccgagaaggaggagaacauggucaagagccugguguccgccggcagcgggaaggucgacaacuucacgaugggcgugcugugccucgccauccuguucgaggaggugaugcgcgggaaguucggcaagaagcacaugaucgccggggucuucuucaccuucgugcugcuccuguccggccagaucaccuggcgggacauggcgcacacccugaucaugaucggcagcaacgccuccgaccgcauggggaugggcgugacguaccucgcccugaucgccaccuucaagauccagcccuuccuggcccucggguucuuccugcggaagcugaccagccgcgagaaccuccugcugggcgucggccucgcgauggccaccacgcugcagcugcccgaggacaucgagcagauggccaacgggaucgcccucggccugauggcgcugaagcucaucacccaguucgagaccuaccagcuguggaccgcccugaucagccucacgugcuccaacaccaucuucacccugaccguggccuggcggacggccacccugauccucgccggggucagccugcugccggugugccaguccagcuccaugcgcaagaccgacuggcuccccaugaccguggcggccaugggcgugccgccccucccgcuguucaucuucagccucaaggacacgcugaagcgccgguccuggccccugaacgagggggugauggccgugggccucgucagcauccuggccuccagccugcuccgcaacgacgugcccauggccggcccccugguggccggcgggcugcucaucgccugcuacgucaucaccgggaccuccgccgaccugaccguggagaaggccgccgacgugacgugggaggaggaggcggagcagaccggggucagccacaaccugaugaucaccguggacgacgacgggaccaugcggaucaaggacgacgagaccgagaacauccucacggugcugcugaagaccgcccuccugaucgucuccggcaucuucccguacagcauccccgccacccugcucguguggcacaccuggcagaagcagacgcagcgcuccggcgugcugugggacguccccagcccgcccgagacccagaaggccgagcuggaggaggggguguaccggaucaagcagcagggcaucuucgggaagacccaggugggcgucggggugcagaaggagggcguguuccacaccauguggcacgucacgcgcggcgccgugcucaccuacaacgggaagcggcuggagcccaacugggcguccgugaagaaggaccugaucagcuacggcgggggcuggcgccucuccgcccaguggcagaagggggaggagguccaggugaucgccguggagcccggcaagaaccccaagaacuuccagaccaugcccggcaccuuccagacgaccaccggggagaucggcgccaucgcgcuggacuucaagcccgggaccagcggcagccccaucaucaaccgggagggcaaggucguggggcuguacggcaacgggguggucacgaagaacggcggguacguguccggcaucgcccagaccaacgccgagccggacggccccacccccgagcuggaggaggagauguucaagaagcgcaaccucaccaucauggaccugcaccccgggagcggcaagacgcggaaguaccugccggccaucgugcgcgaggccaucaagcggcgccuccggacccugauccuggcgcccacccgcgucguggccgccgagauggaggaggcccucaaggggcugcccauccgguaccagaccacggccaccaaguccgagcacaccggccgcgagaucguggaccugaugugccacgcgaccuucacgaugcggcuccugagccccguccgcgugccgaacuacaaccugaucaucauggacgaggcccacuucaccgaccccgccuccaucgccgcccggggguacaucagcacccgcgugggcaugggcgaggcggccgccaucuucaugaccgccacgccgcccgggaccgcggacgccuucccgcaguccaacgcccccauccaggacgaggagcgcgacauccccgagcggagcuggaacuccggcaacgaguggaucaccgacuucgccgggaagaccgucugguucgugcccagcaucaaggccggcaacgacaucgcgaacugccuccgcaagaacgggaagaaggugauccagcugucccggaagacguucgacaccgaguaccagaagaccaagcugaacgacugggacuucgucgugaccacggacaucagcgagaugggcgccaacuucaaggccgaccgcgugaucgacccgcggcgcugccucaagcccgucauccugaccgacggccccgagcgggugauccuggccgggcccaugccggugaccgccgcguccgccgcccagcgccggggccgcgucgggcggaacccccagaaggagaacgaccaguacaucuucaccggccagccccucaacaacgacgaggaccacgcccacuggaccgaggccaagaugcugcuggacaacaucaacacgcccgaggggaucaucccggcccucuucgagcccgagcgcgagaaguccgccgccaucgacggcgaguaccggcugaagggcgagucccgcaagaccuucguggagcugaugcggcgcggggaccuccccgucuggcuggcccacaagguggcgagcgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcccgcacguacuccgacccgcuggcccucaaggaguucaaggacuucgccgccggccgcaagagcaucgcgcuggaccuggucaccgagaucgggcgcgugcccucccaccucgcccaccggacccgcaacgcccuggacaaccuggugaugcuccacaccagcgagcacggcgggaaggccuaccggcacgccgucgaggagcugcccgagacgauggagacccugcuccugcugggccucaugauccugcugaccgggggcgcgaugcuguuccugaucagcggcaaggggaucggcaagaccuccaucgggcugaucugcgugaucgccagcuccggcaugcucuggauggccgagaucccgcugcaguggaucgccagcgccaucgugcuggaguucuucaugaugguccuccugauccccgagcccgagaagcagcgcacgccccaggacaaccagcuggcguacguggugaucgggauccucacccuggccgccaucaucgccgccaacgagaugggccugcucgagaccaccaagcgggaccugggcauguccaaggagccgggggucgugagccccacguccuaccuggacguggaccuccaccccgcgagcgccuggacccuguacgccgucgccaccaccgugaucacgcccaugcugcgccacaccaucgagaacuccaccgcgaacgugagccucgccgccaucgccaaccaggccgucgugcugaugggccuggacaagggguggccgaucuccaagauggaccucggcgugccccugcuggcgcucgggugcuacagccaggucaacccccugacccugacggccgccgugcuccugcugaucacccacuacgccaucaucggccccggccuccaggccaaggcgacccgggaggcccagaagcgcaccgccgccgggaucaugaagaacccgacgguggacggcaucaugaccaucgaccuggaccccgucaucuacgacuccaaguucgagaagcagcugggccaggugaugcuccuggugcugugcgccguccagcuccugcugaugcggaccagcugggcgcucugcgaggcccugacccuggccacgggccccaucaccacccucugggagggcucccccgggaaguucuggaacaccacgaucgccgugagcauggcgaacaucuuccgcggcuccuaccuggccggggccggccuggccuucagcaucaugaaguccguggggaccggcaagcggggcaccgggagccagggcgagacccucggggagaaguggaagaagaagcugaaccagcugagccgcaaggaguucgaccucuacaagaaguccggcaucaccgaggucgaccggacggaggccaaggaggggcugaagcgcggcgagaucacccaccacgcggugagccggggcuccgccaagcugcagugguucguggagcgcaacauggucaucccggaggggcgggugaucgaccucggcugcgggcgcggcggguggagcuacuacugcgccggccugaagaaggugaccgagguccggggcuacaccaagggcgggcccgggcacgaggagcccgugcccauguccacguacggcuggaacaucgugaagcugaugagcgggaaggacgucuucuaccucccgcccgagaagugcgacacccugcugugcgacaucggcgaguccagccccucccccaccguggaggagagccgcaccauccgcgugcugaagauggucgagccguggcucaagaacaaccaguucugcaucaaggugcugaaccccuacaugcccacggugaucgagcaccuggagcggcuccagcgcaagcacggcgggaugcugguccggaacccccugucccgcaacagcacccacgagauguacuggaucuccaacggcaccgggaacaucguggccagcgugaacauggucucccggcuccugcugaaccgcuucaccaugacgcaccggcgcccgaccaucgagaaggacguggaccucggcgccggcacccggcacgugaacgcggagcccgagacccccaacauggacgucaucggggagcgcaucaagcggaucaaggaggagcacaacagcacguggcacuacgacgacgagaacccguacaagaccugggccuaccacggcuccuacgaggugaaggccaccgggagcgccuccagcaugaucaacggcgucgugaagcugcugaccaagcccugggacgugguccccauggugacgcagauggccaugaccgacaccacccccuucgggcagcagcgcguguucaaggagaaggucgacacgcggaccccgcgcagcaugcccggcacccggcgcgugaugggcaucaccgcggaguggcucuggcggacgcuggggcgcaacaagaagccccggcugugcacccgcgaggaguucaccaagaaggugcgcaccaacgccgccaugggcgccgucuucacggaggagaaccagugggacuccgcgaaggccgccguggaggacgaggacuucuggauccucguggaccgggagcgcgagcugcacaagcuggggaagugcggcagcugcgucuacaacaugauggggaagcgggagaagaagcucggcgaguucggcaaggccaaggggucccgcgccaucugguacauguggcugggcgcgcgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgccgacgacaccgccgggugggacacccgcaucaccgaggacgaccugcacaacgaggagaagaucacgcagcagauggacccggagcaccggcagcucgcgaacgccaucuucaagcugaccuaccagaacaagguggucaaggugcagcgccccacccccaccggcaccgugauggacaucaucagccggaaggaccagcgcggcuccgggcaggucggcacguacgggcugaacaccuucaccaacauggaggcccagcucauccggcagauggagggcgagggggugcugagcaaggccgaccuggagaacccccaccucccggagaagaagaucacccaguggcuggagacgaagggcguggagcgccugaagcggauggccaucuccggcgacgacugcgucgugaagcccaucgacgaccgcuucgcgaacgcccuccuggcccugaacgacauggggaaggugcggaaggacaucccccaguggcagcccagcaagggcuggcacgacuggcagcaggucccguucugcucccaccacuuccacgagcucaucaugaaggacgggcgcaagcugguggugcccugccggccccaggacgagcugaucggccgcgcccggaucagccagggggccggcuggucccuccgcgagaccgcgugccugggcaaggccuacgcccagauguggagccugauguacuuccaccgccgggaccuccgccuggccuccaacgcgaucugcagcgccguccccgugcacugggugccgaccucccggaccacguggagcauccacgcccaccaccaguggaugaccaccgaggacaugcugaccgucuggaaccgcguguggaucgaggacaaccccuggauggaggacaagacgcccgugaccaccugggagaacguccccuaccucgggaagcgggaggaccaguggugcggcagccugaucgggcugaccucccgcgccacgugggcccagaacaucccgaccgcgauccagcagguccggagccucaucggcaacgaggaguuccuggacuacaugcccuccaugaagcgcuuccggaaggaggaggagagcgagggggccaucugguga

SEQ ID NO: 10189 - RNA, 9873 nt, Artificial Sequence
  derived and/or modified CDS sequence (opt1) from DENV-3__FJ547073__SS-prME
accagccugugccucaugaugauccugcccgcggcgcuggcguuccaccucaccagccgggacggcgagccccggaugaucguggggaagaacgagcgcggcaagagccugcuguucaagacggccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgugaucgggaucaucacccucuaccugggcgccgucgugcaggccgacauggggugcgugaucaacuggaagggcaaggagcugaagugcggcagcgggaucuucgucacgaacgaggugcacaccuggaccgagcaguacaaguuccaggccgacucccccaagcgccucgcgaccgccaucgccggcgccugggagaacggggugugcggcauccgcagcacgacccggauggagaaccugcuguggaagcagaucgccaacgagcucaacuacauccugugggagaacaacaucaagcugaccgucguggugggggacaucaucggcguccucgagcagggcaagcgcacccugacgccccagccgauggagcugaaguacuccuggaagaccugggggaaggcgaagaucgugaccgccgagacccagaacagcuccuucaucaucgacggccccaacacgcccgagugccccagcgccucccgggccuggaacgugugggaggucgaggacuacggguucggcguguucaccaccaacaucuggcucaagcugcgcgagguguacacccagcugugcgaccaccggcucaugagcgcggccgucaaggacgagcgcgccgugcacgccgacaugggcuacuggaucgagagccagaagaacggguccuggaagcuggagaaggccagccugaucgaggugaagaccugcacguggccgaagucccacacccucuggagcaacggcguccuggaguccgacaugaucauccccaagagccuggcggggcccaucucccagcacaacuaccggccgggcuaccacacccagaccgccgggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaaggucgacaacuucacgaugggcgugcugugccucgccauccuguucgaggaggugaugcgggggaaguucggcaagaagcacaugaucgccggggucuucuucaccuucgugcugcuccuguccggccagaucaccuggcgcgacauggcgcacacccugaucaugaucggcagcaacgccuccgaccggauggggaugggcgugacguaccucgcccugaucgccaccuucaagauccagcccuuccuggcccucggguucuuccugcgcaagcugaccagccgggagaaccuccugcugggcgucggccucgcgauggccaccacgcugcagcugcccgaggacaucgagcagauggccaacgggaucgcccucggccugauggcgcugaagcucaucacccaguucgagaccuaccagcuguggaccgcccugaucagccucacgugcuccaacaccaucuucacccugaccguggccuggcgcacggccacccugauccucgccggggucagccugcugccggugugccaguccagcuccaugcggaagaccgacuggcuccccaugaccguggcggccaugggcgugccgccccucccgcuguucaucuucagccucaaggacacgcugaagcgccgcuccuggccccugaacgagggggugauggccgugggccucgucagcauccuggccuccagccugcuccggaacgacgugcccauggccggcccccugguggccggcgggcugcucaucgccugcuacgucaucaccgggaccuccgccgaccugaccguggagaaggccgccgacgugacgugggaggaggaggcggagcagaccggggucagccacaaccugaugaucaccguggacgacgacgggaccaugcgcaucaaggacgacgagaccgagaacauccucacggugcugcugaagaccgcccuccugaucgucuccggcaucuucccguacagcauccccgccacccugcucguguggcacaccuggcagaagcagacgcagcgguccggcgugcugugggacguccccagcccgcccgagacccagaaggccgagcuggaggaggggguguaccgcaucaagcagcagggcaucuucgggaagacccaggugggcgucggggugcagaaggagggcguguuccacaccauguggcacgucacgcggggcgccgugcucaccuacaacgggaagcgccuggagcccaacugggcguccgugaagaaggaccugaucagcuacggcgggggcuggcggcucuccgcccaguggcagaagggggaggagguccaggugaucgccguggagcccggcaagaaccccaagaacuuccagaccaugcccggcaccuuccagacgaccaccggggagaucggcgccaucgcgcuggacuucaagcccgggaccagcggcagccccaucaucaaccgcgagggcaaggucguggggcuguacggcaacgggguggucacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggccaucaagcgccggcuccgcacccugauccuggcgcccacccgggucguggccgccgagauggaggaggcccucaaggggcugcccauccgcuaccagaccacggccaccaaguccgagcacaccggccgggagaucguggaccugaugugccacgcgaccuucacgaugcgccuccugagccccguccgggugccgaacuacaaccugaucaucauggacgaggcccacuucaccgaccccgccuccaucgccgcccgcggguacaucagcacccgggugggcaugggcgaggcggccgccaucuucaugaccgccacgccgcccgggaccgcggacgccuucccgcaguccaacgcccccauccaggacgaggagcgcgacauccccgagcgcagcuggaacuccggcaacgaguggaucaccgacuucgccgggaagaccgucugguucgugcccagcaucaaggccggcaacgacaucgcgaacugccuccggaagaacgggaagaaggugauccagcugucccgcaagacguucgacaccgaguaccagaagaccaagcugaacgacugggacuucgucgugaccacggacaucagcgagaugggcgccaacuucaaggccgaccgggugaucgacccgcgccggugccucaagcccgucauccugaccgacggccccgagcgcgugauccuggccgggcccaugccggugaccgccgcguccgccgcccagcggcgcggccgggucgggcgcaacccccagaaggagaacgaccaguacaucuucaccggccagccccucaacaacgacgaggaccacgcccacuggaccgaggccaagaugcugcuggacaacaucaacacgcccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcccacaagguggcgagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgccggccgcaagagcaucgcgcuggaccuggucaccgagaucgggcgggugcccucccaccucgcccaccgcacccggaacgcccuggacaaccuggugaugcuccacaccagcgagcacggcgggaaggccuaccgcuacgccgucgaggagcugcccgagacgauggagacccugcuccugcugggccucaugauccugcugaccgggggcgcgaugcuguuccugaucagcggcaaggggaucggcaagaccuccaucgggcugaucugcgugaucgccagcuccggcaugcucuggauggccgagaucccgcugcaguggaucgccagcgccaucgugcuggaguucuucaugaugguccuccugauccccgagcccgagaagcagcggacgccccaggacaaccagcuggcguacguggugaucgggauccucacccuggccgccaucaucgccgccaacgagaugggccugcucgagaccaccaagcgcgaccugggcauguccaaggagccgggggucgugagccccacguccuaccuggacguggaccuccaccccgcgagcgccuggacccuguacgccgucgccaccaccgugaucacgcccaugcugcggcacaccaucgagaacuccaccgcgaacgugagccucgccgccaucgccaaccaggccgucgugcugaugggccuggacaagggguggccgaucuccaagauggaccucggcgugccccugcuggcgcucgggugcuacagccaggucaacccccugacccugacggccgccgugcuccugcugaucacccacuacgccaucaucggccccggccuccaggccaaggcgacccgcgaggcccagaagcggaccgccgccgggaucaugaagaacccgacgguggacggcaucaugaccaucgaccuggaccccgucaucuacgacuccaaguucgagaagcagcugggccaggugaugcuccuggugcugugcgccguccagcuccugcugaugcgcaccagcugggcgcucugcgaggcccugacccuggccacgggccccaucaccacccucugggagggcucccccgggaaguucuggaacaccacgaucgccgugagcauggcgaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggaguucgaccucuacaagaaguccggcaucaccgaggucgaccgcacggaggccaaggaggggcugaagcggggcgagaucacccaccacgcggugagccgcggcuccgccaagcugcagugguucguggagcggaacauggucaucccggaggggcgcgugaucgaccucggcugcgggcggggcggguggagcuacuacugcgccggccugaagaaggugaccgagguccgcggcuacaccaagggcgggcccgggcacgaggagcccgugcccauguccacguacggcuggaacaucgugaagcugaugagcgggaaggacgucuucuaccucccgcccgagaagugcgacacccugcugugcgacaucggcgaguccagccccucccccaccguggaggagagccggaccauccgcgugcugaagauggucgagccguggcucaagaacaaccaguucugcaucaaggugcugaaccccuacaugcccacggugaucgagcaccuggagcgccuccagcggaagcacggcgggaugcugguccgcaacccccugucccggaacagcacccacgagauguacuggaucuccaacggcaccgggaacaucguggccagcgugaacauggucucccgccuccugcugaaccgguucaccaugacgcaccgccggccgaccaucgagaaggacguggaccucggcgccggcacccgccacgugaacgcggagcccgagacccccaacauggacgucaucggggagcggaucaagcgcaucaaggaggagcacaacagcacguggcacuacgacgacgagaacccguacaagaccugggccuaccacggcuccuacgaggugaaggccaccgggagcgccuccagcaugaucaacggcgucgugaagcugcugaccaagcccugggacgugguccccauggugacgcagauggccaugaccgacaccacccccuucgggcagcagcggguguucaaggagaaggucgacacgcgcaccccgcggagcaugcccggcacccgccgggugaugggcaucaccgcggaguggcucuggcgcacgcuggggcggaacaagaagccccgccugugcacccgggaggaguucaccaagaaggugcgcaccaacgccgccaugggcgccgucuucacggaggagaaccagugggacuccgcgaaggccgccguggaggacgaggacuucuggauccucguggaccgcgagcgggagcugcacaagcuggggaagugcggcagcugcgucuacaacaugauggggaagcgcgagaagaagcucggcgaguucggcaaggccaaggggucccgggccaucugguacauguggcugggcgcgcgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgccgacgacaccgccgggugggacacccggaucaccgaggacgaccugcacaacgaggagaagaucacgcagcagauggacccggagcaccgccagcucgcgaacgccaucuucaagcugaccuaccagaacaagguggucaaggugcagcggcccacccccaccggcaccgugauggacaucaucagccgcaaggaccagcggggcuccgggcaggucggcacguacgggcugaacaccuucaccaacauggaggcccagcucauccgccagauggagggcgagggggugcugagcaaggccgaccuggagaacccccaccucccggagaagaagaucacccaguggcuggagacgaagggcguggagcggcugaagcgcauggccaucuccggcgacgacugcgucgugaagcccaucgacgaccgguucgcgaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcugguggugcccugccgcccccaggacgagcugaucggccgggcccgcaucagccagggggccggcuggucccuccgggagaccgcgugccugggcaaggccuacgcccagauguggagccugauguacuuccaccgccgcgaccuccggcuggccuccaacgcgaucugcagcgccguccccgugcacugggugccgaccucccgcaccacguggagcauccacgcccaccaccaguggaugaccaccgaggacaugcugaccgucuggaaccggguguggaucgaggacaaccccuggauggaggacaagacgcccgugaccaccugggagaacguccccuaccucgggaagcgcgaggaccaguggugcggcagccugaucgggcugaccucccgggccacgugggcccagaacaucccgaccgcgauccagcagguccgcagccucaucggcaacgaggaguuccuggacuacaugcccuccaugaagcgguuccgcaaggaggaggagagcgagggggccaucugguga

SEQ ID NO: 10190 - RNA, 9873 nt, Artificial Sequence
  derived and/or modified CDS sequence (opt1) from DENV-3__FJ547074__SS-prME
accagccugugccucaugaugauccugcccgcggcgcuggcguuccaccucaccagccgggacggggagccccggaugaucguggggaagaacgagcgcggcaagagccugcuguucaagacggccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgugaucgggaucaucacccucuaccugggcgccgucgugcaggccgacauggggugcgugaucaacuggaagggcaaggagcugaagugcggcagcgggaucuucgucacgaacgaggugcacaccuggaccgagcaguacaaguuccaggccgacucccccaagcgccucgcgaccgccaucgccggcgccugggagaacggggugugcggcauccgcagcacgacccggauggagaaccugcuguggaagcagaucgccaacgagcucaacuacauccugugggagaacaacaucaagcugaccgucguggugggggacaucaucggcguccucgagcagggcaagcgcacccugacgccccagccgauggagcugaaguacuccuggaagaccugggggaaggcgaagaucgugaccgccgagacccagaacagcuccuucaucaucgacggccccaacacgcccgagugccccagcgccucccgggccuggaacgugugggaggucgaggacuacggguucggcguguucaccaccaacaucuggcucaagcugcgcgagguguacacccagcugugcgaccaccggcucaugagcgcggccgucaaggacgagcgcgccgugcacgccgacaugggcuacuggaucgagagccagaagaacggguccuggaagcuggagaaggccagccugaucgaggugaagaccugcacguggccgaagucccacacccucuggagcaacggcguccuggaguccgacaugaucauccccaagagccuggcggggcccaucucccagcacaacuaccggccgggcuaccacacccagaccgccgggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaaggucgacaacuucacgaugggcgugcugugccucgccauccuguucgaggaggugaugcgggggaaguucggcaagaagcacaugaucgccggggucuucuucaccuucgugcugcuccuguccggccagaucaccuggcgcgacauggcgcacacccugaucaugaucggcagcaacgccuccgaccggauggggaugggcgugacguaccucgcccugaucgccaccuucaagauccagcccuuccuggcccucggguucuuccugcgcaagcugaccagccgggagaaccuccugcugggcgucggccucgcgauggccaccacgcugcagcugcccgaggacaucgagcagauggccaacgggaucgcccucggccugauggcgcugaagcucaucacccaguucgagaccuaccagcuguggaccgcccugaucagccucacgugcuccaacaccaucuucacccugaccguggccuggcgcacggccacccugauccucgccggggucagccugcugccggugugccaguccagcuccaugcggaagaccgacuggcuccccaugaccguggcggccaugggcgugccgccccucccgcuguucaucuucagccucaaggacacgcugaagcgccgcuccuggccccugaacgagggggugauggccgugggccucgucagcauccuggccuccagccugcuccggaacgacgugcccauggccggcccccugguggccggcgggcugcucaucgccugcuacgucaucaccgggaccuccgccgaccugaccguggagaaggccgccgacgugacgugggaggaggaggcggagcagaccggggucagccacaaccugaugaucaccguggacgacgacgggaccaugcgcaucaaggacgacgagaccgagaacauccucacggugcugcugaagaccgcccuccugaucgucuccggcaucuucccguacagcauccccgccacccugcucguguggcacaccuggcagaagcagacgcagcgguccggcgugcugugggacguccccagcccgcccgagacccagaaggccgagcuggaggaggggguguaccgcaucaagcagcagggcaucuucgggaagacccaggugggcgucggggugcagaaggagggcguguuccacaccauguggcacgucacgcggggcgccgugcucaccuacaacgggaagcgccuggagcccaacugggcguccgugaagaaggaccugaucagcuacggcgggggcuggcggcucuccgcccaguggcagaagggggaggagguccaggugaucgccguggagcccggcaagaaccccaagaacuuccagaccaugcccggcaccuuccagacgaccaccggggagaucggcgccaucgcgcuggacuucaagcccgggaccagcggcagccccaucaucaaccgcgagggcaaggucguggggcuguacggcaacgggguggucacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggccaucaagcgccggcuccgcacccugauccuggcgcccacccgggucguggccgccgagauggaggaggcccucaaggggcugcccauccgcuaccagaccacggccaccaaguccgagcacaccggccgggagaucguggaccugaugugccacgcgaccuucacgaugcgccuccugagccccguccgggugccgaacuacaaccugaucaucauggacgaggcccacuucaccgaccccgccuccaucgccgcccgcggguacaucagcacccgggugggcaugggcgaggcggccgccaucuucaugaccgccacgccgcccgggaccgcggacgccuucccgcaguccaacgcccccauccaggacgaggagcgcgacauccccgagcgcagcuggaacuccggcaacgaguggaucaccgacuucgccgggaagaccgucugguucgugcccagcaucaaggccggcaacgacaucgcgaacugccuccggaagaacgggaagaaggugauccagcugucccgcaagacguucgacaccgaguaccagaagaccaagcugaacgacugggacuucgucgugaccacggacaucagcgagaugggcgccaacuucaaggccgaccgggugaucgacccgcgccggugccucaagcccgucauccugaccgacggccccgagcgcgugauccuggccgggcccaugccggugaccgccgcguccgccgcccagcggcgcggccgggucgggcgcaacccccagaaggagaacgaccaguacaucuucaccggccagccccucaacaacgacgaggaccacgcccacuggaccgaggccaagaugcugcuggacaacaucaacacgcccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcccacaagguggcgagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgccggccgcaagagcaucgcgcuggaccuggucaccgagaucgggcgggugcccucccaccucgcccaccgcacccggaacgcccuggacaaccuggugaugcuccacaccagcgagcacggcgggaaggccuaccgccacgccgucgaggagcugcccgagacgauggagacccugcuccugcugggccucaugauccugcugaccgggggcgcgaugcuguuccugaucagcggcaaggggaucggcaagaccuccaucgggcugaucugcgugaucgccagcuccggcaugcucuggauggccgagaucccgcugcaguggaucgccagcgccaucgugcuggaguucuucaugaugguccuccugauccccgagcccgagaagcagcggacgccccaggacaaccagcuggcguacguggugaucgggauccucacccuggccgccaucaucgccgccaacgagaugggccugcucgagaccaccaagcgcgaccugggcauguccaaggagccgggggucgugagccccacguccuaccuggacguggaccuccaccccgcgagcgccuggacccuguacgccgucgccaccaccgugaucacgcccaugcugcggcacaccaucgagaacuccaccgcgaacgugagccucgccgccaucgccaaccaggccgucgugcugaugggccuggacaagggguggccgaucuccaagauggaccucggcgugccccugcuggcgcucgggugcuacagccaggucaacccccugacccugacggccgccgugcuccugcugaucacccacuacgccaucaucggccccggccuccaggccaaggcgacccgcgaggcccagaagcggaccgccgccgggaucaugaagaacccgacgguggacggcaucaugaccaucgaccuggaccccgucaucuacgacuccaaguucgagaagcagcugggccaggugaugcuccuggugcugugcgccguccagcuccugcugaugcgcaccagcugggcgcucugcgaggcccugacccuggccacgggccccaucaccacccucugggagggcucccccgggaaguucuggaacaccacgaucgccgugagcauggcgaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggaguucgaccucuacaagaaguccggcaucaccgaggucgaccgcacggaggccaaggaggggcugaagcggggcgagaucacccaccacgcggugagccgcggcuccgccaagcugcagugguucguggagcggaacauggucaucccggaggggcgcgugaucgaccucggcugcgggcggggcggguggagcuacuacugcgccggccugaagaaggugaccgagguccgcggcuacaccaagggcgggcccgggcacgaggagcccgugcccauguccacguacggcuggaacaucgugaagcugaugagcgggaaggacgucuucuaccucccgcccgagaagugcgacacccugcugugcgacaucggcgaguccagccccucccccaccguggaggagagccggaccauccgcgugcugaagauggucgagccguggcucaagaacaaccaguucugcaucaaggugcugaaccccuacaugcccacggugaucgagcaccuggagcgccuccagcggaagcacggcgggaugcugguccgcaacccccugucccggaacagcacccacgagauguacuggaucuccaacggcaccgggaacaucguggccagcgugaacauggucucccgccuccugcugaaccgguucaccaugacguaccgccggccgaccaucgagaaggacguggugcucggcgccggcacccgccacgucaacgcggagcccgagacccccaacauggacgugaucggggagcggaucaagcgcaucaaggaggagcacaacagcacguggcacuacgacgacgagaacccguacaagaccugggccuaccacggcuccuacgaggucaaggccaccgggagcgccuccagcaugaucaacggcguggugaagcugcugaccaagcccugggacgucgugcccauggugacgcagauggccaugaccgacaccacccccuucgggcagcagcgggucuucaaggagaagguggacacgcgcaccccgcggagcaugcccggcacccgccgggugaugggcaucaccgcggaguggcucuggcgcacgcuggggcggaacaagaagccccgccugugcacccgggaggaguucaccaagaagguccgcaccaacgccgccaugggcgccguguucacggaggagaaccagugggacuccgcgaaggccgccguggaggacgaggacuucuggauccucgucgaccgcgagcgggagcugcacaagcuggggaagugcggcagcugcguguacaacaugauggggaagcgcgagaagaagcucggcgaguucggcaaggccaaggggucccgggccaucugguacauguggcugggcgcgcgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgccgacgacaccgccgggugggacacccggaucaccgaggacgaccugcacaacgaggagaagaucacgcagcagauggacccggagcaccgccagcucgcgaacgccaucuucaagcugaccuaccagaacaaggucgugaaggugcagcggcccacccccaccggcaccgucauggacaucaucagccgcaaggaccagcggggcuccggccaggugggcacguacgggcugaacaccuucaccaacauggaggcccagcucauccgccagauggagggcgagggggugcugagcaaggccgaccuggagaacccccaccucccggagaagaagaucacccaguggcuggagacgaagggcgucgagcggcugaagcgcauggccaucuccggcgacgacugcguggugaagcccaucgacgaccgguucgcgaacgcccuccuggcccugaacgacauggggaagguccgcaaggacaucccccaguggcagcccagcaagggcuggcacgacuggcagcaggucccguucugcucccaccacuuccacgagcucaucaugaaggacgggcggaagcuggugguccccugccgcccccaggacgagcugaucggccgggcccgcaucagccagggggccggcuggucccuccgggagaccgcgugccugggcaaggccuacgcccagauguggagccugauguacuuccaccgccgcgaccuccggcuggccuccaacgcgaucugcagcgccgugcccgugcacugggucccgaccucccgcaccacguggagcauccacgcccaccaccaguggaugaccaccgaggacaugcugaccguguggaaccggguguggaucgaggacaaccccuggauggaggacaagacgcccgucaccaccugggagaacgugcccuaccucgggaagcgcgaggaccaguggugcggcagccugaucgggcugaccucccgggccacgugggcccagaacaucccgaccgcgauccagcagguccgcagccucaucggcaacgaggaguuccuggacuacaugcccuccaugaagcgguuccgcaaggaggaggagagcgagggggccaucugguga

SEQ ID NO: 10191 - RNA, 9873 nt, Artificial Sequence
  derived and/or modified CDS sequence (opt1) from DENV-3__FJ547075__SS-prME
accagccugugccucaugaugauccugcccgcggcgcuggcguuccaccucaccagccgggacggcgagccgcggaugaucguggggaagaacgagcgcggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgugaucgggaucaucacccucuaccugggcgccgucgugcaggccgacauggggugcgugaucaacuggaagggcaaggagcugaagugcggcagcgggaucuucgucacgaacgaggugcacaccuggaccgagcaguacaaguuccaggccgacucccccaagcgccucgcgaccgccaucgccggcgccugggagaacggggugugcggcauccgcagcacgacccggauggagaaccugcuguggaagcagaucgccaacgagcucaacuacauccugugggagaacaacaucaagcugaccgucguggugggggacaucaucggcguccucgagcagggcaagcgcacccugacgccccagccgauggagcugaaguacuccuggaagaccugggggaaggcgaagaucgugaccgccgagacccagaacagcuccuucaucaucgacggccccaacacgcccgagugccccagcgccucccgggccuggaacgugugggaggucgaggacuacggguucggcguguucaccaccaacaucuggcucaagcugcgcgagguguacacccagcugugcgaccaccggcucaugagcgcggccgucaaggacgagcgcgccgugcacgccgacaugggcuacuggaucgagagccagaagaacggguccuggaagcuggagaaggccagccugaucgaggugaagaccugcacguggccgaagucccacacccucuggagcaacggcguccuggaguccgacaugaucauccccaagagccuggcggggcccaucucccagcacaacuaccggccgggcuaccacacccagaccgccgggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaaggucgacaacuucacgaugggcgugcugugccucgccauccuguucgaggaggugaugcgggggaaguucggcaagaagcacaugaucgccggggucuucuucaccuucgugcugcuccuguccggccagaucaccuggcgcgacauggcgcacacccugaucaugaucggcagcaacgccuccgaccggauggggaugggcgugacguaccucgcccugaucgccaccuucaagauccagcccuuccuggcccucggguucuuccugcgcaagcugaccagccgggagaaccuccugcugggcgucggccucgcgauggccaccacgcugcagcugcccgaggacaucgagcagauggccaacgggaucgcccucggccugauggcgcugaagcucaucacccaguucgagaccuaccagcuguggaccgcccugaucagccucacgugcuccaacaccaucuucacccugaccguggccuggcgcacggccacccugauccucgccggggucagccugcugccggugugccaguccagcuccaugcggaagaccgacuggcuccccaugaccguggcggccaugggcgugccgccccucccgcuguucaucuucagccucaaggacacgcugaagcgccgcuccuggccccugaacgagggggugauggccgugggccucgucagcauccuggccuccagccugcuccggaacgacgugcccauggccggcccccugguggccggcgggcugcucaucgccugcuacgucaucaccgggaccuccgccgaccugaccguggagaaggccgccgacgugacgugggaggaggaggcggagcagaccggggucagccacaaccugaugaucaccguggacgacgacgggaccaugcgcaucaaggacgacgagaccgagaacauccucacggugcugcugaagaccgcccuccugaucgucuccggcaucuucccguacagcauccccgccacccugcucguguggcacaccuggcagaagcagacgcagcgguccggcgugcugugggacguccccagcccgcccgagacccagaaggccgagcuggaggaggggguguaccgcaucaagcagcagggcaucuucgggaagacccaggugggcgucggggugcagaaggagggcguguuccacaccauguggcacgucacgcggggcgccgugcucaccuacaacgggaagcgccuggagcccaacugggcguccgugaagaaggaccugaucagcuacggcgggggcuggcggcucuccgcccaguggcagaagggggaggagguccaggugaucgccguggagcccggcaagaaccccaagaacuuccagaccaugcccggcaccuuccagacgaccaccggggagaucggcgccaucgcgcuggacuucaagcccgggaccagcggcagccccaucaucaaccgcgagggcaaggucguggggcuguacggcaacgggguggucacgaagaacggcggguacguguccggcaucgcccagaccaacgccgagagcgacggcccgacccccgagcuggaggaggagauguucaagaagcggaaccucaccaucauggaccugcaccccggguccggcaagacgcgcaaguaccugcccgccaucgugcgggaggccaucaagcgccggcuccgcacccugauccuggcgccgacccgggucguggccgccgagauggaggaggcccucaaggggcugcccauccgcuaccagaccacggccaccaagagcgagcacaccggccgggagaucguggaccugaugugccacgcgaccuucacgaugcgccuccugucccccguccgggugcccaacuacaaccugaucaucauggacgaggcccacuucaccgacccggccagcaucgccgcccgcggguacaucuccacccgggugggcaugggcgaggcggccgccaucuucaugaccgccacgccgcccgggaccgcggacgccuucccccagagcaacgccccgauccaggacgaggagcgcgacauccccgagcgcuccuggaacagcggcaacgaguggaucaccgacuucgccgggaagaccgucugguucgugcccuccaucaaggccggcaacgacaucgcgaacugccuccggaagaacgggaagaaggugauccagcugagccgcaagacguucgacaccgaguaccagaagaccaagcugaacgacugggacuucgucgugaccacggacaucuccgagaugggcgccaacuucaaggccgaccgggugaucgacccccgccggugccucaagccggucauccugaccgacggccccgagcgcgugauccuggccgggcccaugcccgugaccgccgcgagcgccgcccagcggcgcggccgggucgggcgcaacccgcagaaggagaacgaccaguacaucuucaccggccagccccucaacaacgacgaggaccacgcccacuggaccgaggccaagaugcugcuggacaacaucaacacgcccgaggggaucauccccgcccucuucgagccggagcgggagaaguccgccgccaucgacggcgaguaccgccugaagggcgagagccggaagaccuucguggagcugaugcgccgcggggaccuccccgucuggcuggcccacaagguggcguccgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacagcgacccccuggcccucaaggaguucaaggacuucgccgccggccgcaaguccaucgcgcuggaccuggucaccgagaucgggcgggugccgagccaccucgcccaccgcacccggaacgcccuggacaaccuggugaugcuccacaccagcgagcacggcgggaaggccuaccgccacgccgucgaggagcugcccgagacgauggagacccugcuccugcugggccucaugauccugcugaccgggggcgcgaugcuguuccugaucuccggcaaggggaucggcaagaccagcaucgggcugaucugcgugaucgccuccagcggcaugcucuggauggccgagaucccccugcaguggaucgccuccgccaucgugcuggaguucuucaugaugguccuccugaucccggagcccgagaagcagcggacgccccaggacaaccagcuggcguacguggugaucgggauccucacccuggccgccaucaucgccgccaacgagaugggccugcucgagaccaccaagcgcgaccugggcaugagcaaggagcccggggucguguccccgacgagcuaccuggacguggaccuccaccccgcguccgccuggacccuguacgccgucgccaccaccgugaucacgcccaugcugcggcacaccaucgagaacagcaccgcgaacgugucccucgccgccaucgccaaccaggccgucgugcugaugggccuggacaagggguggcccaucagcaagauggaccucggcgugccgcugcuggcgcucgggugcuacucccaggucaacccccugacccugacggccgccgugcuccugcugaucacccacuacgccaucaucggccccggccuccaggccaaggcgacccgcgaggcccagaagcggaccgccgccgggaucaugaagaaccccacgguggacggcaucaugaccaucgaccuggacccggucaucuacgacagcaaguucgagaagcagcugggccaggugaugcuccuggugcugugcgccguccagcuccugcugaugcgcaccuccugggcgcucugcgaggcccugacccuggccacgggccccaucaccacccucugggagggcagccccgggaaguucuggaacaccacgaucgccguguccauggcgaacaucuuccggggcagcuaccuggccggggccggccuggccuucuccaucaugaaguccguggggaccggcaagcgcggcaccgggagccagggcgagacccucggggagaaguggaagaagaagcugaaccagcugucccggaaggaguucgaccucuacaagaaguccggcaucaccgaggucgaccgcacggaggccaaggaggggcugaagcggggcgagaucacccaccacgcggugucccgcggcagcgccaagcugcagugguucguggagcggaacauggucauccccgaggggcgcgugaucgaccucggcugcgggcggggcgggugguccuacuacugcgccggccugaagaaggugaccgagguccgcggcuacaccaagggcgggccggggcacgaggagcccgugcccaugagcacguacggcuggaacaucgugaagcugauguccgggaaggacgucuucuaccucccgcccgagaagugcgacacccugcugugcgacaucggcgagagcucccccagccccaccguggaggagucccggaccauccgcgugcugaagauggucgagcccuggcucaagaacaaccaguucugcaucaaggugcugaaccccuacaugcccacggugaucgagcaccuggagcgccuccagcggaagcacggcgggaugcugguccgcaacccccugagccggaacuccacccacgagauguacuggaucagcaacggcaccgggaacaucguggccuccgugaacauggucagccgccuccugcugaaccgguucaccaugacgcaccgccggcccaccaucgagaaggacguggaccucggcgccggcacccgccacgugaacgcggagccggagacccccaacauggacgucaucggggagcggaucaagcgcaucaaggaggagcacaacuccacguggcacuacgacgacgagaaccccuacaagaccugggccuaccacggcagcuacgaggugaaggccaccggguccgccagcagcaugaucaacggcgucgugaagcugcugaccaagccgugggacgugguccccauggugacgcagauggccaugaccgacaccacccccuucgggcagcagcggguguucaaggagaaggucgacacgcgcacgccccgguccaugccgggcacccgccgggugaugggcaucaccgcggaguggcucuggcgcacgcuggggcggaacaagaagccccgccugugcacccgggaggaguucaccaagaaggugcgcaccaacgccgccaugggcgccgucuucacggaggagaaccagugggacagcgcgaaggccgccguggaggacgaggacuucuggauccucguggaccgcgagcgggagcugcacaagcuggggaagugcggcuccugcgucuacaacaugauggggaagcgcgagaagaagcucggcgaguucggcaaggccaaggggagccgggccaucugguacauguggcugggcgcgcgcuaccuggaguucgaggcccucggguuccugaacgaggaccacugguucucccgggagaacagcuacuccggcguggagggggagggccugcacaagcucggcuacauccugcgcgacaucagcaagauccccgggggcgccauguacgccgacgacaccgccgggugggacacccggaucaccgaggacgaccugcacaacgaggagaagaucacgcagcagauggaccccgagcaccgccagcucgcgaacgccaucuucaagcugaccuaccagaacaagguggucaaggugcagcggccgacccccaccggcaccgugauggacaucaucucccgcaaggaccagcggggcagcgggcaggucggcacguacgggcugaacaccuucaccaacauggaggcccagcucauccgccagauggagggcgagggggugcuguccaaggccgaccuggagaacccccaccuccccgagaagaagaucacccaguggcuggagacgaagggcguggagcggcugaagcgcauggccaucagcggcgacgacugcgucgugaagccgaucgacgaccgguucgcgaacgcccuccuggcccugaacgacauggggaaggugcgcaaggacaucccccaguggcagcccuccaagggcuggcacgacuggcagcagguccccuucugcagccaccacuuccacgagcucaucaugaaggacgggcggaagcugguggugccgugccgcccccaggacgagcugaucggccgggcccgcaucucccagggggccggcuggagccuccgggagaccgcgugccugggcaaggccuacgcccagauguggucccugauguacuuccaccgccgcgaccuccggcuggccagcaacgcgaucugcuccgccguccccgugcacugggugcccaccagccgcaccacguggagcauccacgcccaccaccaguggaugaccaccgaggacaugcugaccgucuggaaccggguguggaucgaggacaacccguggauggaggacaagacgcccgugaccaccugggagaacguccccuaccucgggaagcgcgaggaccaguggugcggcucccugaucgggcugaccagccgggccacgugggcccagaacauccccaccgcgauccagcagguccgcucccucaucggcaacgaggaguuccuggacuacaugccgagcaugaagcgguuccgcaaggaggaggaguccgagggggccaucugguga

SEQ ID NO: 10192 - RNA, 9873 nt, Artificial Sequence
  derived and/or modified CDS sequence (opt1) from DENV-3__FJ547076__SS-prME
accagccugugccucaugaugauccugcccgccgcccuggcguuccaccucaccagccgggacggggagccccggaugaucguggggaagaacgagcgcggcaagagccugcuguucaagacggccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccgucuccgagaaggaggagaacauggucaagagccugguguccgccggcagcgggaaggucgacaacuucacgaugggcgugcugugccucgccauccuguucgaggaggugaugcgggggaaguucggcaagaagcacaugaucgcgggggucuucuucaccuucgugcugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgucggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccguggccuggcgcacggccacccugauccucgcgggggucagccugcugccggugugccaguccagcuccaugcggaagaccgacuggcuccccaugaccguggccgccaugggcgugccgccccucccgcuguucaucuucagccucaaggacacgcugaagcgccgcuccuggccccugaacgagggggugauggccgugggccucgucagcauccuggccuccagccugcuccggaacgacgugcccauggcgggcccccugguggccgggggccugcucaucgccugcuacgucaucaccgggaccuccgccgaccugaccguggagaaggccgcggacgugacgugggaggaggaggccgagcagaccggcgucagccacaaccugaugaucaccguggacgacgacgggaccaugcgcaucaaggacgacgagaccgagaacauccucacggugcugcugaagaccgcccuccugaucgucuccggcaucuucccguacagcauccccgccacccugcucguguggcacaccuggcagaagcagacgcagcgguccggcgugcugugggacguccccagcccgcccgagacccagaaggccgagcuggaggaggggguguaccgcaucaagcagcagggcaucuucgggaagacccaggugggcgucggggugcagaaggagggcguguuccacaccauguggcacgucacgcggggcgcggugcucaccuacaacgggaagcgccuggagcccaacugggccuccgugaagaaggaccugaucagcuacggcgggggcuggcggcucuccgcccaguggcagaagggggaggagguccaggugaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaaggucguggggcuguacggcaacgggguggucacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccgggucguggccgccgagauggaggaggcccucaaggggcugcccauccgcuaccagaccacggcgaccaaguccgagcacaccggccgggagaucguggaccugaugugccacgccaccuucacgaugcgccuccugagccccguccgggugccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgucugguucgugcccagcaucaaggcgggcaacgacaucgccaacugccuccggaagaacgggaagaaggugauccagcugucccgcaagacguucgacaccgaguaccagaagaccaagcugaacgacugggacuucgucgugaccacggacaucagcgagaugggcgccaacuucaaggccgaccgggugaucgacccgcgccggugccucaagcccgucauccugaccgacggccccgagcgcgugauccuggccgggcccaugccggugaccgcggccuccgccgcccagcggcgcggccgggucgggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcgcacaagguggccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggucaccgagaucgggcgggugcccucccaccucgcccaccgcacccggaacgcccuggacaaccuggugaugcuccacaccagcgagcacggcgggaaggccuaccgccacgcggucgaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucgugcuggaguucuucaugaugguccuccugauccccgagcccgagaagcagcggacgccccaggacaaccagcuggccuacguggugaucgggauccucacccuggccgccaucaucgccgcgaacgagaugggccugcucgagaccaccaagcgcgaccugggcauguccaaggagccgggggucgugagccccacguccuaccuggacguggaccuccaccccgccagcgccuggacccuguacgccgucgcgaccaccgugaucacgcccaugcugcggcacaccaucgagaacuccaccgccaacgugagccucgccgccaucgccaaccaggcggucgugcugaugggccuggacaagggguggccgaucuccaagauggaccucggcgugccccugcuggcccucgggugcuacagccaggucaacccccugacccugacggccgccgugcuccugcugaucacccacuacgccaucaucggccccggccuccaggcgaaggccacccgcgaggcccagaagcggaccgccgccgggaucaugaagaacccgacgguggacggcaucaugaccaucgaccuggaccccgucaucuacgacuccaaguucgagaagcagcugggccaggugaugcuccuggugcugugcgcgguccagcuccugcugaugcgcaccagcugggcccucugcgaggcccugacccuggccacgggccccaucaccacccucugggagggcucccccgggaaguucuggaacaccacgaucgcggugagcauggccaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggaguucgaccucuacaagaaguccggcaucaccgaggucgaccgcacggaggcgaaggaggggcugaagcggggcgagaucacccaccacgccgugagccgcggcuccgccaagcugcagugguucguggagcggaacauggucaucccggaggggcgcgugaucgaccucggcugcgggcggggcggguggagcuacuacugcgccggccugaagaaggugaccgagguccgcggcuacaccaagggcgggcccgggcacgaggagcccgugcccauguccacguacggcuggaacaucgugaagcugaugagcgggaaggacgucuucuaccucccgcccgagaagugcgacacccugcugugcgacaucggcgaguccagccccucccccaccguggaggagagccggaccauccgcgugcugaagauggucgagccguggcucaagaacaaccaguucugcaucaaggugcugaaccccuacaugcccacggugaucgagcaccuggagcgccuccagcggaagcacggcgggaugcugguccgcaacccccugucccggaacagcacccacgagauguacuggaucuccaacggcaccgggaacaucguggccagcgugaacauggucucccgccuccugcugaaccgguucaccaugacgcaccgccggccgaccaucgagaaggacguggaccucggcgcgggcacccgccacgugaacgccgagcccgagacccccaacauggacgucaucggggagcggaucaagcgcaucaaggaggagcacaacagcacguggcacuacgacgacgagaacccguacaagaccugggccuaccacggcuccuacgaggugaaggccaccgggagcgccuccagcaugaucaacggcgucgugaagcugcugaccaagcccugggacgugguccccauggugacgcagauggcgaugaccgacaccacccccuucgggcagcagcggguguucaaggagaaggucgacacgcgcaccccgcggagcaugcccggcacccgccgggugaugggcaucaccgccgaguggcucuggcgcacgcuggggcggaacaagaagccccgccugugcacccgggaggaguucaccaagaaggugcgcaccaacgccgccaugggcgcggucuucacggaggagaaccagugggacuccgccaaggccgccguggaggacgaggacuucuggaagcucguggaccgcgagcgggagcugcacaagcuggggaagugcggcagcugcgucuacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgccgacgacaccgcggggugggacacccggaucaccgaggacgaccugcacaacgaggagaagaucacgcagcagauggacccggagcaccgccagcucgccaacgccaucuucaagcugaccuaccagaacaagguggucaaggugcagcggcccacccccaccggcaccgugauggacaucaucagccgcaaggaccagcggggcuccgggcaggucggcacguacgggcugaacaccuucaccaacauggaggcccagcucauccgccagauggagggcgagggggugcugagcaaggccgaccuggagaacccccaccucccggagaagaagaucacccaguggcuggagacgaagggcguggagcggcugaagcgcauggcgaucuccggcgacgacugcgucgugaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcugguggugcccugccgcccccaggacgagcugaucggccgggcccgcaucagccagggggcgggcuggucccuccgggagaccgccugccugggcaaggccuacgcccagauguggagccugauguacuuccaccgccgcgaccuccggcuggcguccaacgccaucugcagcgccguccccgugcacugggugccgaccucccgcaccacguggagcauccacgcccaccaccaguggaugaccaccgaggacaugcugaccgucuggaaccggguguggaucgaggacaaccccuggauggaggacaagacgcccgugaccaccugggagaacguccccuaccucgggaagcgcgaggaccaguggugcggcagccugaucgggcugaccucccgggccacgugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10193 - RNA, 9873 nt, Artificial Sequence
  derived and/or modified CDS sequence (opt1) from DENV-3__FJ547077__SS-prME
accagccugugccucaugaugauccugcccgccgcccuggcguuccaccucaccagccgggacggggagccccggaugaucguggggaagaacgagcggggcaagagccugcuguucaagacggccuccgggaucaacaugugcacccucaucgccauggaccugggggagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgugacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgcgucccgggccuggaacgucugggagguggaggacuacggguucggcguguucaccaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccguggucaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcgggaagguggacaacuucacgaugggcgugcugugccucgcgauccuguucgaggaggucaugcgggggaaguucggcaagaagcacaugaucgccgggguguucuucaccuucgugcugcuccuguccggccagaucaccuggcgcgacauggcccacacccugaucaugaucggcagcaacgccuccgaccggauggggaugggcgucacguaccucgcccugaucgcgaccuucaagauccagcccuuccuggcccucggguucuuccugcgcaagcugaccagccgggagaaccuccugcugggcgugggccucgccauggccaccacgcugcagcugcccgaggacaucgagcagauggcgaacgggaucgcccucggccugauggcccugaagcucaucacccaguucgagaccuaccagcuguggaccgcccugaucagccucacgugcuccaacaccaucuucacccugaccguggccuggcgcacggcgacccugauccucgccggggucagccugcugccggugugccaguccagcuccaugcggaagaccgacuggcuccccaugaccgucgccgccaugggcgugccgccccucccgcuguucaucuucagccucaaggacacgcugaagcgccgcuccuggccccugaacgagggggugauggccgucggccucgugagcauccuggcguccagccugcuccggaacgacgugcccauggccggcccccuggucgccgggggccugcucaucgccugcuacgugaucaccgggaccuccgccgaccugaccguggagaaggcggccgacgucacgugggaggaggaggccgagcagaccggcgugagccacaaccugaugaucaccguggacgacgacgggaccaugcgcaucaaggacgacgagaccgagaacauccucacgguccugcugaagaccgcccuccugaucguguccggcaucuucccguacagcauccccgccacccugcucguguggcacaccuggcagaagcagacgcagcgguccggcguccugugggacgugcccagcccgcccgagacccagaaggcggagcuggaggaggggguguaccgcaucaagcagcagggcaucuucgggaagacccaggucggcgugggggugcagaaggagggcgucuuccacaccauguggcacgugacgcggggcgccgugcucaccuacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccaugcccggcaccuuccagacgaccaccggggagaucggcgccaucgcccuggacuucaagcccgggaccagcggcagccccaucaucaaccgcgagggcaaggugguggggcuguacggcaacggggucgugacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggcgaucguccgggaggccaucaagcgccggcuccgcacccugauccuggcccccacccgggugguggccgccgagauggaggaggcgcucaaggggcugcccauccgcuaccagaccacggccaccaaguccgagcacaccggccgggagaucgucgaccugaugugccacgccaccuucacgaugcgccuccugagccccgugcgggugccgaacuacaaccugaucaucauggacgaggcccacuucaccgaccccgccuccaucgcggcccgcggguacaucagcacccgggucggcaugggcgaggccgccgcgaucuucaugaccgccacgccgcccgggaccgccgacgccuucccgcaguccaacgcccccauccaggacgaggagcgcgacauccccgagcgcagcuggaacuccggcaacgaguggaucaccgacuucgcggggaagaccgugugguucgugcccagcaucaaggccggcaacgacaucgccaacugccuccggaagaacgggaagaaggucauccagcugucccgcaagacguucgacaccgaguaccagaagaccaagcugaacgacugggacuucguggugaccacggacaucagcgagaugggcgccaacuucaaggccgaccgggucaucgacccgcgccggugccucaagcccgugauccugaccgacggccccgagcgcgugauccuggcggggcccaugccggucaccgccgccuccgccgcccagcggcgcggccggguggggcgcaacccccagaaggagaacgaccaguacaucuucaccggccagccccucaacaacgacgaggaccacgcgcacuggaccgaggccaagaugcugcuggacaacaucaacacgcccgaggggaucaucccggcccucuucgagcccgagcgggagaaguccgccgcgaucgacggcgaguaccgccugaagggcgagucccggaagaccuucguggagcugaugcgccgcggggaccuccccgucuggcuggcccacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcacguacuccgacccgcuggcccucaaggaguucaaggacuucgcggccggccgcaagagcaucgcccuggaccuggugaccgagaucgggcgggugcccucccaccucgcccaccgcacccggaacgcccuggacaaccuggucaugcuccacaccagcgagcacggcgggaaggcguaccgccacgccguggaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgcgagcgccaucguccuggaguucuucaugauggugcuccugauccccgagcccgagaagcagcggacgccccaggacaaccagcuggccuacguggucaucgggauccucacccuggccgccaccaucgcggccaacgagaugggccugcucgagaccacgaagcgcgaccugggcauguccaaggagccggggguggugagccccaccuccuaccuggacgucgaccuccaccccgccagcgccuggacccuguacgcgguggccaccacggugaucacccccaugcugcggcacaccaucgagaacuccaccgccaacgucagccucgccgccaucgcgaaccaggccguggugcugaugggccuggacaagggguggccgaucuccaagauggaccucggcgucccccugcuggcccucgggugcuacagccaggugaacccccugacgcugaccgccgccgugcuccugcugaucacccacuacgcgaucaucggccccggccuccaggccaaggccacccgcgaggcccagaagcggacggccgcggggaucaugaagaacccgaccgucgacggcaucaugaccaucgaccuggaccccgugaucuacgacuccaaguucgagaagcagcugggccaggugaugcuccugguccugugcgccgugcagcuccugcugaugcgcaccagcugggcccucugcgaggcccugacgcuggcgaccggccccaucaccacccucugggagggcucccccgggaaguucuggaacacgaccaucgccgugagcauggccaacaucuuccggggcuccuaccuggccggggccggccuggcguucagcaucaugaaguccgucgggaccggcaagcgcggcaccgggagccagggcgagacccucggggagaaguggaagaagaagcugaaccagcugagccggaaggaguucgaccucuacaagaaguccggcaucacggagguggaccgcaccgaggccaaggaggggcugaagcggggcgagaucacccaccacgccgugagccgcggcuccgccaagcugcagugguucgucgagcggaacauggugaucccggaggggcgcgugaucgaccucggcugcgggcggggcggguggagcuacuacugcgccggccugaagaaggucaccgaggugcgcggcuacacgaagggcgggcccgggcacgaggagcccgugcccauguccaccuacggcuggaacaucgucaagcugaugagcgggaaggacguguucuaccucccgcccgagaagugcgacacccugcugugcgacaucggcgaguccagccccucccccaccguggaggagagccggacgauccgcguccugaagaugguggagccguggcucaagaacaaccaguucugcaucaaggugcugaaccccuacaugcccaccgucaucgagcaccuggagcgccuccagcggaagcacggcgggaugcuggugcgcaacccccugucccggaacagcacccacgagauguacuggaucuccaacggcaccgggaacaucguggcgagcgucaacauggugucccgccuccugcugaaccgguucacgaugacccaccgccggccgaccaucgagaaggacguggaccucggcgccggcacccgccacgucaacgccgagcccgagacgcccaacauggacgugaucggggagcggaucaagcgcaucaaggaggagcacaacagcaccuggcacuacgacgacgagaacccguacaagaccugggccuaccacggcuccuacgaggugaaggccaccgggagcgcguccagcaugaucaacggcgucgugaagcugcugacgaagcccugggacgucgugcccauggugacccagauggccaugaccgacaccacgcccuucgggcagcagcgggucuucaaggagaagguggacacccgcaccccgcggagcaugcccggcacccgccgggugaugggcaucacggccgaguggcucuggcgcacccuggggcggaacaagaagccccgccugugcacccgggaggaguucaccaagaagguccgcacgaacgccgcgaugggcgccguguucaccgaggagaaccagugggacuccgccaaggccgccguggaggacgaggacuucuggaagcucgucgaccgcgagcgggagcugcacaagcuggggaagugcggcagcugcguguacaacaugauggggaagcgcgagaagaagcucggcgaguucggcaaggcgaaggggucccgggccaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgcggacgacaccgccgggugggacacccggaucacggaggacgaccugcacaacgaggagaagaucacccagcagauggacccggagcaccgccagcucgccaacgccaucuucaagcugaccuaccagaacaaggucgugaaggugcagcggcccacccccaccggcacggucauggacaucaucagccgcaaggaccagcggggcuccggccaggugggcaccuacgggcugaacaccuucaccaacauggaggcccagcucauccgccagauggagggcgagggggugcugagcaaggcggaccuggagaacccccaccucccggagaagaagaucacgcaguggcuggagaccaagggcgucgagcggcugaagcgcauggccaucuccggcgacgacugcguggugaagcccaucgacgaccgguucgccaacgcccuccuggcccugaacgacauggggaagguccgcaaggacaucccccaguggcagcccagcaagggcuggcacgacuggcagcaggucccguucugcucccaccacuuccacgagcucaucaugaaggacgggcggaagcuggugguccccugccgcccccaggacgagcugaucggccgggcgcgcaucagccagggggccggcuggucccuccgggagaccgccugccugggcaaggccuacgcgcagauguggaaccugauguacuuccaccgccgcgaccuccggcuggccagcaacgccaucugcuccgccgugcccgugcacugggucccgaccagccgcacgaccugguccauccacgcccaccaccaguggaugaccaccgaggacaugcugacgguguggaaccggguguggaucgaggacaaccccuggauggaggacaagacccccgucaccaccugggagaacgugcccuaccucgggaagcgcgaggaccaguggugcggcagccugaucgggcugacgagccgggcgaccugggcccagaacaucccgaccgccauccagcagguccgcucccucaucggcaacgaggaguuccuggacuacaugcccagcaugaagcgguuccgcaaggaggaggaguccgagggggccaucugguga

SEQ ID NO: 10194 - RNA, 9873 nt, Artificial Sequence
  derived and/or modified CDS sequence (opt1) from DENV-3__FJ547078__SS-prME
accagccucugccucaugaugauccugcccgccgcccuggcguuccaccucaccagccgggacggggagccgcggaugaucguggggaagaacgagcggggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgugacgcccagcaugaccaugcggugcgugggggugggcaaccgcgacuucgucgagggccuguccggggccaccuggaucgacguggugcuggagcacggcgggugcgucaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacaccgugaucaucacggugcacaccggggaccagcaccaggucggcaacgagacccagggggugaccgccgagaucacgccccaggccagcaccaccgaggcgauccugcccgaguacggcacccuggggcucgagugcuccccgcgcaccggccuggacuucaacgagaugauccugcucacgaugaagaacaaggccuggaugguccaccggcagugguucuucgaccugccccugcccuggaccagcggcgccaccaccgagacgcccaccuggaaccgcaaggagcuccuggugaccuucaagaacgcccacgccaagaagcaggagguggucgugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucgugcugaagaaggaggucuccgagacccagcacgggaccauccucaucaagguggaguacaagggcgaggacgugccgugcaagauccccuucagcaccgaggacgggcagggcaaggcgcacaacggccgccugaucacggccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacaccgccugggacuucggguccgugggcggggugcucaacagccugggcaagaugguccaccagaucuucggguccgcguacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggccgacauggggugcgucaucaacuggaagggcaaggagcugaagugcggcagcgggaucuucgugacgaacgaggugcacaccuggaccgagcaguacaaguuccaggcggacucccccaagcgccucgccaccgccaucgccggcgccugggagaacggggucugcggcauccgcagcacgacccggauggagaaccugcuguggaagcagaucgcgaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgccucccgggcguggaacgucugggagguggaggacuacggguucggcguguucaccaccaacaucuggcucaagcugcgcgaggucuacacccagcugugcgaccaccggcucaugagcgccgccgugaaggacgagcgcgccgugcacgccgacaugggcuacuggaucgagagccagaagaacggguccuggaagcuggagaaggcgagccugaucgaggucaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccguggucaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcgggaagguggacaacuucacgaugggcgugcugugccucgccauccuguucgaggaggucaugcgggggaaguucggcaagaagcacaugaucgcggggguguucuucaccuucgugcugcuccuguccggccagaucaccuggcgcgacauggcccacacccugaucaugaucggcagcaacgccuccgaccggauggggaugggcgucacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaucuaccagcuguggaccgcccugaucagccugaccugcuccaacacgaucuucacccugaccguggccuggcgcaccgccacgcugauccucgcgggggucagccugcugccggugugccaguccagcuccaugcggaagaccgacuggcuccccaugaccgucgccgccaugggcgugccgccccucccgcuguucaucuucagccucaaggacacccugaagcgccgcuccuggccccugaacgagggggugauggccgucggccucgugagcauccuggccuccagccugcuccggaacgacgugcccauggcgggcccccuggucgccgggggccugcucaucgccugcuacgugaucacggggaccuccgccgaccugaccguggagaaggccgcggacgucaccugggaggaggaggccgagcagacgggcgugagccacaaccugaugaucaccguggacgacgacgggaccaugcgcaucaaggacgacgagaccgagaacauccucaccguccugcugaagacggcccuccugaucguguccggcaucuucccguacagcauccccgccacccugcucguguggcacaccuggcagaagcagacccagcgguccggcguccugugggacgugcccagcccgcccgagacgcagaaggccgagcuggaggaggggguguaccgcaucaagcagcagggcaucuucgggaagacccaggucggcgugggggugcagaaggagggcgucuuccacaccauguggcacgugacccggggcgcggugcucacguacaacgggaagcgccuggagcccaacugggccuccgucaagaaggaccugaucagcuacggcgggggcuggcggcucuccgcccaguggcagaagggggaggagguccaggugaucgccgucgagcccggcaagaaccccaagaacuuccagaccaugcccggcaccuuccagaccacgaccggggagaucggcgcgaucgcccuggacuucaagcccgggaccagcggcagccccaucaucaaccgcgagggcaaggugguggggcuguacggcaacggggucgugaccaagaacggcggguacguguccggcaucgcccagacgaacgccgagccggacggccccacccccgagcuggaggaggagauguucaagaagcggaaccucaccaucauggaccugcaccccgggagcggcaagacccgcaaguaccugccggccaucguccgggaggcgaucaagcgccggcuccgcacgcugauccuggcccccacccgggugguggccgccgagauggaggaggcccucaaggggcugcccauccgcuaccagaccaccgcgacgaaguccgagcacaccggccgggagaucgucgaccugaugugccacgccaccuucaccaugcgccuccugagccccgugcgggugccgaacuacaaccugaucaucauggacgaggcccacuucacggaccccgccuccaucgccgcgcgcggguacaucagcacccgggucggcaugggcgaggccgccgccaucuucaugaccgcgacgccgcccgggacggccgacgccuucccgcaguccaacgcccccauccaggacgaggagcgcgacauccccgagcgcagcuggaacuccggcaacgaguggaucaccgacuucgccgggaagaccgugugguucgugcccagcaucaaggcgggcaacgacaucgccaacugccuccggaagaacgggaagaaggucauccagcugucccgcaagaccuucgacacggaguaccagaagaccaagcugaacgacugggacuucguggugaccaccgacaucagcgagaugggcgccaacuucaaggccgaccgggucaucgacccgcgccggugccucaagcccgugauccugacggacggccccgagcgcgugauccuggccgggcccaugccggucaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacccccgaggggaucaucccggcccucuucgagcccgagcgggagaaguccgccgccaucgacggcgaguaccgccugaagggcgagucccggaagacguucguggagcugaugcgccgcggggaccuccccgucuggcuggcgcacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcaccuacuccgacccgcuggcccucaaggaguucaaggacuucgccgcgggccgcaagagcaucgcccuggaccuggugacggagaucgggcgggugcccucccaccucgcccaccgcacccggaacgcccuggacaaccuggucaugcuccacaccagcgagcacggcgggaaggccuaccgccacgcgguggaggagcugcccgagaccauggagacgcugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucguccuggaguucuucaugauggugcuccugauccccgagcccgagaagcagcggacgccccaggacaaccagcuggccuacguggucaucgggauccucacgcuggccgccaucaucgccgcgaacgagaugggccugcucgagaccaccaagcgcgaccugggcauguccaaggagccggggguggugagccccaccuccuaccuggacgucgaccuccaccccgccagcgccuggacgcuguacgccguggcgaccaccgugaucacccccaugcugcggcacacgaucgagaacuccaccgccaacgucagccucgccgccaucgccaaccaggcgguggugcugaugggccuggacaagggguggccgaucuccaagauggaccucggcgucccccugcuggcccucgggugcuacagccaggugaacccccugacccugaccgccgccgugcuccugcugaucacgcacuacgccaucaucggccccggccuccaggcgaaggccacccgcgaggcccagaagcggaccgccgccgggaucaugaagaacccgaccgucgacggcaucaugacgaucgaccuggaccccgugaucuacgacuccaaguucgagaagcagcugggccaggugaugcuccugguccugugcgcggugcagcuccugcugaugcgcaccagcugggcccucugcgaggcccugacccuggccaccggccccaucacgacccucugggagggcucccccgggaaguucuggaacaccaccaucgcggugagcauggccaacaucuuccggggcuccuaccuggccggggccggccuggccuucagcaucaugaaguccgucgggacgggcaagcgcggcaccgggagccagggcgagacccucggggagaaguggaagaagaagcugaaccagcugagccggaaggaguucgaccucuacaagaaguccggcaucaccgagguggaccgcaccgaggcgaaggaggggcugaagcggggcgagaucacgcaccacgccgugagccgcggcuccgccaagcugcagugguucgucgagcggaacauggugaucccggaggggcgcgugaucgaccucggcugcgggcggggcggguggagcuacuacugcgccggccugaagaaggucaccgaggugcgcggcuacaccaagggcgggcccgggcacgaggagcccgugcccauguccaccuacggcuggaacaucgucaagcugaugagcgggaaggacguguucuaccucccgcccgagaagugcgacacgcugcugugcgacaucggcgaguccagccccucccccaccguggaggagagccggaccauccgcguccugaagaugguggagccguggcucaagaacaaccaguucugcaucaaggugcugaaccccuacaugcccaccgucaucgagcaccuggagcgccuccagcggaagcacggcgggaugcuggugcgcaacccccugucccggaacagcacgcacgagauguacuggaucuccaacggcaccgggaacaucguggccagcgucaacauggugucccgccuccugcugaaccgguucaccaugacccaccgccggccgacgaucgagaaggacguggaccucggcgcgggcacccgccacgucaacgccgagcccgagacccccaacauggacgugaucggggagcggaucaagcgcaucaaggaggagcacaacagcaccuggcacuacgacgacgagaacccguacaagacgugggccuaccacggcuccuacgaggugaaggccaccgggagcgccuccagcaugaucaacggcgucgugaagcugcugaccaagcccugggacgucgugcccauggugacccagauggcgaugacggacaccacccccuucgggcagcagcgggucuucaaggagaagguggacacccgcacgcccaagagcaugcccggcacccggcgcgugaugggcaucaccgccgaguggcucuggcggacccuggggcgcaacaagaagccccggcugugcacgcgcgaggaguucaccaagaagguccggaccaacgccgccaugggcgcgguguucaccgaggagaaccagugggacuccgccaaggccgccguggaggacgaggacuucuggaagcucgucgaccgcgagcgcgagcugcacaagcuggggaagugcggcagcugcguguacaacaugauggggaagcgggagaagaagcucggcgaguucggcaaggccaaggggucccgcgcgaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgccgacgacacggcggggugggacacccgcaucaccgaggacgaccugcacaacgaggagaagaucacccagcagauggacccggagcaccggcagcucgccaacgccaucuucaagcugacguaccagaacaaggucgugaaggugcagcgccccacccccaccggcaccgucauggacaucaucagccggaaggaccagcgcggcuccggccaggugggcaccuacgggcugaacacguucaccaacauggaggcccagcucauccggcagauggagggcgagggggugcugagcaaggccgaccuggagaacccccaccucccggagaagaagaucacccaguggcuggagaccaagggcgucgagcgccugaagcggauggcgaucuccggcgacgacugcguggugaagcccaucgacgaccgcuucgccaacgcccuccuggcccugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcccggaucagccagggggcgggcuggucccuccgcgagacggccugccugggcaaggccuacgcccagauguggagccugauguacuuccaccggcgcgaccuccgccuggcguccaacgccaucugcagcgccgugcccgugcacugggucccgaccucccggaccaccuggagcauccacgcccaccaccaguggaugacgaccgaggacaugcugaccguguggaaccgcguguggaucgaggacaaccccuggauggaggacaagacccccgucacgaccugggagaacgugcccuaccucgggaagcgggaggaccaguggugcggcagccugaucgggcugaccucccgcgccaccugggcgcagaacaucccgacggccauccagcagguccggagccucaucggcaacgaggaguuccuggacuacaugcccuccaugaagcgcuuccggaaggaggaggagagcgagggggccaucugguga

SEQ ID NO: 10195 - RNA, 9873 nt, Artificial Sequence
  derived and/or modified CDS sequence (opt1) from DENV-3__FJ547079__SS-prME
accagccugugccucaugaugauccugcccgccgcccuggcguuccaccucaccagccgggacggggagccccggaugaucguggggaagaacgagcggggcaagagccugcuguucaagacggccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcacaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaaguccgagcacaccggccgggagaucguggaccugaugugccacgccaccuucacgaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucguccccagcaucaaggcgggcaacgacaucgccaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggugaccgagaucgggcggguccccucccaccucgcccaccgcacccggaacgcccuggacaaccuggugaugcuccacaccagcgagcacggcgggaaggccuaccgccacgcgguggaggagcugcccgagacgauggagacccugcuccugcugggccucaugauccugcugaccgggggcgccaugcuguuccugaucagcggcaaggggaucggcaagaccuccaucgggcugaucugcgucaucgccagcuccggcaugcucuggauggccgagaucccgcugcaguggaucgccagcgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccaccaagcgcgaccugggcauguccaaggagccggggguggucagccccacguccuaccuggacguggaccuccaccccgccagcgccuggacccuguacgccguggcgaccaccgucaucacgcccaugcugcggcacaccaucgagaacuccaccgccaacgugagccucgccgccaucgccaaccaggcggugguccugaugggccuggacaagggguggccgaucuccaagauggaccucggcgugccccugcuggcccucgggugcuacagccaggugaacccccugacccugacggccgccguccuccugcugaucacccacuacgccaucaucggccccggccuccaggcgaaggccacccgcgaggcccagaagcggaccgccgccgggaucaugaagaacccgacgguggacggcaucaugaccaucgaccuggaccccgugaucuacgacuccaaguucgagaagcagcuggggcaggucaugcuccuggugcugugcgcggugcagcuccugcugaugcgcaccagcugggcccucugcgaggcccugacccuggccacgggccccaucaccacccucugggagggcucccccgggaaguucuggaacaccacgaucgcggucagcauggccaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggaguucgaccucuacaagaaguccggcaucaccgagguggaccgcacggaggcgaaggaggggcugaagcggggcgagaucacccaccacgccgucagccgcggcuccgccaagcugcagugguucguggagcggaacauggugaucccggaggggcgcgucaucgaccucggcugcgggcggggcggguggagcuacuacugcgccggccugaagaaggugaccgaggugcgcggcuacaccaagggcgggcccgggcacgaggagcccguccccauguccacguacggcuggaacaucgugaagcugaugagcgggaaggacguguucuaccucccgcccgagaagugcgacacccugcugugcgacaucggcgaguccagccccucccccaccgucgaggagagccggaccauccgcgugcugaagaugguggagccguggcucaagaacaaccaguucugcaucaagguccugaaccccuacaugcccacggugaucgagcaccuggagcgccuccagcggaagcacggcgggaugcuggugcgcaacccccugucccggaacagcacccacgagauguacuggaucuccaacggcaccgggaacaucgucgccagcgugaacauggugucccgccuccugcugaaccgguucaccaugacgcaccgccggccgaccaucgagaaggacgucgaccucggcgcgggcacccgccacgugaacgccgagcccgagacccccaacauggacgugaucggggagcggaucaagcgcaucaaggaggagcacaacagcacguggcacuacgacgacgagaacccguacaagaccugggccuaccacggcuccuacgaggucaaggccaccgggagcgccuccagcaugaucaacggcguggucaagcugcugaccaagcccugggacguggugcccauggucacgcagauggcgaugaccgacaccacccccuucgggcagcagcggguguucaaggagaagguggacacgcgcaccccgcggagcaugcccggcacccgccgggucaugggcaucaccgccgaguggcucuggcgcacgcuggggcggaacaagaagccccgccugugcacccgggaggaguucaccaagaaggugcgcaccaacgccgccaugggcgcgguguucacggaggagaaccagugggacuccgccaaggccgccgucgaggacgaggacuucuggaagcucguggaccgcgagcgggagcugcacaagcuggggaagugcggcagcugcguguacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcgucgagggggagggccugcacaagcucggcuacauccugcgcgacaucuccaagauccccgggggcgccauguacgccgacgacaccgcggggugggacacccggaucaccgaggacgaccugcacaacgaggagaagaucacgcagcagauggacccggagcaccgccagcucgccaacgccaucuucaagcugaccuaccagaacaagguggugaagguccagcggcccacccccaccggcaccgugauggacaucaucagccgcaaggaccagcggggcuccggccaggugggcacguacgggcugaacaccuucaccaacauggaggcccagcucauccgccagauggagggcgaggggguccugagcaaggccgaccuggagaacccccaccucccggagaagaagaucacccaguggcuggagacgaagggcguggagcggcugaagcgcauggcgaucuccggcgacgacugcguggucaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcuggucgugcccugccgcccccaggacgagcugaucggccgggcccgcaucagccagggggcgggcuggucccuccgggagaccgccugccugggcaaggccuacgcccagauguggagccugauguacuuccaccgccgcgaccuccggcuggcguccaacgccaucugcagcgccgugcccguccacugggugccgaccucccgcaccacguggagcauccacgcccaccaccaguggaugaccaccgaggacaugcugaccguguggaaccgggucuggaucgaggacaaccccuggauggaggacaagacgcccgugaccaccugggagaacgugcccuaccucgggaagcgcgaggaccaguggugcggcagccugaucgggcugaccucccgggccacgugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10196 - RNA, 9873 nt, Artificial Sequence
  derived and/or modified CDS sequence (opt1) from DENV-3__FJ547080__SS-prME
accagccugugccucaugaugauccugcccgcggcgcuggcguuccaccucaccagccgggacggcgagccccggaugaucguggggaagaacgagcgcggcaagagccugcuguucaagacggccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcagcacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgugaucgggaucaucacccucuaccugggcgccgucgugcaggccgacauggggugcgugaucaacuggaagggcaaggagcugaagugcggcagcgggaucuucgucacgaacgaggugcacaccuggaccgagcaguacaaguuccaggccgacucccccaagcgccucgcgaccgccaucgccggcgccugggagaacggggugugcggcauccgcagcacgacccggauggagaaccugcuguggaagcagaucgccaacgagcucaacuacauccugugggagaacaacaucaagcugaccgucguggugggggacaucaucggcguccucgagcagggcaagcgcacccugacgccccagccgauggagcugaaguacuccuggaagaccugggggaaggcgaagaucgugaccgccgagacccagaacagcuccuucaucaucgacggccccaacacgcccgagugccccagcgccucccgggccuggaacgugugggaggucgaggacuacggguucggcguguucaccaccaacaucuggcucaagcugcgcgagguguacacccagcugugcgaccaccggcucaugagcgcggccgucaaggacgagcgcgccgugcacgccgacaugggcuacuggaucgagagccagaagaacggguccuggaagcuggagaaggccagccugaucgaggugaagaccugcacguggccgaagucccacacccucuggagcaacggcguccuggaguccgacaugaucauccccaagagccuggcggggcccaucucccagcacaacuaccggccgggcuaccacacccagaccgccgggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaaggucgacaacuucacgaugggcgugcugugccucgccauccuguucgaggaggugaugcgggggaaguucggcaagaagcacaugaucgccggggucuucuucaccuucgugcugcuccuguccggccagaucaccuggcgcgacauggcgcacacccugaucaugaucggcagcaacgccuccgaccggauggggaugggcgugacguaccucgcccugaucgccaccuucaagauccagcccuuccuggcccucggguucuuccugcgcaagcugaccagccgggagaaccuccugcugggcgucggccucgcgauggccaccacgcugcagcugcccgaggacaucgagcagauggccaacgggaucgcccucggccugauggcgcugaagcucaucacccaguucgagaccuaccagcuguggaccgcccugaucagccucacgugcuccaacaccaucuucacccugaccguggccuggcgcacggccacccugauccucgccggggucagccugcugccggugugccaguccagcuccaugcggaagaccgacuggcuccccaugaccguggcggccaugggcgugccgccccucccgcuguucaucuucagccucaaggacacgcugaagcgccgcuccuggccccugaacgagggggugauggccgugggccucgucagcauccuggccuccagccugcuccggaacgacgugcccauggccggcccccugguggccggcgggcugcucaucgccugcuacgucaucaccgggaccuccgccgaccugaccguggagaaggccgccgacgugacgugggaggaggaggcggagcagaccggggucagccacaaccugaugaucaccguggacgacgacgggaccaugcgcaucaaggacgacgagaccgagaacauccucacggugcugcugaagaccgcccuccugaucgucuccggcaucuucccguacagcauccccgccacccugcucguguggcacaccuggcagaagcagacgcagcgguccggcgugcugugggacguccccagcccgcccgagacccagaaggccgagcuggaggaggggguguaccgcaucaagcagcagggcaucuucgggaagacccaggugggcgucggggugcagaaggagggcguguuccacaccauguggcacgucacgcggggcgccgugcucaccuacaacgggaagcgccuggagcccaacugggcguccgugaagaaggaccugaucagcuacggcgggggcuggcggcucuccgcccaguggcagaagggggaggagguccaggugaucgccguggagcccggcaagaaccccaagaacuuccagaccaugcccggcaccuuccagacgaccaccggggagaucggcgccaucgcgcuggacuucaagcccgggaccagcggcagccccaucaucaaccgcgagggcaaggucguggggcuguacggcaacgggguggucacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggccaucaagcgccggcuccgcacccugauccuggcgcccacccgggucguggccgccgagauggaggaggcccucaaggggcugcccauccgcuaccagaccacggccaccaaguccgagcacaccggccgggagaucguggaccugaugugccacgcgaccuucacgaugcgccuccugagccccguccgggugccgaacuacaaccugaucaucauggacgaggcccacuucaccgaccccgccuccaucgccgcccgcggguacaucagcacccgggugggcaugggcgaggcggccgccaucuucaugaccgccacgccgcccgggaccgcggacgccuucccgcaguccaacgcccccauccaggacgaggagcgcgacauccccgagcgcagcuggaacuccggcaacgaguggaucaccgacuucgccgggaagaccgucugguucgugcccagcaucaaggccggcaacgacaucgcgaacugccuccggaagaacgggaagaaggugauccagcugucccgcaagacguucgacaccgaguaccagaagaccaagcugaacgacugggacuucgucgugaccacggacaucagcgagaugggcgccaacuucaaggccgaccgggugaucgacccgcgccggugccucaagcccgucauccugaccgacggccccgagcgcgugauccuggccgggcccaugccggugaccgccgcguccgccgcccagcggcgcggccgggucgggcgcaacccccggaaggagaacgaccaguacaucuucaccggccagccccucaacaacgacgaggaccacgcccacuggaccgaggccaagaugcugcuggacaacaucaacacgcccgaggggaucaucccggcccucuucgagcccgagcgcgagaaguccgccgccaucgacggcgaguaccggcugaagggcgagucccgcaagaccuucguggagcugaugcggcgcggggaccuccccgucuggcuggcccacaagguggcgagcgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcccgcacguacuccgacccgcuggcccucaaggaguucaaggacuucgccgccggccgcaagagcaucgcgcuggaccuggucaccgagaucgggcgcgugcccucccaccucgcccaccggacccgcaacgcccuggacaaccuggugaugcuccacaccagcgagcacggcgggaaggccuaccggcacgccgucgaggagcugcccgagacgauggagacccugcuccugcugggccucaugauccugcugaccgggggcgcgaugcuguuccugaucagcggcaaggggaucggcaagaccuccaucgggcugaucugcgugaucgccagcuccggcaugcucuggauggccgagaucccgcugcaguggaucgccagcgccaucgugcuggaguucuucaugaugguccuccugauccccgagcccgagaagcagcgcacgccccaggacaaccagcuggcguacguggugaucgggauccucacccuggccgccaucaucgccgccaacgagaugggccugcucgagaccaccaagcgggaccugggcauguccaaggagccgggggucgugagccccacguccuaccuggacguggaccuccaccccgcgagcgccuggacccuguacgccgucgccaccaccgugaucacgcccaugcugcgccacaccaucgagaacuccaccgcgaacgugagccucgccgccaucgccaaccaggccgucgugcugaugggccuggacaagggguggccgaucuccaagauggaccucggcgugccccugcuggcgcucgggugcuacagccaggucaacccccugacccugacggccgccgugcuccugcugaucacccacuacgccaucaucggccccggccuccaggccaaggcgacccgggaggcccagaagcgcaccgccgccgggaucaugaagaacccgacgguggacggcaucaugaccaucgaccuggaccccgucaucuacgacuccaaguucgagaagcagcugggccaggugaugcuccuggugcugugcgccguccagcuccugcugaugcggaccagcugggcgcucugcgaggcccugacccuggccacgggccccaucaccacccucugggagggcucccccgggaaguucuggaacaccacgaucgccgugagcauggcgaacaucuuccgcggcuccuaccuggccggggccggccuggccuucagcaucaugaaguccguggggaccggcaagcggggcaccgggagccagggcgagacccucggggagaaguggaagaagaagcugaaccagcugagccgcaaggaguucgaccucuacaagaaguccggcaucaccgaggucgaccggacggaggccaaggaggggcugaagcgcggcgagaucacccaccacgcggugagccggggcuccgccaagcugcagugguucguggagcgcaacauggucaucccggaggggcgggugaucgaccucggcugcgggcgcggcggguggagcuacuacugcgccggccugaagaaggugaccgagguccggggcuacaccaagggcgggcccgggcacgaggagcccgugcccauguccacguacggcuggaacaucgugaagcugaugagcgggaaggacgucuucuaccucccgcccgagaagugcgacacccugcugugcgacaucggcgaguccagccccucccccaccguggaggagagccgcaccauccgcgugcugaagauggucgagccguggcucaagaacaaccaguucugcaucaaggugcugaaccccuacaugcccacggugaucgagcaccuggagcggcuccagcgcaagcacggcgggaugcugguccggaacccccugucccgcaacagcacccacgagauguacuggaucuccaacggcaccgggaacaucguggccagcgugaacauggucucccggcuccugcugaaccgcuucaccaugacgcaccggcgcccgaccaucgagaaggacguggaccucggcgccggcacccggcacgugaacgcggagcccgagacccccaacauggacgucaucggggagcgcaucaagcggaucaaggaggagcacaacagcacguggcacuacgacgacgagaacccguacaagaccugggccuaccacggcuccuacgaggugaaggccaccgggagcgccuccagcaugaucaacggcgucgugaagcugcugaccaagcccugggacgugguccccauggugacgcagauggccaugaccgacaccacccccuucgggcagcagcgcguguucaaggagaaggucgacacgcggaccccgcgcagcaugcccggcacccggcgcgugaugggcaucaccgcggaguggcucuggcggacgcuggggcgcaacaagaagccccggcugugcacccgcgaggaguucaccaagaaggugcgcaccaacgccgccaugggcgccgucuucacggaggagaaccagugggacuccgcgaaggccgccguggaggacgaggacuucuggauccucguggaccgggagcgcgagcugcacaagcuggggaagugcggcagcugcgucuacaacaugauggggaagcgggagaagaagcucggcgaguucggcaaggccaaggggucccgcgccaucugguacauguggcugggcgcgcgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgccgacgacaccgccgggugggacacccgcaucaccgaggacgaccugcacaacgaggagaagaucacgcagcagauggacccggagcaccggcagcucgcgaacgccaucuucaagcugaccuaccagaacaagguggucaaggugcagcgccccacccccaccggcaccgugauggacaucaucagccggaaggaccagcgcggcuccgggcaggucggcacguacgggcugaacaccuucaccaacauggaggcccagcucauccggcagauggagggcgagggggugcugagcaaggccgaccuggagaacccccaccucccggagaagaagaucacccaguggcuggagacgaagggcguggagcgccugaagcggauggccaucuccggcgacgacugcgucgugaagcccaucgacgaccgcuucgcgaacgcccuccuggcccugaacgacauggggaaggugcggaaggacaucccccaguggcagcccagcaagggcuggcacgacuggcagcaggucccguucugcucccaccacuuccacgagcucaucaugaaggacgggcgcaagcugguggugcccugccggccccaggacgagcugaucggccgcgcccggaucagccagggggccggcuggucccuccgcgagaccgcgugccugggcaaggccuacgcccagauguggagccugauguacuuccaccgccgggaccuccgccuggccuccaacgcgaucugcagcgccguccccgugcacugggugccgaccucccggaccacguggagcauccacgcccaccaccaguggaugaccaccgaggacaugcugaccgucuggaaccgcguguggaucgaggacaaccccuggauggaggacaagacgcccgugaccaccugggagaacguccccuaccucgggaagcgggaggaccaguggugcggcagccugaucgggcugaccucccgcgccacgugggcccagaacaucccgaccgcgauccagcagguccggagccucaucggcaacgaggaguuccuggacuacaugcccuccaugaagcgcuuccggaaggaggaggagagcgagggggccaucugguga

SEQ ID NO: 10197 - RNA, 9873 nt, Artificial Sequence
  derived and/or modified CDS sequence (opt1) from DENV-3__FJ547081__SS-prME
accagccucugccucaugaugauccuccccgccgcccuggcguuccaccucaccagccgggacggggagccgcggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucagcggccaccugaagugccggcugaagauggacaagcucgagcugaagggcauguccuacgccaugugcaccaacacguucguccugaagaaggaggugagcgagacccagcacgggaccauccucaucaagguggaguacaagggcgaggacgucccgugcaagauccccuucagcaccgaggacgggcagggcaaggcccacaacggccgccugaucacggcgaaccccguggugaccaagaaggaggagcccgucaacaucgaggccgagccgcccuucggggaguccaacaucgugaucggcaucggggacaacgcccugaagaucaacugguacaagaagggcagcuccaucgggaagauguucgaggccaccgcgcggggcgcccgccggauggccauccugggcgacaccgccugggacuucgggagcgugggcgggguccucaacucccugggcaagauggugcaccagaucuucgggagcgccuacacggcgcuguucuccggcgugagcugggucaugaagaucggcaucggggugcuccugaccuggaucggccugaacuccaagaacaccagcauguccuucagcugcaucgccaucgggaucaucacccucuaccugggcgccgugguccaggccgacauggggugcgugaucaacuggaagggcaaggagcugaagugcggcuccgggaucuucgugacgaacgagguccacaccuggaccgagcaguacaaguuccaggccgacagccccaagcgccucgcgaccgccaucgccggcgccugggagaacggggugugcggcauccgcuccacgacccggauggagaaccugcuguggaagcagaucgccaacgagcucaacuacauccugugggagaacaacaucaagcugaccguggucgugggggacaucaucggcgugcucgagcagggcaagcgcacccugacgccccagccgauggagcugaaguacagcuggaagaccugggggaaggcgaagaucgucaccgccgagacccagaacuccagcuucaucaucgacggccccaacacgcccgagugccccuccgccagccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagucccagaagaacgggagcuggaagcuggagaaggccucccugaucgaggugaagaccugcacguggcccaagucccacacccucugguccaacggcgugcuggagagcgacaugaucauccccaagucccuggcggggcccaucagccagcacaacuaccggccgggcuaccacacccagaccgccgggcccuggcaccucggcaagcuggagcuggacuucaacuacugcgagggcacgaccgucgugaucaccgagaacugcgggacccgcggccccucccuccggacgaccaccgugagcgggaagcugauccacgaguggugcugccgcuccugcacccugcccccgcuccgguacaugggcgaggacgggugcugguacggcauggagauccgccccaucagcgagaaggaggagaacauggucaagucccuggugagcgccggcuccgggaagguggacaacuucacgaugggcguccugugccucgccauccuguucgaggaggugaugcgggggaaguucggcaagaagcacaugaucgccgggguguucuucaccuucguccugcuccugagcggccagaucaccuggcgcgacauggcgcacacccugaucaugaucggcuccaacgccagcgaccggauggggaugggcgugacguaccucgcccugaucgccaccuucaagauccagcccuuccuggcccucggguucuuccugcgcaagcugaccagccgggagaaccuccugcugggcgugggccucgcgauggccaccacgcugcagcugcccgaggacaucgagcagauggccaacgggaucgcccucggccugaugacccugaagcucaucacccaguucgagaccuaccagcuguggacggcgcugaucucccugaccugcagcaacaccaucuucacccugacggucgccuggcgcaccgccacccugauccucgccggggugucccugcugccggucugccagagcuccagcaugcggaagaccgacuggcuccccaugacgguggccgcgaugggcgugccgccccucccgcuguucaucuucucccucaaggacacccugaagcgccgcagcuggccccugaacgagggggucauggccgugggccucguguccauccuggccagcucccugcuccggaacgacguccccauggccggcccccugguggccgggggccugcucaucgcgugcuacgugaucaccgggaccagcgccgaccugacggucgagaaggccgccgacgugaccugggaggaggaggccgagcagaccggcgugucccacaaccugaugaucaccgucgacgacgacgggaccaugcgcaucaaggacgacgagacggagaacauccucaccgugcugcugaagaccgcgcuccugaucgugagcggcaucuucccguacuccauccccgccacccugcucgucuggcacacguggcagaagcagacccagcggagcggcgugcugugggacgugcccagcccgcccgagacccagaaggccgagcuggaggagggggucuaccgcaucaagcagcagggcaucuucgggaagacccaggugggcguggggguccagaaggagggcguguuccacacgauguggcacgugacccggggcgccguccucaccuacaacgggaagcgccuggagcccaacugggccagcgugaagaaggaccugaucuccuacggcgggggcuggcggcucagcgcgcaguggcagaagggggaggaggugcaggucaucgccguggagcccggcaagaaccccaagaacuuccagaccaugcccggcacguuccagaccaccaccggggagaucggcgccaucgcccuggacuucaagcccgggacgagcggcucccccaucaucaaccgcgagggcaagguggucgggcuguacggcaacgggguggugaccaagaacggcggguacgucagcggcaucgcgcagaccaacgccgagccggacggccccacccccgagcuggaggaggagauguucaagaagcggaaccucacgaucauggaccugcaccccggguccggcaagacccgcaaguaccugccggccaucgugcgggaggccaucaagcgccggcuccgcacccugauccuggcccccacccggguggucgcggccgagauggaggaggcccucaaggggcugcccauccgcuaccagacgaccgccaccaagagcgagcacaccggccgggagaucguggaccugaugugccacgccacguucaccaugcgccuccugucccccgugcgggucccgaacuacaaccugaucaucauggacgaggcgcacuucaccgaccccgccagcaucgccgcccgcggguacaucuccacccgggugggcaugggcgaggccgcggccaucuucaugacggccacgccgcccgggaccgccgacgcguucccgcagagcaacgcccccauccaggacgaggagcgcgacauccccgagcgcuccuggaacagcggcaacgaguggaucaccgacuucgccgggaagacggugugguucguccccuccaucaaggccggcaacgacaucgccaacugccuccggaagaacgggaagaaggugauccagcugagccgcaagaccuucgacaccgaguaccagaagaccaagcugaacgacugggacuucguggucacgaccgacaucuccgagaugggcgcgaacuucaaggccgaccgggugaucgacccgcgccggugccucaagcccgugauccugaccgacggccccgagcgcgucauccuggccgggcccaugccggugaccgccgccagcgcggcccagcggcgcggccggguggggcgcaacccccagaaggagaacgaccaguacaucuucaccggccagccccucaacaacgacgaggaccacgcccacuggacggaggccaagaugcugcuggacaacaucaacacccccgaggggaucaucccggcccucuucgagcccgagcgggagaaguccgcggccaucgacggcgaguaccgccugaagggcgagagccggaagaccuucgucgagcugaugcgccgcggggaccuccccguguggcuggcccacaaggucgccuccgagggcaucaaguacgcggaccgcaaguggugcuucgacgggcagcggaacaaccagauccuggaggagaacauggacguggagaucuggaccaaggagggcgagaagaagaagcuccgcccccgguggcuggacgcccgcacguacagcgacccgcuggcccucaaggaguucaaggacuucgccgccggccgcaaguccaucgcgcuggaccuggugaccgagaucgggcggguccccagccaccucgcccaccgcacccggaacgcccuggacaaccuggugaugcuccacaccagcgagcacggcgggaaggccuaccgccacgccguggaggagcugcccgagacgauggagacccugcuccugcugggccucaugauccugcugaccgggggcgcgaugcuguuccugaucuccggcaaggggaucggcaagaccagcaucgggcugaucugcgucaucgccuccagcggcaugcucuggauggccgagaucccgcugcaguggaucgccuccgccaucgugcuggaguucuucaugauggugcuccugauccccgagcccgagaagcagcggacgccccaggacaaccagcuggcguacgucgugaucgggauccucacccuggccgccaucaucgccgccaacgagaugggccugcucgagaccaccaagcgcgaccugggcaugagcaaggagccggggguggucuccagcacguccuaccuggacguggaccuccaccccgcgagcgccuggacccuguacgccguggccaccaccgucaucacgcccaugcugcggcacaccaucgagaacuccaccgcgaacgugagccucgccgccaucgccaaccaggccgugguccugaugggccuggacaagggguggcccaucuccaagauggaccucggcgugccgcugcuggcgcucgggugcuacagccaggugaacccccugacccugacggccgccguccuccugcugaucacccacuacgccaucaucggccccggccuccaggccaaggcgacccgcgaggcccagaagcggaccgccgccgggaucaugaagaaccccacgguggacggcaucaugaccaucgaccuggacccggugaucuacgacuccaaguucgagaagcagcuggggcaggucaugcuccuggugcugugcgccgugcagcuccugcugaugcgcaccagcugggcgcucugcgaggcccugacccuggccacgggccccaucaccacccucugggagggcucccccgggaaguucuggaacaccacgaucgccgucagcauggcgaacaucuuccggggcuccuaccuggccggggccggccuggccuucagcaucaugaaguccguggggaccggcaagcgcggcaccgggucccagggcgagacccucggggagaaguggaagaagaagcugaaccagcugagccggaaggaguucgaccucuacaagaaguccggcaucaccgagguggaccgcacggaggccaaggaggggcugaagcggggcgagaucacccaccacgcggucagccgcggcuccgccaagcugcagugguucguggagcggaacauggugauccccgaggggcgcgucaucgaccucggcugcgggcggggcggguggagcuacuacugcgccggccugaagaaggugaccgaggugcgcggcuacaccaagggcgggccggggcacgaggagcccguccccauguccacguacggcuggaacaucgugaagcugaugagcgggaaggacguguucuaccugcccccggagaagugcgacacccugcugugcgacaucggcgaguccagccccucccccaccgucgaggagagccggaccauccgcgugcugaagaugguggagcccuggcucaagaacaaccaguucugcaucaagguccugaacccguacaugcccacggugaucgagcaccuggagcgccuccagcggaagcacggcgggaugcuggugcgcaacccccugucccggaacagcacccacgagauguacuggaucuccaacggcaccgggaacaucgucgccagcgugaacauggugucccgccuccugcugaaccgguucaccaugacgcaccgccggcccaccaucgagaaggacgucgaccucggcgccggcacccgccacgugaacgcggagccggagacccccaacauggacgugaucggggagcggaucaagcgcaucaaggaggagcacaacagcacguggcacuacgacgacgagaaccccuacaagaccugggccuaccacggcuccuacgaggucaaggccaccgggagcgccagcuccaugaucaacggcguggucaagcugcugaccaagccgugggacguggugcccauggucacgcagauggccaugaccgacaccacccccuucgggcagcagcggguguucaaggagaagguggacacgcgcacgccccggagcaugccgggcacccgccgggucaugggcaucaccgcggaguggcucuggcgcacgcuggggcggaacaagaagccccgccugugcacccgggaggaguucaccaagaaggugcgcaccaacgccgccaugggcgccguguucacggaggagaaccagugggacuccgcgaaggccgccgucgaggacgaggacuucuggaagcucguggaccgcgagcgggagcugcacaagcuggggaagugcggcagcugcguguacaacaugauggggaagcgcgagaagaagcucggcgaguucggcaaggccaaggggucccgggccaucugguacauguggcugggcgcgcgcuaccuggaguucgaggcccucggguuccugaacgaggaccacugguucagccgggagaacuccuacagcggcgucgagggggagggccugcacaagcucggcuacauccugcgcgacaucuccaagauccccgggggcgccauguacgccgacgacaccgccgggugggacacccggaucaccgaggacgaccugcacaacgaggagaagaucacgcagcagauggaccccgagcaccgccagcucgcgaacgccaucuucaagcugaccuaccagaacaagguggugaagguccagcggccgacccccaccggcaccgugauggacaucaucagccgcaaggaccagcggggcuccggccaggugggcacguacagccugaacaccuucaccaacauggaggcccagcucauccgccagauggagggggagggcguccuguccaaggccgaccuggagaacccccaccuccccgagaagaagaucacccaguggcuggagacgaaggggguggagcggcugaagcgcauggccaucagcggcgacgacugcguggucaagccgaucgacgaccgguucgcgaacgcccuccuggcccugaacgacaugggcaaggugcgcaaggacaucccccaguggcagcccuccaagggguggcacgacuggcagcagguccccuucugcagccaccacuuccacgagcucaucaugaaggacggccggaagcuggucgugccgugccgcccccaggacgagcugaucgggcgggcccgcaucucccagggcgccggguggagccuccgggagaccgcgugccugggcaaggccuacgcccagauguggucccugauguacuuccaccgccgcgaccuccggcuggccagcaacgcgaucugcagcgccgugcccguccacugggugcccaccucccgcaccacguggagcauccacgcccaccaccaguggaugaccaccgaggacaugcugaccguguggaaccgggucuggaucgaggacaacccguggauggaggacaagacgcccgugaccaccugggagaacgugcccuaccucggcaagcgcgaggaccaguggugcgggucccugaucggccugaccagccgggccacgugggcccagaacauccccaccgcgauccagcagguccgcucccucaucgggaacgaggaguuccuggacuacaugccgagcaugaagcgguuccgcaaggaggaggaguccgagggcgccaucugguga

SEQ ID NO: 10198 - RNA, 9873 nt, Artificial Sequence
  derived and/or modified CDS sequence (opt1) from DENV-3__FJ547082__SS-prME
accagccucugccucaugaugauccugcccgccgcccuggccuuccaccucaccagccgggacggcgagccccggaugaucguggggaagaacgagcgcggcaagagccugcuguucaagaccgccagcgggaucaacaugugcacccucaucgccauggaccugggcgagaugugcgacgacaccgugaccuacaagugcccccacaucgccgagguggagcccgaggacaucgacugcuggugcaaccugacgagcaccugggugaccuacgggaccugcaaccaggccggcgagcaccggcgcgacaagcgguccgucgcgcucgcgccccacgugggcauggggcuggacacgcgcacccagaccuggaugagcgccgagggcgccuggcgccagguggagaaggucgagaccugggcgcugcgccacccgggguucacgauccucgcccuguuccuggcccacuacaucggcaccucccucacccagaagguggugaucuucauccugcugaugcucgucacccccagcaugacgaugcggugcgugggggugggcaaccgcgacuucgucgagggccuguccggggccaccuggguggacgugguccuggagcacggcgggugcgugaccaccauggccaagaacaagcccacgcucgacaucgagcugcagaagaccgaggcgacccagcuggccacccuccggaagcugugcaucgagggcaagaucacgaacaucaccaccgacagccgcugccccacccagggcgaggccgugcugccggaggagcaggaccagaacuacgucugcaagcacacguacguggaccggggguggggcaacgggugcggccucuucgggaagggcucccuggugaccugcgccaaguuccagugccuggagcccaucgagggcaaggucgugcaguacgagaaccucaaguacaccgugaucaucaccguccacacgggggaccagcaccaggugggcaacgagacccagggggucaccgccgagaucacgccccaggcgagcacgaccgaggccauccugcccgaguacggcacccuggggcucgagugcuccccgcgcaccggccuggacuucaacgagaugauccugcucaccaugaagaacaaggccuggauggugcaccggcagugguucuucgaccugccccugcccuggacgagcggcgccaccaccgagacccccacguggaaccgcaaggagcuccuggugaccuucaagaacgcccacgcgaagaagcaggaggucguggugcuggggucccaggagggcgccaugcacaccgcccucaccggggccacggagauccagaacagcggcgggaccuccaucuucgccggccaccugaagugccggcugaagauggacaagcucgagcugaagggcaugagcuacgcgaugugcaccaacaccuucguccugaagaaggagguguccgagacgcagcacgggaccauccucaucaagguggaguacaagggcgaggacgucccgugcaagauccccuucagcaccgaggacgggcagggcaaggcccacaacggccgccugaucaccgccaaccccguggugacgaagaaggaggagcccgucaacaucgaggccgagccgcccuucggggagagcaacaucgugaucggcaucggggacaacgcgcugaagaucaacugguacaagaagggcuccagcaucgggaagauguucgaggccaccgcccggggcgcccgccggauggccauccugggcgacaccgcgugggacuucggguccgugggcgggguccucaacagccugggcaagauggugcaccagaucuucggguccgccuacaccgcccuguucagcggcguguccugggucaugaagaucggcaucggggugcuccugacguggaucggccugaacagcaagaacaccuccaugagcuucuccugcaucgccaucgggaucaucacccucuaccugggcgccgugguccaggcggacaccgggugcgugaucaacuggaagggcaaggagcugaagugcggcagcgggaucuucgugacgaacgagguccacaccuggaccgagcaguacaaguuccaggccgacucccccaagcgccucgccaccgccaucgccggcgcgugggagaacggggugugcggcauccgcagcacgacccggauggagaaccugcuguggaagcagaucgccaacgagcucaacuacauccugugggagaacaacaucaagcugaccguggucgugggggacaucaucggcgugcucgagcagggcaagcgcacccugacgccccagccgauggagcugaaguacuccuggaagaugugggggaaggccaagaucgucaccgccgagacccagaacagcuccuucaucaucgacggccccaacacccccgagugccccagcgcgucccgggccuggaacgugugggagguggaggacuacggguucggcgucuucacgaccaacaucuggcucaagcugcgcgagguguacacccagcugugcgaccaccggcucaugagcgccgccgugaaggacgagcgcgccguccacgcggacaugggcuacuggaucgagagccagaagaacggguccuggaagcuggagaaggccagccugaucgaggugaagaccugcaccuggccgaagucccacacgcucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcaccacggucgugaucaccgagaacugcgggacccgcggccccagccuccggaccacgaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucaccaugggcguccugugccucgcgauccuguucgaggaggugaugcgggggaaguucggcaagaagcacaugaucgccgggguguucuucacguucguccugcuccuguccggccagaucaccuggcgcgacauggcccacacccugaucaugaucggcagcaacgccuccgaccggauggggaugggcgugaccuaccucgcccugaucgcgacguucaagauccagcccuuccuggcccucggguucuuccugcgcaagcugaccagccgggagaaccuccugcugggcgugggccucgccauggccaccacccugcagcugcccgaggacaucgagcagauggcgaacgggaucgcccucggccugauggcccugaagcucaucacgcaguucgagaccuaccagcuguggaccgcccugaucagccugaccugcuccaacacgaucuucacccugaccgucgccuggcgcaccgcgacgcugauccucgccggggugagccugcugccggucugccaguccagcuccaugcggaaguccgacuggcuccccaugaccguggccgccaugggcgugccgccccucccgcuguucaucuucucccucaaggacacccugaagcgccgcagcuggccccugaacgagggggucauggccgugggccucguguccauccuggcgagcucccugcuccggaacgacguccccauggccggcccccugguggccgggggccugcucaucgccugcuacgugaucaccgggacgagcgccgaccugaccgucgagaaggcggccgacgugaccugggaggaggaggccgagcagaccggcgugucccacaaccugaugaucacggucgacgacgacgggaccaugcgcaucaaggacgacgagaccgagaacauccucaccgugcugcugaagaccgcccuccugaucgugagcggcaucuucccguacuccauccccgccacgcugcucgucuggcacaccuggcagaagcagacccggcgcagcggcgugcugugggacgugcccagcccgcccgagacccagaaggcggagcuggaggagggggucuaccggaucaagcagcagggcaucuucgggaagacccaggugggcguggggguccagaaggagggcguguuccacaccauguggcacgugacccgcggcgccguccucaccuacaacgggaagcggcuggagcccaacugggccagcgugaagaaggaccugaucuccuacggcgggggcuggcgccucagcgcccaguggcagaagggggaggaggugcaggucaucgcgguggagcccggcaagaaccccaagaacuuccagacgaugcccggcaccuuccagaccaccacgggggagaucggcgccaucgcccuggacuucaagcccgggaccagcggcucccccaucaucaaccgggagggcaagguggucgggcuguacggcaacgggguggugaccaagaacggcggguacgucagcggcaucgcccagaccaacgccgagccggacggccccacgcccgagcuggaggaggagauguucaagaagcgcaaccucaccaucauggaccugcaccccggguccggcaagacccggaaguaccugccggcgaucgugcgcgaggccaucaagcggcgccuccggacccugauccuggcccccacgcgcguggucgccgccgagauggaggaggcgcucaaggggcugcccauccgguaccagaccaccgccaccaagagcgagcacacgggccgcgagaucguggaccugaugugccacgccaccuucaccaugcggcuccugucccccgugcgcgucccgaacuacaaccugaucaucauggacgaggcccacuucaccgaccccgccagcaucgcggcccggggguacaucuccacgcgcgugggcaugggcgaggccgccgcgaucuucaugaccgccacgccgcccgggaccgccgacgccuucccgcagagcaacgcccccauccaggacgaggagcgcgacauccccgagcgguccuggaacagcggcaacgaguggaucacggacuucgcggggaagaccgugugguucguccccuccaucaaggccggcaacgacaucgccaacugccuccgcaagaacgggaagaaggugauccagcugagccggaagaccuucgacaccgaguaccagaagacgaagcugaacgacugggacuucguggucaccaccgacaucuccgagaugggcgccaacuucaaggccgaccgcgugaucgacccgcggcgcugccucaagcccgugauccugaccgacggccccgagcgggucauccuggcggggcccaugccggugacggccgccagcgccgcccagcgccggggccgcguggggcggaacccccagaaggagaacgaccaguacaucuucaccggccagccccucaacaacgacgaggaccacgcgcacuggaccgaggccaagaugcugcuggacaacaucaacacccccgaggggaucaucccggcccucuucgagcccgagcgcgagaaguccgccgcgaucgacggcgaguaccggcugaagggcgagagccgcaagaccuucgucgagcugaugcggcgcggggaccuccccguguggcuggcccacaaggucgccuccgagggcaucaaguacacggaccggaaguggugcuucgacgggcagcgcaacaaccagauccuggaggagaacauggacguggagaucuggaccaaggagggcgagaagaagaagcuccggccccgcuggcuggacgcccgcaccuacagcgacccgcuggcccucaaggaguucaaggacuucgcggccggccggaaguccaucgcccuggaccuggugaccgagaucgggcgcguccccagccaccucgcccaccggacgcgcaacgcccuggacaaccuggugaugcuccacaccagcgagcacggcgggaaggcguaccggcacgccguggaggagcugcccgagaccauggagacccugcuccugcugggccucaugauccugcugaccggcggggccaugcuguuccugaucuccgggaaggggaucggcaagaccagcaucgggcugaucugcgucaucgccuccagcggcaugcucuggauggccgagaucccgcugcaguggaucgcguccgccaucgugcuggaguucuucaugauggugcuccugauccccgagcccgagaagcagcgcacgccccaggacaaccagcuggccuacgucgugaucgggauccucacccuggccgccaucaucgcggccaacgagaugggccugcucgagacgaccaagcgggaccugggcaugagcaaggagccggggguggucucccccaccagcuaccuggacguggaccuccaccccgccuccgccuggacccuguacgcgguggccacgaccgucaucacccccaugcugcgccacaccaucgagaacagcacggccaacgugucccucgccgccaucgcgaaccaggccgugguccugaugggccuggacaagggguggccgaucagcaagauggaccucggcgugccccugcuggcccucgggugcuacucccaggugaacccccugacccugaccgccgccguccuccugcugaucacccacuacgcgaucaucggccccggccuccaggccaaggccacgcgggaggcccagaagcgcaccgccgcggggaucaugaagaacccgaccguggacggcaucaugaccaucgaccuggaccccgugaucuacgacagcaaguucgagaagcagcuggggcaggucaugcuccuggugcugugcgccgugcagcuccugcugaugcggacguccugggcccucugcgaggcccugacccuggcgaccggccccaucaccacgcucugggagggcagccccgggaaguucuggaacaccaccaucgccgucuccauggccaacaucuuccgcggcagcuaccuggccggggccggccuggcguucuccaucaugaaguccguggggaccggcaagcggggcacggggagccagggcgagacccucggggagaaguggaagaagaagcugaaccagcugucccgcaaggaguucgaccucuacaagaaguccggcaucaccgagguggaccggaccgaggccaaggaggggcugaagcgcggcgagaucacccaccacgccgucucccggggcagcgccaagcugcagugguucguggagcgcaacauggugaucccggaggggcgggucaucgaccucggcugcgggcgcggcgggugguccuacuacugcgccggccugaagaaggugacggaggugcggggcuacaccaagggcgggcccgggcacgaggagcccguccccaugagcaccuacggcuggaacaucgugaagcugauguccgggaaggacguguucuaccucccgcccgagaagugcgacacccugcugugcgacaucggcgagagcucccccagccccacggucgaggagucccgcaccauccgcgugcugaagaugguggagccguggcucaagaacaaccaguucugcaucaagguccugaaccccuacaugcccaccgugaucgagcaccuggagcggcuccagcgcaagcacggcgggaugcuggugcggaacccccugagccgcaacuccacccacgagauguacuggaucagcaacggcacggggaacaucgucgcguccgugaacauggugagccggcuccugcugaaccgcuucaccaugacccaccggcgcccgaccaucgagaaggacgucgaccucggcgccggcacgcggcacgugaacgccgagcccgagacccccaacauggacgugaucggggagcgcaucaagcggaucaaggaggagcacaacuccaccuggcacuacgacgacgagaacccguacaagaccugggccuaccacggcagcuacgaggucaaggccacgggguccgcgagcagcaugaucaacggcguggucaagcugcugaccaagcccugggacguggugcccauggucacccagauggccaugaccgacacgacccccuucgggcagcagcgcguguucaaggagaagguggacacccggaccccgcgcuccaugcccggcacgcggcgcgucaugggcaucaccgccgaguggcucuggcggacccuggggcgcaacaagaagccccggcugugcacccgcgaggaguucacgaagaaggugcgcaccaacgccgcgaugggcgccguguucaccgaggagaaccagugggacagcgccaaggccgccgucgaggacgaggacuucuggaagcucguggaccgggagcgcgagcugcacaagcuggggaagugcggcuccugcguguacaacaugauggggaagcgggagaagaagcucggcgaguucggcaaggcgaaggggagccgcgccaucugguacauguggcugggcgcccgguaccuggaguucgaggcccucggguuccugaacgaggaccacugguucucccgcgagaacagcuacuccggcgucgagggggagggccugcacaagcucggcuacauccugcgggacaucagcaagauccccgggggcgccauguacgcggacgacaccgccgggugggacacgcgcaucaccgaggacgaccugcacaacgaggagaagaucacccagcagauggacccggagcaccggcagcucgccaacgccaucuucaagcugaccuaccagaacaagguggugaagguccagcgccccacgcccaccggcaccgugauggacaucaucucccggaaggaccagcgcggcagcggccaggugggcaccuacgggcugaacaccuucacgaacauggaggcccagcucauccggcagauggagggcgaggggguccuguccaaggcggaccuggagaacccccaccucagcgagaagaagaucacccaguggcuggagaccaagggcguggagcgccugaagcggauggccaucuccggcgacgacugcguggucaagccgaucgacgaccgcuucgccaacgcccuccuggcccugaacgacauggggaaggugcggaaggacaucccccaguggcagcccagcaagggcuggcacgacuggcagcagguccccuucugcucccaccacuuccacgagcucaucaugaaggacgggcgcaagcuggucgugccgugccggccccaggacgagcugaucggccgcgcgcggaucagccagggggccggcuggucccuccgcgagaccgccugccugggcaaggccuacgcgcagauguggagccugauguacuuccaccgccgggaccuccgccuggccuccaacgccaucugcagcgccgugcccguccacugggugcccacgagccggaccaccugguccauccacgcccaccaccaguggaugaccacggaggacaugcugaccguguggaaccgcgucuggaucgaggacaacccguggauggaggacaagacccccgugaccacgugggagaacgugcccuaccucgggaagcgggaggaccaguggugcggcagccugaucgggcugaccucccgcgcgaccugggcccagaacauccccaccgccauccagcagguccggagccucaucggcaacgaggaguuccuggacuacaugccguccaugaagcgcuuccggaaggaggaggagagcgagggggccaucugguga

SEQ ID NO: 10199 - RNA, 9873 nt, Artificial Sequence
  derived and/or modified CDS sequence (opt1) from DENV-3__FJ547083__SS-prME
accagccucugccucaugaugauccugcccgccgcccuggcguuccaccucaccagccgggacggggagccgcggaugaucguggggaagaacgagcgcggcaagagccugcuguucaagaccgccagcgggaucaacaugugcacccucaucgccauggaccugggggagaugugcgacgacaccgugaccuacaagugcccccacaucacggagguggagcccgaggacaucgacugcuggugcaaccugaccagcaccugggugaccuacgggacgugcaaccaggccggcgagcggcgccgggacaagcgcuccguggcccucgcgccccacgugggcauggggcuggacacccggacccagaccuggaugagcgccgagggcgccuggcgccagguggagaagguggagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccgugcugccggaggagcaggaccaguccuacgucugcaagcacaccuacguggaccgcggguggggcaacgggugcggccucuucgggaagggcagccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccuccaccaccgaggcgauccugcccgaguacggcacccuggggcucgagugcagcccgcggaccggccuggacuucaacgagaugauccugcucacgaugaagaacaaggccuggauggugcaccgccagugguucuucgaccugccccugcccuggaccuccggcgccaccaccgagacgcccaccuggaaccggaaggagcuccuggugaccuucaagaacgcccacgccaagaagcaggaggucguggugcuggggagccaggagggcgcgaugcacaccgcccucacgggggccaccgagauccagaacuccggcgggaccagcaucuucgccggccaccugaagugccgccugaagauggacaagcucgagcugaagggcauguccuacgccaugugcaccaacacguucguccugaagaaggaggugagcgagacccagcacgggaccauccucaucaagguggaguacaagggcgaggacgcgccgugcaagauccccuucagcaccgaggacgggcagggcaaggcccacaacggccggcugaucacggccaaccccgucgugaccaagaaggaggagcccgugaacaucgaggccgagccgcccuucggggaguccaacaucgucaucggcaucggggacaacgcgcugaagaucaacugguacaagaagggcagcuccaucgggaagauguucgaggccaccgcccgcggcgcccggcgcauggccauccugggcgacaccgcgugggacuucgggagcgugggcggggugcucaacucccugggcaagaugguccaccagaucuucgggagcgccuacacggcccuguucuccggcgugagcugggugaugaagaucggcaucgggguccuccugaccuggaucggccugaacuccaagaacaccagcauguccuucagcugcaucgccaucgggaucaucacccucuaccugggcgccguggugcaggcggacauggggugcgucaucaacuggaagggcaaggagcugaagugcggcuccgggaucuucgugacgaacgaggugcacaccuggaccgagcaguacaaguuccaggccgacagccccaagcgccucgccaccgccaucgccggcgcgugggagaacggggucugcggcauccgguccacgacccgcauggagaaccugcuguggaagcagaucgccaacgagcucaacuacauccugugggagaacaacaucaagcugaccgugguggucggggacaccaucggcgugcucgagcagggcaagcggacgcugacgccccagccgauggagcugaaguacagcuggaagaccugggggaaggccaagaucgugaccgccgagacgcagaacuccagcuucaucaucgacggccccaacacccccgagugccccuccgcgagccgcgccuggaacgucugggagguggaggacuacggguucggcguguucaccaccaacaucuggcucaagcugcgggaggucuacacccagcugugcgaccaccgccucaugagcgccgccgugaaggacgagcgggccgugcacgcggacaugggcuacuggaucgagucccagaagaacgggagcuggaagcuggagaaggccucccugaucgaggucaagacgugcaccuggcccaagagccacacccucugguccaacggcgugcuggagagcgacaugaucauccccaagucccuggccgggcccaucagccagcacaaccaccgcccgggcuaccacacccagacggccgggcccuggcaccucggcaagcuggagcuggacuucaacuacugcgagggcaccaccguggucaucaccgagaacugcgggacgcggggccccucccuccgcaccaccaccgugagcgggaagcugauccacgaguggugcugccgguccugcacgcugcccccgcuccgcuacaugggcgaggacgggugcugguacggcauggagauccggcccaucagcgagaaggaggagaacauggugaagucccuggucagcgccggcuccgggaagguggacaacuucaccaugggcgugcugugccucgcgauccuguucgaggaggucaugcgcgggaaguucggcaagaagcacaugaucgccgggguguucuucaccuucgugcugcuccugagcggccagaucaccuggcgggacauggcccacacgcugaucaugaucggcuccagcgccagcgaccgcauggggaugggcgucaccuaccucgcccugaucgcgaccuucaagauccagcccuuccuggcccucggguucuuccugcggaagcugaccucccgcgagaaccuccugcugggcgugggccucgccauggccacgacccugcagcugcccgaggacaucgagcagauggcgaacgggaucgcccucggccugauggcccugaagcucaucacccaguucgagaccuaccagcuguggacggcccugaucagccugaccugcuccaacaccauguucacccugacgguggccuggcggaccgcgacccugauccucgccggggucagccugcugccggugugccaguccagcuccaugcgcaagaccgacuggcuccccauggccgucgccgccaugggcgugccgccccucccgcuguucaucuucagccucaaggacacgcugaagcgccgguccuggccccugaacgagggggugauggcggucggccucgugagcauccuggccuccagccugcuccgcaacgacgugcccauggccggcccccuggucgccgggggccugcucaucgccugcuacgugaucaccgggaccuccgcggaccugaccguggagaaggccgccgacaucacgugggaggaggaggccgagcagaccggcgucagccacaaccugaugaucaccguggacgacgacgggaccaugcggaucaaggacgacgagaccgagaacauccucacggugcugcugaagaccgcccuccugaucgucuccggcguguucccguacagcauccccgcgacccugcucguguggcacaccuggcagaagcagacgcagcgcuccggcguccugugggacgugcccagcccgcccgagacccagaaggccgagcuggaggaggggguguaccggaucaagcagcagggcaucuucgggaagacccaggucggcgugggggugcagaaggagggcgucuuccacaccauguggcacgugacgcgcggcgccgugcucaccuacaacgggaagcggcuggagcccaacugggccuccgucaagaaggaccugaucagcuacggcgggggcuggcgccucagcgcgcaguggcagaagggggaggagguccaggugaucgccgucgagcccggcaagaaccccaagaacuuccagaccaugcccggcaccuuccagacgaccaccggggagaucggcgccaucgcccuggacuucaagcccgggaccuccggcagccccaucaucaaccgggagggcaaggugguggggcuguacggcaacggggucgugacgaagaacggcggguacguguccggcaucgcccagaccaacgcggagccggacggccccacccccgagcuggaggaggagauguucaagaagcgcaaccucaccaucauggaccugcaccccgggagcggcaagacgcggaaguaccugccggccaucguccgcgaggccaucaagcggcgccuccggacccugauccuggcccccacccgcgugguggccgcggagauggaggaggcccucaaggggcugcccauccgguaccagaccacggccaccaaguccgagcacaccggccgcgagaucgucgaccugaugugccacgccaccuucacgaugcggcuccugagccccgugcgcgugccgaacuacaaccugaucaucauggacgaggcccacuucaccgaccccgcguccaucgccgcccggggguacaucagcacccgcgucggcaugggcgaggccgcggccaucuucaugaccgccacgccgcccgggaccgccgacgccuucccgcaguccaacgcgcccauccaggacgaggagcgcgacauccccgagcggagcuggaacuccggcaacgaguggaucaccgacuucgccgggaagaccgugugguucgugcccagcaucaaggccggcaacgacaucgccaacugccuccgcaagaacgggaagaaggucauccagcugucccggaagacguucgacaccgaguaccagaagaccaagcugaacgacugggacuucguggugaccacggacaucagcgagaugggcgccaacuucaaggcggaccgcgucaucgacccgcggcgcugccucaagcccgugauccugaccgacggccccgagcgggugauccuggccgggcccaugccggucaccgccgccuccgccgcgcagcgccggggccgcguggggcggaacccccagaaggagaacgaccaguacaucuucaccggccagccccucaacaacgacgaggaccacgcccacuggaccgaggccaagaugcugcuggacaacaucaacacgcccgaggggaucaucccggcccucuucgagcccgagcgcgagaaguccgcggccaucgacggcgaguaccggcugaagggcgagucccgcaagaccuucguggagcugaugcggcgcggggaccuccccgucuggcuggcccacaagguggccagcgagggcaucaaguacaccgaccggaaguggugcuucgacgggcagcgcaacaaccagauccuggaggagaacauggacgucgagaucuggaccaaggagggcgagaagaagaagcuccggccccgcuggcuggacgcccgcacguacuccgacccgcuggcgcucaaggaguucaaggacuucgccgccggccgcaagagcaucgcccuggaccuggugaccgagaucgggcgcgugcccagccaccucgcccaccggacccgcaacgcgcuggacaaccuggucaugcuccacaccuccgagcacggcgggcgggccuaccgccacgccguggaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggcggagaucccgcugcaguggaucgccagcgccaucguccuggaguucuucaugauggugcuccugauccccgagcccgagaagcagcggacgccccaggacaaccagcuggccuacguggucaucgggauccucacccuggccgcgaucaucgccgccaacgagaugggccugcucgagaccaccaagcgcgaccugggcauguccaaggagccggggguggugagccccacguccuaccuggacgucgaccuccaccccgccagcgcguggacccuguacgccguggccaccaccgugaucacgcccaugcugcggcacaccaucgagaacuccaccgccaacgucagccucgccgcgaucgccaaccaggccguggugcugaugggccuggacaagggguggccgaucuccaagauggaccucggcgucccccugcuggcccucgggugcuacagccaggugaacccccugacccugacggccgcggugcuccugcugaucacccacuacgccaucaucggccccggccuccaggccaaggccacccgcgaggcccagaagcggaccgcggccgggaucaugaagaacccgacggucgacggcaucaugaccaucgaccuggaccccgugaucuacgacuccaaguucgagaagcagcugggccaggugaugcuccugguccugugcgccgugcagcuccugcugaugcgcaccagcugggcccucugcgaggcgcugacccuggccacgggccccaucaccacccucugggagggcucccccgggaaguucuggaacaccacgaucgccgugagcauggccaacaucuuccggggcuccuaccuggccggggcgggccuggccuucagcaucaugaaguccgucgggaccggcaagcgcggcaccgggucccagggcgagacccucggggagaaguggaagaagaagcugaaccagcugagccggaaggaguucgaccucuacaagaaguccggcaucaccgagguggaccgcacggaggccaaggaggggcugaagcggggcgagaucacccaccacgccgugagccgcggcuccgccaagcugcagugguucgucgagcggaacauggugaucccggaggggcgcgugaucgaccucggcugcgggcggggcggguggagcuacuacugcgcgggccugaagaaggucaccgaggugcgcggcuacaccaagggcgggcccgggcacgaggagcccgugcccauguccacguacggcuggaacaucgucaagcugaugagcgggaaggacguguucuaccucccgcccgagaagugcgacacccugcugugcgacaucggcgaguccagccccucccccaccguggaggagagccgcaccauccggguccugaagaugguggagccguggcucaagaacaaccaguucugcaucaaggugcugaaccccuacaugcccacggucaucgagcaccuggagcgccuccagcggaagcacggcgggaugcuggugcgcaacccccugucccggaacagcacccacgagauguacuggaucuccaacggcaccgggaacaucguggccagcgucaacauggugucccgccuccugcugaaccgguucaccaugacgcaccgccggccgaccaucgagaaggacguggaccucggcgccggcacccgccacgucaacgccgagcccgagacccccaacauggacgugaucggggagcggaucaagcgcaucaaggaggagcacaacagcacguggcacuacgacgacgagaacccguacaagaccugggccuaccacggcuccuacgaggugaaggcgaccgggagcgccagcuccaugaucaacggcgucgugaagcugcugaccaagcccugggacgucgugcccauggugacgcagauggccaugaccgacaccacccccuucgggcagcagcgggucuucaaggagaagguggacacgcgcaccccgcggagcaugcccggcacccgccgggugaugggcaucaccgccgaguggcucuggcgcacgcuggggcggaacaagaagccccgccugugcacccgcgaggaguucaccaagaagguccggaccaacgcggccaugggcgccguguucacggaggagaaccagugggacuccgccaaggccgcgguggaggacgaggacuucuggaagcucgucgaccgcgagcgggagcugcacaagcuggggaagugcggcagcugcguguacaacaugauggggaagcgcgagaagaagcucggcgaguucggcaaggccaaggggucccgggccaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgcgauguacgccgacgacaccgccgggugggacacccggaucaccgaggacgaccugcacaacgaggagaagaucacgcagcagauggacccggagcaccgccagcucgccaacgccaucuucaagcugaccuaccagaacaaggucgugaaggugcagcggcccacccccaccggcaccgucauggacaucaucagccgcaaggaccagcggggcuccggccaggugggcacguacgggcugaacaccuucaccaacauggaggcgcagcucauccgccagauggagggcgagggggugcugagcaaggccgaccuggagaacccccaccucccggagaagaagaucacccaguggcuggagacgaagggcgucgagcggcugaagcgcauggccaucuccggcgacgacugcguggugaagcccaucgacgaccgguucgccaacgcccuccuggcgcugaacgacauggggaagguccgcaaggacaucccccaguggcagcccagcaagggcuggcacgacuggcagcaggucccguucugcucccaccacuuccacgagcucaucaugaaggacgggcggaagcuggugguccccugccgcccccaggacgagcugaucggccgggcccgcaucagccagggggccggcuggucccuccgcgagaccgccugccugggcaaggcguacgcccagauguggagccugauguacuuccaccggcgcgaccuccggcuggccuccaacgccaucugcagcgccgugcccgugcacugggucccgaccagccgcaccacgugguccauccacgcgcaccaccaguggaugaccaccgaggacaugcugaccguguggaaccggguguggaucgaggacaaccccuggauggaggacaagacgcccgucaccaccugggagaacgugcccuaccucgggaagcgcgaggaccaguggugcggcagccugaucgggcugaccucccgggccacgugggcccagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10200 - RNA, 9873 nt, Artificial Sequence
  derived and/or modified CDS sequence (opt1) from DENV-3__FJ547084__SS-prME
accagccucugccucaugaugauccugcccgcggcgcuggcguuccaccucaccagccgggacggcgagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagcggggcuccagcaucgggaagauguucgaggcgaccgcccgcggcgcccggcgcauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccggagcacgacccgcauggagaaccugcuguggaagcagaucgcgaacgagcucaacuacauccugugggagaacaacaucaagcugaccguggucgugggggacaccaucggcgugcucgagcagggcaagcggacgcugacgccccagccgauggagcugaaguacuccuggaagaccugggggaaggccaagaucgucaccgccgagacgcagaacagcuccuucaucaucgacggccccaacacccccgagugccccagcgccucccgcgcguggaacgugugggagguggaggacuacggguucggcgucuucaccaccaacaucuggcucaagcugcgggagguguacacccagcugugcgaccaccgccucaugagcgccgccgugaaggacgagcgggccguccacgccgacaugggcuacuggaucgagagccagaagaacggguccuggaagcuggagaaggcgagccugaucgaggugaagacgugcaccuggccgaagucccacacccucuggagcaacggcgugcuggaguccgacaugaucauccccaagagccuggccgggcccaucucccagcacaacuaccgcccgggcuaccacacccagacggccgggcccuggcaccucggcaagcuggagcuggacuucaacuacugcgagggcaccaccgucgugaucaccgagaacugcgggacgcggggccccagccuccgcaccaccaccguguccgggaagcugauccacgaguggugcugccggagcugcacgcugcccccgcuccgcuacaugggcgaggacgggugcugguacggcauggagauccggcccaucuccgagaaggaggagaacauggucaagagccugguguccgccggcagcgggaagguggacaacuucaccaugggcguccugugccucgccauccuguucgaggaggugaugcgcgggaaguucggcaagaagcacaugaucgugggggucuucuucaccuucgugcugcuccuguccggccagaucaccuggcgggacauggcgcacacgcugaucaugaucggcagcaacgccuccgaccgcauggggaugggcgugaccuaccucgcccugaucgccaccuucaagauccagcccuuccuggcccucggguucuuccugcggaagcugaccagccgcgagaaccuccugcugggcgucggccucgcgauggccacgacccugcagcugcccgaggacaucgagcagauggccaacgggaucgcccucggccugauggcgcugaagcucaccacccaguucgagacguaccagcuguggaccgcccugaucagccugaccugcuccaacaccaucuucacgcugaccguggccuggcggaccgccacccugauccucgccggggucagccugcugccggugugccaguccagcuccaugcgcaagacggacuggcuccccaugaccguggcggccaugggcgugccgccccucccgcuguucaucuucagccucaaggacacccugaagcgccgguccuggccccugaacgagggggugauggccgugggccucgucagcauccuggccuccagccugcuccgcaacgacgugcccauggccggcccccugguggccggcgggcugcucaucgccugcuacgucaucaccgggacguccgccgaccugaccguggagaaggccgccgacgugaccugggaggaggaggcggagcagaccggggucagccacaaccugaugaucaccguggacgacgacgggacgaugcggaucaaggacgacgagaccgagaacauccucaccgugcugcugaagaccgcccuccugaucgucuccggcaucuucccguacagcauccccgccacgcugcucguguggcacaccuggcagaagcagacccagcgcuccggcgugcugugggacguccccagcccgcccgagacccagaaggccgagcuggaggaggggguguaccggaucaagcagcagggcaucuucgggaagacccaggugggcgucggggugcagaaggagggcguguuccacaccauguggcacgucacccgcggcgccgugcucaccuacaacgggaagcggcuggagcccaacugggcguccgugaagaaggaccugaucagcuacggcgggggcuggcgccucuccgcccaguggcagaagggggaggagguccaggugaucgccguggagcccggcaagaaccccaagaacuuccagacgaugcccggcaccuuccagaccaccacgggggagaucggcgccaucgcgcuggacuucaagcccgggaccagcggcagccccaucaucaaccgggagggcaaggucguggggcuguacggcaacgggguggucaccaagaacggcggguacguguccggcaucgcccagaccaacgccgagccggacggccccacgcccgagcuggaggaggagauguucaagaagcgcaaccucaccaucauggaccugcaccccgggagcggcaagacccggaaguaccugccggccaucgugcgcgaggccaucaagcggcgccuccggacccugauccuggcgcccacgcgcgucguggccgccgagauggaggaggcccucaaggggcugcccauccgguaccagaccaccgccaccaaguccgagcacacgggccgcgagaucguggaccugaugugccacgcgaccuucaccaugcggcuccugagccccguccgcgugccgaacuacaaccugaucaucauggacgaggcccacuucaccgaccccgccuccaucgccgcccggggguacaucagcacgcgcgugggcaugggcgaggcggccgccaucuucaugaccgccacgccgcccgggaccgcggacgccuucccgcaguccaacgcccccauccaggacgaggagcgcgacauccccgagcggagcuggaacuccggcaacgaguggaucacggacuucgccgggaagaccgucugguucgugcccagcaucaaggccggcaacgacaucgcgaacugccuccgcaagaacgggaagaaggugauccagcugucccggaagaccuucgacaccgaguaccagaagacgaagcugaacgacugggacuucgucgugaccaccgacaucagcgagaugggcgccaacuucaaggccgaccgcgugaucgacccgcggcgcugccucaagcccgucauccugaccgacggccccgagcgggugauccuggccgggcccaugccggugaccgccgcguccgccgcccagcgccggggccgcgucgggcggaacccccagaaggagaacgaccaguacaucuucacgggccagccccucaacaacgacgaggaccacgcccacuggaccgaggccaagaugcugcuggacaacaucaacacccccgaggggaucaucccggcccucuucgagcccgagcgcgagaaguccgccgccaucgacggcgaguaccggcugaagggcgagucccgcaagaccuucguggagcugaugcggcgcggggaccuccccgucuggcuggcccacaagguggcgagcgagggcaucaaguacacggaccggaaguggugcuucgacgggcagcgcaacaaccagauccuggaggagaacauggacguggagaucuggaccaaggagggcgagaagaagaagcuccggccccgcuggcuggacgcccgcaccuacuccgacccgcuggcccucaaggaguucaaggacuucgccgccggccgcaagagcaucgcgcuggaccuggucaccgagaucgggcgcgugcccucccaccucgcccaccggacgcgcaacgcccuggacaaccuggugaugcuccacaccagcgagcacggcgggaaggccuaccggcacgccgucgaggagcugcccgagaccauggagacccugcuccugcugggccucaugauccugcugaccggcggggcgaugcuguuccugaucagcgggaaggggaucggcaagaccuccaucgggcugaucugcgugaucgccagcuccggcaugcucuggauggccgagaucccgcugcaguggaucgccagcgccaucgugcuggaguucuucaugaugguccuccugauccccgagcccgagaagcagcgcacgccccaggacaaccagcuggcguacguggugaucgggauccucacccuggccgccaucaucgccgccaacgagaugggccugcucgagacgaccaagcgggaccugggcauguccaaggagccgggggucgugagccccaccuccuaccuggacguggaccuccaccccgcgagcgccuggacccuguacgccgucgccacgaccgugaucacccccaugcugcgccacaccaucgagaacuccacggcgaacgugagccucgccgccaucgccaaccaggccgucgugcugaugggccuggacaagggguggccgaucuccaagauggaccucggcgugccccugcuggcgcucgggugcuacagccaggucaacccccugacccugaccgccgccgugcuccugcugaucacccacuacgccaucaucggccccggccuccaggccaaggcgacgcgggaggcccagaagcgcaccgccgccgggaucaugaagaacccgaccguggacggcaucaugaccaucgaccuggaccccgucaucuacgacuccaaguucgagaagcagcugggccaggugaugcuccuggugcugugcgccguccagcuccugcugaugcggacgagcugggcgcucugcgaggcccugacccuggccaccggccccaucaccacgcucugggagggcucccccgggaaguucuggaacaccaccaucgccgugagcauggcgaacaucuuccgcggcuccuaccuggccggggccggccuggccuucagcaucaugaaguccguggggaccggcaagcggggcaccgggagccagggcgagacgcucggggagaaguggaagaagaagcugaaccagcugagccgcaaggaguucgaccucuacaagaaguccggcaucaccgaggucgaccggaccgaggccaaggaggggcugaagcgcggcgagaucacccaccacgcggugagccggggcuccgccaagcugcagugguucguggagcgcaacauggucaucccggaggggcgggugaucgaccucggcugcgggcgcggcggguggagcuacuacugcgccggccugaagaaggugacggagguccggggcuacaccaagggcggccccgggcacgaggagcccgugcccauguccaccuacggcuggaacaucgugaagcugaugagcgggaaggacgucuucuaccucccgcccgagaagugcgacacccugcugugcgacaucggcgaguccagccccucccccacgguggaggagagccgcaccauccgcgugcugaagauggucgagccguggcucaagaacaaccaguucugcaucaaggugcugaaccccuacaugcccaccgugaucgagcaccuggagcggcuccagcgcaagcacggcgggaugcugguccggaacccccugucccgcaacagcacccacgagauguacuggaucuccaacggcacggggaacaucguggccagcgugaacauggucucccggcuccugcugaaccgcuucaccaugacccaccggcgcccgaccaucgagaaggacguggaccucggcgccggcacgcggcacgugaacgcggagcccgagacccccaacauggacgucaucggggagcgcaucaagcggaucaaggaggagcacaacagcaccuggcacuacgacgacgagaacccguacaagaccugggccuaccacggcuccuacgaggugaaggccacggggagcgccuccagcaugaucaacggcgucgugaagcugcugaccaagcccugggacgugguccccauggugacccagauggccaugaccgacacgacccccuucgggcagcagcgcguguucaaggagaaggucgacacccggaccccgcgcagcaugcccggcacgcggcgcgugaugggcaucaccgcggaguggcucuggcggacccuggggcgcaacaagaagccccggcugugcacccgcgaggaguucacgaagaaggugcgcaccaacgccgccaugggcgccgucuucaccgaggagaaccagugggacuccgcgaaggccgccguggaggacgaggacuucuggaagcucguggaccgggagcgcgagcugcacaagcuggggaagugcggcagcugcgucuacaacaugauggggaagcgggagaagaagcucggcgaguucggcaaggccaaggggucccgcgccaucugguacauguggcugggcgcgcgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgccgacgacaccgccgggugggacacgcgcaucaccgaggacgaccugcacaacgaggagaagaucacccagcagauggacccggagcaccggcagcucgcgaacgccaucuucaagcugaccuaccagaacaagguggucaaggugcagcgccccacccccacgggcaccgugauggacaucaucagccggaaggaccagcgcggcuccgggcaggucggcaccuacgggcugaacaccuucacgaacauggaggcccagcucauccggcagauggagggcgagggggugcugagcaaggccgaccuggagaacccccaccucccggagaagaagaucacccaguggcuggagaccaagggcguggagcgccugaagcggauggccaucuccggcgacgacugcgucgugaagcccaucgacgaccgcuucgcgaacgcccuccuggcccugaacgacauggggaaggugcggaaggacaucccccaguggcagcccagcaagggcuggcacgacuggcagcaggucccguucugcucccaccacuuccacgagcucaucaugaaggacgggcgcaagcugguggugcccugccggccccaggacgagcugaucggccgcgcccggaucagccagggggccggcuggucccuccgcgagaccgcgugccugggcaaggccuacgcccagauguggagccugauguacuuccaccgccgggaccuccgccuggccuccaacgcgaucugcagcgccguccccgugcacugggugccgacgucccggaccaccuggagcauccacgcccaccaccaguggaugaccacggaggacaugcugaccgucuggaaccgcguguggaucgaggacaaccccuggauggaggacaagacccccgugaccacgugggagaacguccccuaccucgggaagcgggaggaccaguggugcggcagccugaucgggcugaccucccgcgccaccugggcccagaacaucccgaccgcgauccagcagguccggagccucaucggcaacgaggaguuccuggacuacaugcccuccaugaagcgcuuccggaaggaggaggagagcgagggggccaucugguga

SEQ ID NO: 10201 - RNA, 9873 nt, Artificial Sequence
  derived and/or modified CDS sequence (opt1) from DENV-3__FJ478456__SS-prME
accagccugugccucaugaugauccugcccgccgcccuggccuuccaccucaccagccgggacggggagccccggaugaucguggggaagaacgagcgcggcaagagccugcuguucaagaccgccagcgggaucaacaugugcacccucaucgccauggaccugggcgagaugugcgacgacaccgugaccuacaagugcccccacaucgccgagguggagcccgaggacaucgacugcuggugcaaccugaccagcaccugggugaccuacgggaccugcaaccaggccggcgagcaccggcgcgacaagcgguccgucgcgcucgcgccccacgugggcauggggcuggacacgcgcacccagaccuggaugagcgccgagggcgccuggcgccagguggagaaggucgagaccugggcgcugcgccacccgggguucacgauccucgcccuguuccuggcccacuacaucggcaccucccucacccagaagguggugaucuucauccugcugaugcucgucacccccagcaugacgaugcggugcgugggggugggcaaccgcgacuucgucgagggccuguccggggccaccuggguggacgugguccuggagcacggcgggugcgugaccaccauggccaagaacaagcccacgcucgacaucgagcugcagaagaccgaggcgacccagcuggccacccuccggaagcugugcaucgagggcaagaucacgaacaucaccaccgacagccgcugccccacccagggcgaggccgugcugccggaggagcaggaccagaacuacgucugcaagcacacguacguggaccggggguggggcaacgggugcggccucuucgggaagggcucccuggugaccugcgccaaguuccagugccuggagcccaucgagggcaaggucgugcaguacgagaaccucaaguacaccgugaucaucaccguccacacgggggaccagcaccaggugggcaacgagacccagggggucaccgccgagaucacgccccaggcgagcacgaccgaggccauccugcccgaguacggcacccuggggcucgagugcuccccgcgcaccggccuggacuucaacgagaugauccugcucaccaugaagaacaaggccuggauggugcaccggcagugguucuucgaccugccccugcccuggacgagcggcgccaccaccgagacccccacguggaaccgcaaggagcuccuggugaccuucaagaacgcccacgcgaagaagcaggaggucguggugcuggggucccaggagggcgccaugcacaccgcccucaccggggccacggagauccagaacagcggcgggaccuccaucuucgccggccaccugaagugccggcugaagauggacaagcucgagcugaagggcaugagcuacgcgaugugcaccaacaccuucguccugaagaaggagguguccgagacgcagcacgggaccauccucaucaagguggaguacaagggcgaggacgucccgugcaagauccccuucagcaccgaggacgggcagggcaaggcccacaacggccgccugaucaccgccaaccccguggugacgaagaaggaggagcccgucaacaucgaggccgagccgcccuucggggagagcaacaucgugaucggcaucggggacaacgcgcugaagaucaacugguacaagaagggcuccagcaucgggaagauguucgaggccaccgcccggggcgcccgccggauggccauccugggcgacaccgcgugggacuucggguccgugggcgggguccucaacagccugggcaagauggugcaccagaucuucggguccgccuacaccgcccuguucagcggcguguccugggucaugaagaucggcaucggggugcuccugacguggaucggccugaacagcaagaacaccuccaugagcuucuccugcaucgccaucgggaucaucacccucuaccugggcgccgugguccaggcggacaccgggugcgugaucaacuggaagggcaaggagcugaagugcggcagcgggaucuucgugacgaacgagguccacaccuggaccgagcaguacaaguuccaggccgacucccccaagcgccucgccaccgccaucgccggcgcgugggagaacggggugugcggcauccgcagcacgacccggauggagaaccugcuguggaagcagaucgccaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgcgucccgggccuggaacgugugggagguggaggacuacggguucggcgucuucaccaccaacaucuggcucaagcugcgcgagguguacacccagcugugcgaccaccggcucaugagcgccgccgugaaggacgagcgcgccguccacgcggacaugggcuacuggaucgagagccagaagaacggguccuggaagcuggagaaggccagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgcgauccuguucgaggaggugaugcgggggaaguucggcaagaagcacaugaucgccgggguguucuucaccuucguccugcuccuguccggccagaucaccuggcgcgacauggcccacacccugaucaugaucggcagcaacgccuccgaccggauggggaugggcgugacguaccucgcccugaucgcgaccuucaagauccagcccuuccuggcccucggguucuuccugcgcaagcugaccagccgggagaaccuccugcugggcgugggccucgccauggccaccacgcugcagcugcccgaggacaucgagcagauggcgaacgggaucgcccucggccugauggcccugaagcucaucacccaguucgagaccuaccagcuguggaccgcccugaucagccucacgugcuccaacaccaucuucacccugaccgucgccuggcgcacggcgacccugauccucgccggggugagcauccugccggucugccaguccagcuccaugcggaaguccgacuggcugcccaugaccguggccgccaugggcgugccgccccucccgcuguucaucuucucccugaaggacacccucaagcgccgcagcuggccccugaacgagggggucauggccgugggccugguguccauccucgcgagcucccugcugcggaacgacguccccauggccggcccccucguggccgggggccugcugaucgccugcuacgugaucacggggaccagcgccgaccucaccgucgagaaggcggccgacgugaccugggaggaggaggccgagcagacgggcgugucccacaaccugaugaucaccgucgacgacgacgggaccaugcgcaucaaggacgacgagaccgagaacauccugaccgugcuccugaagacggcccugcucaucgugagcggcaucuucccguacuccauccccgccacccugcuggucuggcacaccuggcagaagcagacccggcgcagcggcgugcucugggacgugcccagcccgcccgagacgcagaaggcggagcuggaggagggggucuaccggaucaagcagcagggcaucuucgggaagacccaggugggcguggggguccagaaggagggcguguuccacaccauguggcacgugacccgcggcgccguccugacguacaacgggaagcggcucgagcccaacugggccagcgugaagaaggaccugaucuccuacggcgggggcuggcgccugagcgcccaguggcagaagggggaggaggugcaggucaucgcgguggagcccggcaagaaccccaagaacuuccagaccaugcccggcaccuuccagaccacgaccggggagaucggcgccaucgcccucgacuucaagcccgggaccagcggcucccccaucaucaaccgggagggcaagguggucgggcuguacggcaacgggguggugaccaagaacggcggguacgucagcggcaucgcccagacgaacgccgagccggacggccccacccccgagcuggaggaggagauguucaagaagcgcaaccugaccaucauggaccuccaccccggguccggcaagacccggaaguaccugccggcgaucgugcgcgaggccaucaagcggcgccugcggacgcucauccuggcccccacccgcguggucgccgccgagauggaggaggcgcugaaggggcuccccauccgguaccagaccaccgccaccaagagcgagcacaccggccgcgagaucguggaccugaugugccacgccaccuucaccaugcggcugcucucccccgugcgcgucccgaacuacaaccugaucaucauggacgaggcccacuucacggaccccgccagcaucgcggcccggggguacaucuccacccgcgugggcaugggcgaggccgccgcgaucuucaugaccgccacgccgcccgggacggccgacgccuucccgcagagcaacgcccccauccaggacgaggagcgcgacauccccgagcgguccuggaacagcggcaacgaguggaucaccgacuucgcggggaagaccgugugguucguccccuccaucaaggccggcaacgacaucgccaacugccugcgcaagaacgggaagaaggugauccagcucagccggaagaccuucgacacggaguaccagaagaccaagcugaacgacugggacuucguggucaccaccgacaucuccgagaugggcgccaacuucaaggccgaccgcgugaucgacccgcggcgcugccugaagcccgugauccucacggacggccccgagcgggucauccuggcggggcccaugccggugaccgccgccagcgccgcccagcgccggggccgcguggggcggaacccccagaaggagaacgaccaguacaucuucaccggccagccccugaacaacgacgaggaccacgcgcacuggaccgaggccaagaugcuccuggacaacaucaacacccccgaggggaucaucccggcccuguucgagcccgagcgcgagaaguccgccgcgaucgacggcgaguaccggcucaagggcgagagccgcaagacguucgucgagcugaugcggcgcggggaccugcccguguggcucgcccacaaggucgccuccgagggcaucaaguacaccgaccggaaguggugcuucgacgggcagcgcaacaaccagauccuggaggagaacauggacguggagaucuggaccaaggagggcgagaagaagaagcugcggccccgcuggcucgacgcccgcaccuacagcgacccgcuggcccugaaggaguucaaggacuucgcggccggccggaaguccaucgcccucgaccuggugacggagaucgggcgcguccccagccaccuggcccaccggacccgcaacgcccucgacaaccuggugaugcugcacaccagcgagcacggcgggaaggcguaccggcacgccguggaggagcuccccgagaccauggagacgcugcugcuccugggccugaugauccuccugaccgggggcgccaugcuguuccucaucuccggcaaggggaucggcaagaccagcaucgggcugaucugcgucaucgccuccagcggcaugcuguggauggccgagaucccgcuccaguggaucgcguccgccaucgugcuggaguucuucaugauggugcugcucauccccgagcccgagaagcagcgcacgccccaggacaaccagcuggccuacgucgugaucgggauccugacgcucgccgccaucaucgcggccaacgagaugggccugcuggagaccaccaagcgggaccucggcaugagcaaggagccggggguggucucccccaccagcuaccuggacguggaccugcaccccgccuccgccuggacgcucuacgcgguggccaccaccgucaucacccccaugcugcgccacacgaucgagaacagcaccgccaacgugucccuggccgccaucgcgaaccaggccgugguccucaugggccuggacaagggguggccgaucagcaagauggaccugggcgugccccuccuggcccuggggugcuacucccaggugaacccccucacccugaccgccgccguccugcuccugaucacgcacuacgcgaucaucggccccggccugcaggccaaggccacccgggaggcccagaagcgcaccgccgcggggaucaugaagaacccgaccguggacggcaucaugacgaucgaccucgaccccgugaucuacgacagcaaguucgagaagcagcuggggcaggucaugcugcucgugcugugcgccgugcagcugcuccugaugcggaccuccugggcccugugcgaggcccucacccuggcgaccggccccaucacgacccugugggagggcagccccgggaaguucuggaacaccaccaucgccgucuccauggccaacaucuuccgcggcagcuaccucgccggggccggccuggcguucuccaucaugaaguccguggggacgggcaagcggggcaccgggagccagggcgagacccugggggagaaguggaagaagaagcucaaccagcugucccgcaaggaguucgaccuguacaagaaguccggcaucaccgagguggaccggaccgaggccaaggaggggcucaagcgcggcgagaucacgcaccacgccgucucccggggcagcgccaagcugcagugguucguggagcgcaacauggugaucccggaggggcgggucaucgaccugggcugcgggcgcggcgggugguccuacuacugcgccggccucaagaaggugaccgaggugcggggcuacaccaagggcgggcccgggcacgaggagcccguccccaugagcaccuacggcuggaacaucgugaagcugauguccgggaaggacguguucuaccugccgcccgagaagugcgacacgcuccugugcgacaucggcgagagcucccccagccccaccgucgaggagucccgcaccauccgcgugcugaagaugguggagccguggcugaagaacaaccaguucugcaucaagguccucaaccccuacaugcccaccgugaucgagcaccuggagcggcugcagcgcaagcacggcgggaugcucgugcggaacccccugagccgcaacuccacgcacgagauguacuggaucagcaacggcaccgggaacaucgucgcguccgugaacauggugagccggcugcuccugaaccgcuucaccaugacccaccggcgcccgacgaucgagaaggacgucgaccugggcgccggcacccggcacgugaacgccgagcccgagacccccaacauggacgugaucggggagcgcaucaagcggaucaaggaggagcacaacuccaccuggcacuacgacgacgagaacccguacaagacgugggccuaccacggcagcuacgaggucaaggccaccggguccgcgagcagcaugaucaacggcguggucaagcuccugaccaagcccugggacguggugcccauggucacccagauggccaugacggacaccacccccuucgggcagcagcgcguguucaaggagaagguggacacccggacgccgcgcuccaugcccggcacccggcgcgucaugggcaucaccgccgaguggcuguggcggacccucgggcgcaacaagaagccccggcugugcacgcgcgaggaguucaccaagaaggugcgcaccaacgccgcgaugggcgccguguucaccgaggagaaccagugggacagcgccaaggccgccgucgaggacgaggacuucuggaagcugguggaccgggagcgcgagcuccacaagcuggggaagugcggcuccugcguguacaacaugauggggaagcgggagaagaagcugggcgaguucggcaaggcgaaggggagccgcgccaucugguacauguggcucggcgcccgguaccuggaguucgaggcccugggguuccucaacgaggaccacugguucucccgcgagaacagcuacuccggcgucgagggggagggccugcacaagcugggcuacauccuccgggacaucagcaagauccccgggggcgccauguacgcggacgacacggccgggugggacacccgcaucaccgaggacgaccugcacaacgaggagaagaucacccagcagauggacccggagcaccggcagcuggccaacgccaucuucaagcucacguaccagaacaagguggugaagguccagcgccccacccccaccggcaccgugauggacaucaucucccggaaggaccagcgcggcagcggccaggugggcaccuacgggcugaacacguucaccaacauggaggcccagcugauccggcagauggagggcgaggggguccucuccaaggcggaccuggagaacccccaccugagcgagaagaagaucacccaguggcucgagaccaagggcguggagcgccugaagcggauggccaucuccggcgacgacugcguggucaagccgaucgacgaccgcuucgccaacgcccugcucgcccugaacgacauggggaaggugcggaaggacaucccccaguggcagcccagcaagggcuggcacgacuggcagcagguccccuucugcucccaccacuuccacgagcugaucaugaaggacgggcgcaagcucgucgugccgugccggccccaggacgagcugaucggccgcgcgcggaucagccagggggccggcuggucccugcgcgagacggccugccucggcaaggccuacgcgcagauguggagccugauguacuuccaccgccgggaccugcgccucgccuccaacgccaucugcagcgccgugcccguccacugggugcccaccagccggaccaccugguccauccacgcccaccaccaguggaugacgaccgaggacaugcugaccguguggaaccgcgucuggaucgaggacaacccguggauggaggacaagacccccgugacgaccugggagaacgugcccuaccuggggaagcgggaggaccaguggugcggcagccucaucgggcugaccucccgcgcgaccugggcccagaacauccccacggccauccagcagguccggagccugaucggcaacgaggaguuccucgacuacaugccguccaugaagcgcuuccggaaggaggaggagagcgagggggccaucugguga

SEQ ID NO: 10202 - RNA, 9873 nt, Artificial Sequence
  derived and/or modified CDS sequence (opt1) from DENV-3__FJ547085__SS-prME
accagccucugccucaugaugauccugcccgcggcgcuggcguuccaccucaccagccgggacggcgagccgcggaugaucguggggaagaacgagcggggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggaccugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacacggggugcgugaucaacuggaagggcaaggagcugaagugcggcagcgggaucuucgugaccaacgagguccacaccuggaccgagcaguacaaguuccaggcggacucccccaagcgccucgccacggccaucgccggcgccugggagaacggggugugcggcauccgcagcaccacccggauggagaaccugcuguggaagcagaucgcgaacgagcucaacuacauccugugggagaacaacaucaagcugaccguggucgugggggacaucaucggcgugcucgagcagggcaagcgcacgcugacgccccagccgauggagcugaaguacuccuggaagaccugggggaaggcccggaucgucaccgccgagacgcagaacagcuccuucaucaucgacggccccaacacccccgagugccccaacaccagccgcgccuggaacgugugggagguggaggacuacggguucggcgucuucaccaccaacaucuggcucaagcugcgggagguguacacgcagcugugcgaccaccgccucauguccgcggccgugaaggacgagcgggccguccacgccgacaugggcuacuggaucgagagccagaagaacgggagcuggaagcuggagaaggccucccugaucgaggugaagaccugcaccuggcccaagagccacacccucugguccaacggcgugcuggagagcgacaugaucauccccaagucccuggcggggcccaucagccagcacaacuaccgcccgggcuaccacacgcagaccgccgggcccuggcaccucggcaagcuggagcuggacuucaacuacugcgagggcaccaccgucgugaucacggagaacugcgggacccggggccccucccuccgcaccaccacggugagcgggaagcugauccacgaguggugcugccgguccugcacccugcccccgcuccgcuacaugggcgaggacgggugcugguacggcauggagauccggcccaucagcgagaaggaggagaacauggucaagucccuggugagcgccggcuccggggagguggacaacuucaccaugggcguccugugccucgccauccuguucgaggaggugaugcgcgggaaguucggcaagaagcacaugaucgccgggguguucuucaccuucguccugcuccugagcggccagaucacguggcgggacauggcgcacacccugaucaugaucggcuccaacgccaccgaccgcauggggaugggcgugaccuaccucgcccugaucgccacguucaagauccagcccuuccuggcccucggguucuuccugcggaagcugaccagccgcgagaaccuccugcugggcgugggccucgcgauggccaccacccugcagcugcccgaggacaucgagcagauggccaacgggaucgcccucggccugauggcgcugaagcucaucacgcaguucgagaccuaccagcuguggaccgcccugaucucccugaccugcagcaacacgaucuucacccugaccgucgccuggcggaccgccacgcugauccucgccggggugagccugcugccggucugccaguccagcuccaugcgcaagaccgacuggcuccccaugaccguggcggccaugggcgugccgccccucccgcuguucaucuucagccucaaggacacccugaagcgccgguccuggccccugaacgagggggucauggccgugggccucgugagcauccuggccuccagccugcuccgcaacgacguccccauggccggcccccugguggccggcgggcugcucaucgccugcuacgugaucacggggaccuccgccgaccugaccgucgagaaggccgccgacgugaccugggaggaggaggcggagcagaccggggugagccacaaccugaugaucacggucgacgacgacgggaccaugcggaucaaggacgacgagaccgagaacauccucaccgugcugcugaagacggcccuccugaucguguccggcaucuucccguacagcauccccgccacccugcucgucuggcacaccuggcagaagcagacccagcgcuccggcgugcugugggacgugcccagcccgcccgagacgcagaaggccgagcuggaggagggggucuaccggaucaagcagcagggcaucuucgggaagacccaggugggcguggggguccagaaggagggcguguuccacaccauguggcacgugacccgcggcgccguccucacguacaacgggaagcggcuggagcccaacugggcguccgugaagaaggaccugaucagcuacggcgggggcuggcgccucuccgcccaguggcagaagggggaggaggugcaggucaucgccguggagcccggcaagaaccccaagaacuuccagaccaugcccggcaccuuccagaccacgaccggggagaucggcgccaucgcgcuggacuucaagcccgggaccagcggcucccccaucaucaaccgggagggcaagguggucgggcuguacggcaacgggguggugaccaagaacggcggguacgucagcggcaucgcccagacgaacgccgagccggacggccccacccccgagcuggaggaggagauguucaagaagcgcaaccucaccaucauggaccugcaccccgggagcggcaagacccggaaguaccugccggccaucgugcgcgaggccaucaagcggcgccuccggacgcugauccuggcgcccacccgcguggucgccgccgagauggaggaggcccucaaggggcugcccauccgguaccagaccaccgccacgaaguccgagcacaccggccgcgagaucguggaccugaugugccacgcgaccuucaccaugcggcuccugagccccgugcgcgucccgaacuacaaccugaucaucauggacgaggcccacuucacggaccccgccuccaucgccgcccggggguacaucagcacccgcgugggcaugggcgaggcggccgccaucuucaugaccgccacgccgcccgggacggcggacgccuucccgcaguccaacgcccccauccaggacgaggagcgcgacauccccgagcggagcuggaacuccggcaacgaguggaucaccgacuucgccgggaagaccgugugguucguccccagcaucaaggccggcaacgacaucgcgaacugccuccgcaagaacgggaagaaggugauccagcugucccggaagaccuucgacacggaguaccagaagaccaagcugaacgacugggacuucguggucaccaccgacaucagcgagaugggcgccaacuucaaggccgaccgcgugaucgacccgcggcgcugccucaagcccgugauccugaccgacggccccgagcgggucauccuggccgggcccaugccggugacggccgcguccgccgcccagcgccggggccgcguggggcggaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgcgagaaguccgccgccaucgacggcgaguaccggcugaagggcgagucccgcaagacguucgucgagcugaugcggcgcggggaccuccccguguggcuggcccacaaggucgcgagcgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcccgcaccuacuccgacccgcuggcccucaaggaguucaaggacuucgccgccggccgcaagagcaucgcgcuggaccuggugacggagaucgggcgcguccccacccaccucgcccaccggacccgcaacgcccuggacaaccuggugaugcuccacaccuccgagcacggcgggaaggccuaccggcacgccguggaggagcugcccgagacgauggagacccugcuccugcugggccucaugauccugcugaccgggggcgcgaugcuguuccugaucagcggcaaggggaucggcaagaccuccaucgggcugaucugcgucaucgccagcagcggcaugcucuggauggccgagaucccgcugcaguggaucgccuccgccaucgugcuggaguucuucaugauggugcuccugauccccgagcccgagaagcagcgcacgccccaggacaaccagcuggcguacgucgugaucgggauccucacccuggccgccaucaucgccgccaacgagaugggccugcucgagaccaccaagcgggaccugggcaugagcaaggagccggggguggucucccccacgagcuaccuggacguggaccuccaccccgcguccgccuggacccuguacgccguggccaccaccgucaucacgcccaugcugcgccacaccaucgagaacagcaccgcgaacgugucccucgccgccaucgccaaccaggccgugguccugaugggccuggacaagggguggccgaucagcaagauggaccucggcgugccccugcuggcgcucgggugcuacucccaggugaacccccugacccugacggccgccguccuccugcugaucacccacuacgccaucaucggccccggccuccaggccaaggcgacccgggaggcccagaagcgcaccgccgccgggaucaugaagaacccgacgguggacggcaucaugaccaucgaccuggaccccgugaucuacgacagcaaguucgagaagcagcuggggcaggucaugcuccuggugcugugcgccgugcagcuccugcugaugcggaccuccugggcgcucugcgaggcccugacccuggccacgggccccaucaccacccucugggagggcagccccgggaaguucuggaacaccaccaucgccgucuccauggcgaacaucuuccgcggcagcuaccuggccggggccggccuggccuucuccaucaugaaguccguggggacgggcaagcggggcaccgggucccagggcgagacccucggggagaaguggaagaagaagcugaaccagcugagccgcaaggaguucgaccucuacaagaaguccggcaucaccgagguggaccggacggaggccaaggaggggcugaagcgcggcgagaucacccaccacgcggucagccggggcaccgccaagcugcagugguucguggagcgcaacauggugaucccggaggggcgggucaucgaccucggcugcgggcgcggcggguggagcuacuacugcgccggccugaagaaggugaccgaggugcggggcuacacgaagggcggccccgggcacgaggagcccguccccauguccaccuacggcuggaacaucgugaagcugaugagcgggaaggacguguucuaccucccgcccgagaagugcgacacccugcugugcgacaucggcgaguccagccccucccccaccgucgaggagagccgcacgauccgcgugcugaagaugguggagccguggcucaagaacaaccaguucugcaucaagguccugaaccccuacaugcccgccgugaucgagcaccuggagcggcuccagcgcaagcacggcgggaugcuggugcggaacccccugucccgcaacagcacccacgagauguacuggaucuccaacggcaccgggaacaucgucgccagcgugaacauggugucccggcuccugcugaaccgcuucaccaugacgcaccggcgcccgaccaucgagaaggacgucgaccucggcgcgggcacccggcacgugaacgccgagcccgagacccccaacauggacgugaucggggagcgcaucaagcggaucaaggaggagcacaacagcacguggcacuacgacgacgagaacccguacaagaccugggccuaccacggcuccuacgaggucaaggccaccgggagcgccuccagcaugaucaacggcguggucaagcugcugaccaagcccugggacguggugcccauggucacgcagauggcgaugaccgacaccacccccuucgggcagcagcgcguguucaaggagaagguggacacgcggaccccgcgcuccaugcccggcacccggcgcgucauggagaucaccgccgaguggcucuggcggacgcugggccgcaacaagaagccccggcugugcacccgcgaggaguucaccaagaaggugcgcaccaacgccgccaugggggcgguguucacggaggagaaccagugggacagcgccaaggccgccgucgaggacgaggacuucuggaagcucguggaccgggagcgcgagcugcacaagcugggcaagugcggguccugcguguacaacaugaugggcaagcgggagaagaagcucggggaguucggcaaggccaagggcagccgcgcgaucugguacauguggcugggggcccgguaccuggaguucgaggcccucggcuuccugaacgaggaccacugguucagccgcgagaacuccuacagcggggucgagggcgaggggcugcacaagcucggcuacauccugcgggacaucuccaagauccccggcggggccauguacgccgacgacaccgcgggcugggacacccgcaucaccgaggacgaccugcacaacgaggagaagaucacccagcagauggacccggagcaccggcagcucgccaacgccaucuucaagcugacguaccagaacaagguggugaagguccagcgccccacccccaccgggaccgugauggacaucaucagccggaaggaccagcgcggcuccggccagguggggacguacggccugaacaccuucaccaacauggaggcccagcucauccggcagauggagggggagggcguccugagcaaggccgaccuggagaacccccaccucccggagaagaagaucacccaguggcuggagacgaaggggguggagcgccugaagcggauggcgaucuccggcgacgacugcguggucaagcccaucgacgaccgcuucgccaacgcccuccuggcccugaacgacaugggcaaggugcggaaggacaucccccaguggcagcccagcaagggguggcacgacuggcagcaggucccguucugcucccaccacuuccacgagcucaucaugaaggacggccgcaagcuggucgugcccugccggccccaggacgagcugaucgggcgcgcccggaucagccagggcgcgggguggucccuccgcgagaccgccugccugggcaaggccuacgcccagauguggagccugauguacuuccaccgccgggaccuccgccuggcguccaacgccaucugcagcgccgugcccguccacugggugccgaccucccggaccacguggagcauccacgcccaccaccaguggaugaccaccgaggacaugcugaccguguggaaccgcgucuggaucgaggacaaccccuggauggaggacaagacgcccgugaccaccugggagaacgugcccuaccucggcaagcgggaggaccaguggugcgggucccugaucggccugaccagccgcgccacgugggcgcagaacaucccgaccgccauccagcagguccggucccucaucgggaacgaggaguuccuggacuacaugcccagcaugaagcgcuuccggaaggaggaggagagcgagggcgccaucugguga

SEQ ID NO: 10203 - RNA, 9873 nt, Artificial Sequence
  derived and/or modified CDS sequence (opt1) from DENV-3__EU482595__SS-prME
accagccucugccucaugaugaugcugcccgcggcccuggcguuccaccucaccagccgggacggcgagccgcggaugaucguggggaagaacgagcgcggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacgugggcaccucccucacccagaagguggucaucuucauccugcugaugcucgugacgcccagcaugaccaugcggugcgugggggucggcaaccgcgacuucguggagggccuguccggggccaccuggguggacgucgugcuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccguccugccggaggagcaggaccagaacuacgugugcaagcacaccuacguggaccggggguggggcaacgggugcggccucuucgggaagggcucccuggugaccugcgccaaguuccagugccuggagcccaucgagggcaagguggugcaguacgagaaccucaaguacaccgucaucaucacggugcacaccggggaccagcaccaggucggcaacgagacccagggggugaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggucaccuucaagaacgcccacgccaagaagcaggagguggugguccuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucgugcugaagaaggagguguccgagacccagcacgggaccauccucaucaaggucgaguacaagggcgaggacgugccgugcaaggugcccuucagcaccgaggacgggcagggcaaggcgcacaacggccgccugaucacggccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacaccgccugggacuucggguccgugggcggggugcucaacagccugggcaagaugguccaccagaucuucggguccgcguacacggcccuguucagcggcguguccugggugaugaagaucggcaucgggguccuccugaccuggaucggccugaacagcaagaacaccuccaugagcuucuccugcaucgugaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggccgacucccccaagcgccucgcgaccgccaucgccggcgccugggagaacggggugugcggcauccgcagcacgacccggauggagaaccugcuguggaagcagaucgccaacgagcucaacuacauccugugggagaacaacaucaagcugaccguggucgugggggacaucaucggcgugcucgagcagggcaagcgcauccugacgccccagccgauggagcugaaguacuccuggaagacgugggggaaggcgaagaucgucaccgccgagacccagaacagcuccuucaucaucgacggccccaacacccccgagugccccagcgccucccgggccuggaacgugugggagguggaggacuacggguucggcgucuucagcacgaacaucuggcucaagcugcgcgagguguacacccagcugugcgaccaccggcucaugagcgcggccgugaaggacgagcgcgccguccacgccgacaugggcuacuggaucgagucccagaagaacgggagcuggaagcuggagaaggccucccugaucgaggugaagaccugcaccuggcccaagucccacacccucugguccaacggcgugcuggagagcgacaugaucauccccaagucccuggcggggcccaucagccagcacaacuaccggccgggcuaccacacgcagaccgccgggcccuggcaccucggcaagcuggagcuggacuucaacuacugcgagggcaccaccgucgugaucacggagaacugcgggacccgcggccccucccuccggaccaccacggugagcgggaagcugauccacgaguggugcugccgcuccugcacccugcccccgcuccgguacaugggcgaggacgggugcugguacggcauggagauccgccccaucagcgagaaggaggagaacauggucaagucccuggugagcgccggcuccgggaagguggacaacuucaccaugggcguccugugccucgccauccuguucgaggaggugaugcgggggaaguucggcaagaagcacaugaucgccgggguguucuucaccuucguccugcuccugagcggccagaucacguggcgcgacauggcgcacacccugaucaugaucggcuccaacgccagcgaccggauggggaugggcgugaccuaccucgcccugaucgccaccuucaagauccagcccuuccuggcccucggguucuuccugcgcaagcugacgagccgggagaaccuccugcugggcgucggccucgcgauggccaccacccugcagcugcccgaggacaucgagcagauggccaacgggaucgcccucggccugauggcgcugaagcucaucacccaguucgagacguaccagcuguggaccgcccugaucucccugaccugcagcaacaccaucuucacgcugaccguggccuggcgcaccgccacccugauccucgccggggugucccugcugccggucugccagagcuccagcaugcggaagacggacuggcuccccaugaccguggcggccaugggcgugccgccccucccgcuguucaucuucucccucaaggacacccugaagcgccgcagcuggccccugaacgagggggucauggccgugggccucguguccauccuggccagcucccugcuccggaacgacguccccauggccggcccccugguggccggcgggcugcucaucgccugcuacgugaucaccgggacgagcgccgaccugaccgucgagaaggccgccgacgugaccugggaggaggaggcggagcagaccggggugucccacaaccugaugaucacggucgacgacgacgggaccaugcgcaucaaggacgacgagaccgagaacauccucaccgugcugcugaagaccgcccuccugaucgugagcggcaucuucccguacuccauccccgccacgcugcucgucuggcacaccuggcagaagcagacccagcggagcggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacccggggcgccguccucaccuacaacgggaagcgccuggagcccaacugggcgagcgugaagaaggaccugaucuccuacggcgggggcuggcggcucagcgcccaguggcagaagggggaggaggugcaggucaucgccguggagcccggcaagaaccccaagaacuuccagacgaugcccggcaccuuccagaccaccacgggggagaucggcgccaucgcgcuggacuucaagcccgggaccagcggcucccccaucaucaaccgcgagggcaagguggucgggcuguacggcaacgggguggugaccaagaacggcggguacgucagcggcaucgcccagaccaacgccgagccggacggccccgcccccgagcuggaggaggagauguucaagaagcggaaccucacgaucauggaccugcaccccggguccggcaagacccgcaaguaccugccggccaucgugcgggaggcgaucaagcgccggcuccgcacccugauccuggcccccacccggguggucgccgccgagauggaggaggcccucaaggggcugcccauccgcuaccagacgaccgcgaccaagagcgagcacaccggccgggagaucguggaccugaugugccacgccacguucaccaugcgccuccugucccccgugcgggucccgaacuacaaccugaucaucauggacgaggcccacuucaccgaccccgccagcaucgccgcgcgcggguacaucuccacccgggugggcaugggcgaggccgccgccaucuucaugacggcgacgccgcccgggaccgccgacgccuucccgcagagcaacgcccccauccaggacgaggagcgcgacauccccgagcgcuccuggaacagcggcaacgaguggaucaccgacuucgccgggaagacggugugguucguccccuccaucaaggcgggcaacgacaucgccaacugccuccggaagaacgggaagaaggugauccagcugagccgcaagaccuucgacaccgaguaccagaagaccaagcugaacgacugggacuucguggucacgaccgacaucuccgagaugggcgccaacuucaaggccgaccgggugaucgacccgcgccggugccucaagcccgugauccugaccgacggccccgagcgcgucauccuggccgggcccaugccggugaccgcggccagcgccgcccagcggcgcggccgggucgggcgcaacccccagaaggagaacgaccaguacaucuucacgggccagccccucaacaacgacgaggaccacgcccacuggaccgaggcgaagaugcugcuggacaacaucaacacccccgaggggaucaucccggcccucuucgagcccgagcgggagaaguccgccgccaucgacggcgaguaccgccugaagggcgagagccggaagaccuucguggagcugaugcgccgcggggaccuccccguguggcuggcgcacaaggucgccuccgagggcaucaaguacaccgaccgcaaguggugcuucgacgggcagcggaacaaccagauccuggaggagaacauggacguggagaucuggacgaaggagggcgagaagaagaagcuccgcccccgguggcuggacgcccgcaccuacagcgacccgcuggcccucaaggaguucaaggacuucgccgcgggccgcaaguccaucgcccuggaccuggugaccgagaucgggcggguccccagccaccucgcccaccgcacccggaacgcccuggacaaccuggugaugcuccacacgagcgagcacggcgggaaggccuaccgccacgcgguggaggagcugcccgagaccauggagacccugcuccugcugggccucaugauccugcugaccgggggcgccaugcuguuccugaucuccggcaaggggaucggcaagacgagcaucgggcugaucugcgucaucgccuccagcggcaugcucuggauggccgagaucccgcugcaguggaucgccuccgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccacgaagcgcgaccugggcaugagcaaggagccggggguggucucccccaccagcuaccuggacguggaccuccaccccgccuccgccuggacccuguacgccguggcgaccacggucaucacccccaugcugcggcacaccaucgagaacagcaccgccaacgugucccucgccgccaucgccaaccaggcggugguccugaugggccuggacaagggguggccgaucagcaagauggaccucggcgugccccugcuggcccucgggugcuacucccaggugaacccccugacgcugaccgccgccguccuccugcugaucacccacuacgccaucaucggccccggccuccaggcgaaggccacccgcgaggcccagaagcggacggccgccgggaucaugaagaacccgaccguggacggcaucaugaccaucgaccuggaccccgugaucuacgacagcaaguucgagaagcagcuggggcaggucaugcuccuggugcugugcgcggugcagcuccugcugaugcgcaccuccugggcccucugcgaggcccugacgcuggccaccggccccaucaccacccucugggagggcagccccgggaaguucuggaacacgaccaucgcggucuccauggccaacaucuuccggggcagcuaccuggccggggccggccuggccuucuccaucaugaaguccguggggaccggcaagcgcggcaccgggagccagggcgagacgcucggggagaaguggaagaagaagcugaaccagcugucccggaaggaguucgaccucuacaagaaguccggcaucaccgagguggaccgcaccgaggcgaaggaggggcugaagcggggcgagaucacccaccacgccgucucccgcggcagcgccaagcugcagugguucguggagcggaacauggugaucccggaggggcgcgucaucgaccucggcugcgggcggggcgggugguccuacuacugcgccggccugaagaaggugaccgaggugcgcggcuacacgaagggcgggcccgggcacgaggagcccguccccaugagcaccuacggcuggaacaucgugaagcugauguccgggaaggacguguucuaccucccgcccgagaagugcgacacccugcugugcgacaucggcgagagcucccccagccccaccgucgaggagucccggacgauccgcgugcugaagaugguggagccguggcucaagaacaaccaguucugcaucaagguccugaaccccuacaugcccaccgugaucgagcaccuggagcgccuccagcggaagcacggcgggaugcuggugcgcaacccccugagccggaacuccacccacgagauguacuggaucagcaacggcaccgggaacaucgucgccuccgugaacauggugagccgccuccugcugaaccgguucacgaugacccaccgccggccgaccaucgagaaggacgucgaccucggcgcgggcacccgccacgugaacgccgagcccgagacgcccaacauggacgucaucggggagcggaucaagcgcaucaaggaggagcacaacuccaccuggcacuacgacgacgagaacccguacaagaccugggccuaccacggcagcuacgaggugaaggccaccggguccgccagcagcaugaucaacggcguggucaagcugcugacgaagcccugggacguggugcccauggucacccagauggcgaugaccgacaccacgcccuucgggcagcagcggguguucaaggagaagguggacacccgcaccccgcgguccaugcccggcacccgccgggucaugggcaucacggccgaguggcucuggcgcacccuggggcggaacaagaagccccgccugugcacccgggaggaguucaccaagaaggugcgcacgaacgccgccaugggcgcgguguucaccgaggagaaccagugggacagcgccaaggccgccgucgaggacgaggacuucuggauccucguggaccgcgagcgggagcugcacaagcuggggaagugcggcuccugcguguacaacaugauggggaagcgcgagaagaagcucggcgaguucggcaaggccaaggggagccgggcgaucugguacauguggcugggcgcccgcuaccuggaguucgaggcccucggguuccugaacgaggaccacugguucucccgggagaacagcuacuccggcgucgagggggagggccugcacaagcucggcuacauccugcgcgacaucagcaagauccccgggggcgccauguacgccgacgacaccgcggggugggacacccggaucacggaggacgaccugcacaacgaggagaagaucacccagcagauggacccggagcaccgccagcucgccaacgccaucuucaagcugaccuaccagaacaagguggugaagguccagcggcccacccccacgggcaccgugauggacaucaucucccgcaaggaccagcggggcagcggccaggugggcaccuacgggcugaacaccuucaccaacauggaggcccagcucauccgccagauggagggcgaggggguccuguccaaggccgaccuggagaacccccaccucccggagaagaagaucacgcaguggcuggagaccaagggcguggagcggcugaagcgcauggcgaucagcggcgacgacugcguggucaagcccaucgacgaccgguucgccaacgcccuccuggcccugaacgacauggggaaggugcgcaaggacaucccccaguggcagcccuccaagggcuggcacgacuggcagcaggucccguucugcagccaccacuuccacgagcucaucaugaaggacgggcggaagcuggucgugcccugccgcccccaggacgagcugaucggccgggcccgcaucucccagggggcgggcuggagccuccgggagaccgccugccugggcaaggccuacgcccagauguggucccugauguacuuccaccgccgcgaccuccggcuggcgagcaacgccaucugcuccgccgugcccguccacugggugccgaccagccgcacgaccuggagcauccacgcccaccaccaguggaugaccaccgaggacaugcugacgguguggaaccgggucuggaucgaggacaaccccuggauggaggacaagacccccgugaccaccugggagaacgugcccuaccucgggaagcgcgaggaccaguggugcggcucccugaucgggcugacgagccgggccaccugggcgcagaacaucccgaccgccauccagcagguccgcucccucaucggcaacgaggaguuccuggacuacaugcccagcaugaagcgguuccgcaaggaggaggaguccgagggggccaucugguga

SEQ ID NO: 10204 - RNA, 9873 nt, Artificial Sequence
  derived and/or modified CDS sequence (opt1) from DENV-3__EU482596__SS-prME
accagccugugccucaugaugauccugcccgccgcccuggcguuccaccucaccagccgggacggggagccccggaugaucguggggaagaacgagcggggcaagagccugcuguucaagacggccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcgggaagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaaguccgagcacaccggccgggagaucguggaccugaugugccacgccaccuucacgaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucguccccagcaucaaggcgggcaacgacaucgccaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggugaccgagaucgggcggguccccucccaccucgcccaccgcacccggaacgcccuggacaaccuggugaugcuccacaccagcgagcacggcgggaaggccuaccgccacgcgguggaggagcugcccgagacgauggagacccugcuccugcugggccucaugauccugcugaccgggggcgccaugcuguuccugaucagcggcaaggggaucggcaagaccuccaucgggcugaucugcgucaucgccagcuccggcaugcucuggauggccgagaucccgcugcaguggaucgccagcgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccaccaagcgcgaccugggcauguccaaggagccggggguggucagccccacguccuaccuggacguggaccuccaccccgccagcgccuggacccuguacgccguggcgaccaccgucaucacgcccaugcugcggcacaccaucgagaacuccaccgccaacgugagccucgccgccaucgccaaccaggcggugguccugaugggccuggacaagggguggccgaucuccaagauggaccucggcgugccccugcuggcccucgggugcuacagccaggugaacccccugacccugacggccgccguccuccugcugaucacccacuacgccaucaucggccccggccuccaggcgaaggccacccgcgaggcccagaagcggaccgccgccgggaucaugaagaacccgacgguggacggcaucaugaccaucgaccuggaccccgugaucuacgacuccaaguucgagaagcagcuggggcaggucaugcuccuggugcugugcgcggugcagcuccugcugaugcgcaccagcugggcccucugcgaggcccugacccuggccacgggccccaucaccacccucugggagggcucccccgggaaguucuggaacaccacgaucgcggucagcauggccaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggaguucgaccucuacaagaaguccggcaucaccgagguggaccgcacggaggcgaaggaggggcugaagcggggcgagaucacccaccacgccgucagccgcggcuccgccaagcugcagugguucguggagcggaacauggugaucccggaggggcgcgucaucgaccucggcugcgggcggggcggguggagcuacuacugcgccggccugaagaaggugaccgaggugcgcggcuacaccaagggcgggcccgggcacgaggagcccguccccauguccacguacggcuggaacaucgugaagcugaugagcgggaaggacguguucuaccucccgcccgagaagugcgacacccugcugugcgacaucggcgaguccagccccucccccaccgucgaggagagccggaccauccgcgugcugaagaugguggagccguggcucaagaacaaccaguucugcaucaagguccugaaccccuacaugcccacggugaucgagcaccuggagcgccuccagcggaagcacggcgggaugcuggugcgcaacccccugucccggaacagcacccacgagauguacuggaucuccaacggcaccgggaacaucgucgccagcgugaacauggugucccgccuccugcugaaccgguucaccaugacgcaccgccggccgaccaucgagaaggacgucgaccucggcgcgggcacccgccacgugaacgccgagcccgagacccccaacauggacgugaucggggagcggaucaagcgcaucaaggaggagcacaacagcacguggcacuacgacgacgagaacccguacaagaccugggccuaccacggcuccuacgaggucaaggccaccgggagcgccuccagcaugaucaacggcguggucaagcugcugaccaagcccugggacguggugcccauggucacgcagauggcgaugaccgacaccacccccuucgggcagcagcggguguucaaggagaagguggacacgcgcaccccgcggagcaugcccggcacccgccgggucaugggcaucaccgccgaguggcucuggcgcacgcuggggcggaacaagaagccccgccugugcacccgggaggaguucaccaagaaggugcgcaccaacgccgccaugggcgcgguguucacggaggagaaccagugggacuccgccaaggccgccgucgaggacgaggacuucuggaagcucguggaccgcgagcgggagcugcacaagcuggggaagugcggcagcugcguguacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcgucgagggggagggccugcacaagcucggcuacauccugcgcgacaucuccaagauccccgggggcgccauguacgccgacgacaccgcggggugggacacccggaucaccgaggacgaccugcacaacgaggagaagaucacgcagcagauggacccggagcaccgccagcucgccaacgccaucuucaagcugaccuaccagaacaagguggugaagguccagcggcccacccccaccggcaccgugauggacaucaucagccgcaaggaccagcggggcuccggccaggugggcacguacgggcugaacaccuucaccaacauggaggcccagcucauccgccagauggagggcgaggggguccugagcaaggccgaccuggagaacccccaccucccggagaagaagaucacccaguggcuggagacgaagggcguggagcggcugaagcgcauggcgaucuccggcgacgacugcguggucaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcuggucgugcccugccgcccccaggacgagcugaucggccgggcccgcaucagccagggggcgggcuggucccuccgggagaccgccugccugggcaaggccuacgcccagauguggagccugauguacuuccaccgccgcgaccuccggcuggcguccaacgccaucugcagcgccgugcccguccacugggugccgaccucccgcaccacguggagcauccacgcccaccaccaguggaugaccaccgaggacaugcugaccguguggaaccgggucuggaucgaggacaaccccuggauggaggacaagacgcccgugaccaccugggagaacgugcccuaccucgggaagcgcgaggaccaguggugcggcagccugaucgggcugaccucccgggccacgugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10205 - RNA, 9873 nt, Artificial Sequence
  derived and/or modified CDS sequence (opt1) from DENV-3__JQ922554__SS-prME
accagccugugccucaugaugaugcugcccgccacccuggccuuccaccucacgucccgcgacggcgagccgcggaugaucguggggaagaacgagcgcggcaagagccugcuguucaagaccgcguccgggaucaacaugugcacccucaucgccauggaccugggcgagaugugcgacgacaccgucacguacaagugcccccacaucaccgagcuggagcccgaggacaucgacugcuggugcaaccucaccagcaccugggugacguacgggaccugcaaccaggccggcgagcaccggcgcgacaagcgguccguggcccuggccccccacgucggcauggggcuggacacccgcacccagacguggaugagcgcggagggcgccuggcggcagguggagaagguggagaccugggcccuccgccacccgggguucaccauccuggcccuguuccucgcgcacuacaucggcaccucccugacgcagaaggucgugaucuucauccugcucaugcuggugacccccagcaugaccaugcggugcgucggggugggcaaccgcgacuucguggagggccuguccggggccaccugggucgacguggugcucgagcacggcgggugcgucacgaccauggccaagaacaagcccacccuggacaucgagcugcagaagaccgaggccacgcagcucgccacccugcggaagcugugcaucgagggcaagaucaccaacaucaccacggacagccgcugccccacccagggcgaggcgauccucccggaggagcaggaccagaacuacgugugcaagcacaccuacguggaccggggguggggcaacgggugcggccuguucgggaagggcucccuggucaccugcgccaaguuccagugccucgagagcaucgagggcaagguggugcagcacgagaaccugaaguacacggucaucaucaccgugcacaccggggaccagcaccaggugggcaacgagacccagggggucacggccgagaucaccucccaggccagcaccgccgaggcgauccugcccgaguacggcacccucgggcuggagugcuccccccgcaccggccuggacuucaacgagaugauccuccugacgaugaagaacaaggccuggauggugcaccggcagugguucuucgaccugccccucccguggaccagcggcgccaccaccaagacgcccaccuggaaccgcaaggagcugcuggucaccuucaagaacgcccacgccaagaagcaggagguggugguccucgggucccaggagggcgcgaugcacaccgcccugacgggggccaccgagauccagaccagcggcgggaccuccaucuucgccggccaccugaagugccggcucaagauggacaagcuggagcugaagggcaugagcuacgccaugugccucaacacguucgugcugaagaaggaggugagcgagacccagcacgggaccauccugaucaaggucgaguacaagggcgaggacgcgcccugcaagauccccuucuccaccgaggacgggcagggcaaggcccacaacggccgccugaucacggccaacccgguggugaccaagaaggaggagcccgucaacaucgaggccgagccccccuucggggagagcaacaucgugaucggcaucggggacaaggcgcucaagaucaacugguaccggaagggcuccagcaucgggaagauguucgaggccaccgcccgcggcgcccggcgcauggccauccugggcgacaccgcgugggacuucggguccgugggcgggguccugaacagccucggcaagauggugcaccagaucuucggguccgccuacacggcccuguucagcggcguguccuggaucaugaagaucggcaucgggguccugcucaccuggaucggccugaacagcaagaacaccuccauggccuucagcugcaucgccaucgggaucaucacccuguacgugggcguggucgugcaggcggacauggggugcgugaucaacuggaagggcaaggagcucaagugcggcuccgggaucuucgucacgaacgaggugcacaccuggaccgagcaguacaaguuccaggccgacagcccgaagcgccuggccaccgccaucgccggcgcgugggagaacggggugugcggcauccgguccacgacccgcauggagaaccugcucuggaagcagaucgccaacgagcugaacuacauccugugggagaacaacaucaagcucaccgucguggugggggacaucaccggcguccuggagcagggcgagcggacgcugaccccccagcccauggagcucaaguacagcuggaagaccugggggaaggccaagaucgugaccgccgagacgcagaacuccagcuucaucaucgacggccccuccaccccggagugccccagcgcgagccgcgccuggaacgugugggaggucgaggacuacggguucggcguguucaccaccaacaucuggcugaagcugcgggagguguacacccagcucugcgaccaccgccugauguccgccgccgucaaggacgagcgggccgugcacgcggacaugggcuacuggaucgagagccagaagaacggguccuggaagcuggagaaggccagccucaucgaggugaagacgugcaccuggcccaagucccacacccuguggagcaacggcguccuggaguccgacaugaucauccccaagagccucgccgggccgaucucccagcacaaccaccgccccggcuaccacacccagacggccgggcccuggcaccugggcaagcuggagcucgacuucaacuacugcgagggcaccaccguggugaucagcgagaacugcgggacccggggcccgucccugcgcacgaccaccgucagcgggaagcugauccacgaguggugcugccgguccugcacccuccccccccugcgcuacaugggcgaggacgggugcugguacggcauggagauccggcccaucaacgagaaggaggagaacauggugaagagccuggccuccgcgggcagcgggaagguggacaacuucacgaugggcguccucugccuggccauccuguucgaggaggugaugcgcgggaaguuccggaagaagcacaugaucgccggcgugcucuucaccuucguccugcugcucuccgggcagaucaccuggcgcgacauggcccacacccugaucaugaucggcagcaacgccagcgaccggaugggcaugggggugacguaccuggcgcucaucgccaccuucaagauccagccguuccuggcccugggcuucuuccuccgcaagcugaccucccgggagaaccugcuccugggggugggccuggccauggcggccacccuccgccugcccgaggacaucgagcagauggccaacggcaucgcccuggggcucauggcccugaagcugaucacgcaguucgagaccuaccagcucuggaccgcgcuggucagccugaccugcuccaacacgaucuucacccucaccguggccuggcgcaccgccacgcugauccuggccggcaucagccuccugcccgugugccaguccagcuccaugcggaagaccgacuggcugcccaugaccgucgccgcgaugggggugccgccccucccccuguucaucuucagccugaaggacacccucaagcgccgguccuggccccugaacgagggcgucauggccguggggcuggugagcauccucgccuccagccugcugcgcaacgacgucccgauggccggcccccucguggccggcgggcugcugaucgcgugcuacgugaucacgggcaccuccgccgaccucaccgucgagaaggccgccgacgugaccugggaggaggaggccgagcagacgggggugagccacaaccugaugaucaccgucgacgacgacggcaccaugcggaucaaggacgacgagaccgagaacauccugaccgugcuccugaagacggcgcugcucaucguguccgggaucuuccccuacagcauccccgccacccugcuggucuggcacaccuggcagaagcagacccagcgcuccggcgugcucugggacgugccgagcccccccgagacgcagaaggccgagcuggaggagggcgucuaccggaucaagcagcaggggaucuucggcaagacccaggugggggugggcguccagaaggaggggguguuccacaccauguggcacgugacccgcggcgccguccugacgcacaacggcaagcggcucgagcccaacugggcguccgugaagaaggaccugaucagcuacgggggcggguggcgccugagcgcccagugggccaagggcggggagacccaggugaucgccgucgagccgggcaagaaccccaagaacuuccagaccaugcccggcaucuuccagaccacgaccggggagaucggcgccaucgcgcuggacuucaagcccgggaccuccggcagcccgaucaucaaccgggagggcaaggugguggggcucuacggcaacggggucgugaccaagaacggcggguacguguccggcaucgcccagacgaacgccgagcuggacggccccacccccgagcuggaggaggagauguucaagaagcgcaaccucaccaucauggaccugcacccggggagcggcaagacccggaaguaccugcccgccaucguccgcgaggccaucaagcggcgccuccggacgcugauccuggcgcccacccgcgugguggccgccgagauggaggaggcccucaaggggcugcccauccgguaccagaccaccgccacgaaguccgagcacaccggccgcgagaucgucgaccugaugugccacgcgaccuucaccaugcggcuccugagcccggugcgcggguccaacuacaaccugaucaucauggacgaggcccacuucacggaccccgccagcaucgccgcgaucggcuacaucuccacccgcgugggcaugggggaggccgccgccaucuucaugaccgccaccccccccggcacggucgacgcguucccgcagagcaucccccccauccaggacgaggagcgggacauccccgagcgcuccuggaacagcgggaacgaguggaucaccgacuucgugggcaagaccgugugguucgucccguccaucaaggccgggaacgacaucgccaacugccuccggaagaacggcaagaaggugauccagcugagccgcaagaccuucgacacggaguaccagaagaccaagcugaacgacugggacuucguggucaccaccgacaucuccgagaugggcgccaacuucaaggccgaccgggugaucuaccuccgccggugccugaagcccgugauccugacgaacgggcccgagcgcgucauccucgcgggccccaugccggugaccguggccagcgccgcccagcggcgcgggcgggucggccgcaacccccagaaggagaacgaccaguacaucuucauggggcagccccugaacaacgacgaggaccacgcccacuggaccgaggcgaagaugcugcucgacaacaucaacacccccgagggcaucaucccggcccuguucgagcccgagcgggagaaguccgccgccaucgacggcgaguaccgccugaagggggagagccggaagaccuucguggagcucaugcgccggggcgaccugcccguguggcuggcgcacaaggucgccuccgaggggaucaaguacacggaccgcaaguggugcuucgacggcgagcggaacaaccagauccucgaggagaacauggacguggagaucuggaccaaggagggcgagaagaagaacuggcgcccccgcuggcuggacgcccggaccuacagcgacccgcuggcccucaaggaguucaaggacuucgccgcggggcgcaagagcaucgcccuggaccuggucaccgagaucggccgggugcccucccaccucgcccacacggugcgcaacgcccuggacaaccuggucaugcuccacaccagcgagcacgggggccgggccuaccgccacgcgguggaggagcugcccgagaccauggagacccugcuccugcuggggcucaugauccugcugacgggcggcgccaugcucuuccugaucuccgggaagggcaucgggaagaccagcaucggccugaucugcgugaucgccuccagcgggaugcucuggauggccgacgucccccugcaguggaucgccuccgcgaucgugcuggaguucuucaugauggugcuccugaucccggagcccgagaagcagcggaccccccaggacaaccagcuggccuacgucgugaucggcauccucacccuggccgccaucguggccgcgaacgagaugggccugcucgagacgaccaagcgcgaccuggggaugagcaaggagccgggcgucgugucccccaccagcuaccuggacguggaccuccaccccgccuccgccuggacccuguacgccgucgcgacgcccgugaucaccccgaugcugcggcacaccaucgagaacagcaccgccaacgugucccucgccgccaucgccaaccaggcggucgugcugauggggcuggacaagggcuggcccaucagcaagauggaccucggggugccccugcuggcccucggcugcuacucccaggucaacccccugacgcuggccgccgccgugcuccugcuggugacccacuacgcgaucaucggcccggggcuccaggccaaggccacccgcgaggcccagaagcggaccgccgcgggcaucaugaagaaccccacggucgacgggaucaugaccaucgaccuggaccccgugaucuacgacagcaaguucgagaagcagcugggccaggugaugcuccugguccugugcgccgugcagcuccugcugaugcgcaccuccuggccccucugcgaggugcuggcccuggccaccggcccgaucacgacccucugggaggggagccccggcaaguucuggaacaccaccaucgcggucuccauggccaacaucuuccgggggagcuaccuggccggcgccgggcuggccuucagcaucaugaaguccgugggcacgggcaagcgcgggaccggcagccagggggagacccucggcgagaaguggaagaagaagcugaaccagcugucccggaaggaguucgaccucuacaagaagagcgggaucaccgagguggaccgcacggaggcgaaggagggccugaagcggggcgagaucacccaccacgccgucucccgcgggagcgccaagcugcagugguucguggagcggaacaugguguuccccgagggccgcgucaucgaccucgggugcggccgggggggcugguccuacuacugcgccggccugaagaaggugaccgaggugcgcggguacaccaagggcgggcccggccacgaggagccgguccccaugagcaccuacggguggaacaucgugaagcugauguccggcaaggacguguucuaccugccccccgagaagugcgacacgcuccugugcgacaucggcgagagcuccccgagccccaccgucgaggagucccgcaccauccgggugcugaagaugguggagcccugggucaagaacaaccaguucugcaucaaggugcucaaccccuacaugccgagcgugaucgagcaccuggagaaccugcagcgcaagcacgggggcauccucguccggaacccccugucccgcaacagcacccacgagauguacuggaucuccaacgggacgggcaacaucgugagcuccgugaacauggucagccggcugcuccugaaccgcuucaccaugacccaccggcgccccaccaucgagaaggacguggaccugggcgccgggacgcggcacgucaacgcggagcccgagaccccgaacauggacgugaucggcgagcgcaucaagcggaucaaggaggagcacagcuccaccuggcacuacgacgacgagaaccccuacaagaccugggccuaccacgggagcuacgaggugaaggccacgggcuccgccagcuccaugaucaacggggucgugaagcuccugaccaagcccugggacguggucccgauggugacccagauggccaugaccgacacgacccccuucggccagcagcgcguguucaaggagaaggucgacacccggaccccccgccccaugccgggcacgcggaaggugauggagaucaccgcggaguggcuguggcgcacccucgggcggaacaagcgcccccggcugugcacccgcgaggaguucacgaagaaggugcgcaccaacgccgccaugggcgccgucuucaccgaggagaaccagugggacagcgcgcgggccgccguggaggacgaggaguucuggaagcugguggaccgcgagcgggagcuccacaagcuggggaagugcggcuccugcgucuacaacaugauggggaagcgcgagaagaagcugggcgaguucggcaaggccaaggacagccgggccaucugguacauguggcucggggcgcgcuaccuggaguucgaggcccugggcuuccucaacgaggaccacugguucucccgggagaacagcuacuccgggguggagggcgaggggcugcacaagcugggcuacauccuccgcgacaucagcaagauccccggcggggccauguacgccgacgacaccgccggcugggacacgcggaucaccgaggacgaccugcacaacgaggagaagaucacccagcagauggcgcgcgagcaccggcagcuggccaacgccaucuucaagcucaccuaccagaacaagguggucaaggugcagcgccccacgccgaaggggaccgugauggacaucaucucccggaaggaccagcgcggcagcggccaggucgggaccuacggccugaacaccuucacgaacauggaggcccagcugauccggcagauggagggggagggcgugcucuccaaggccgaccuggagaacccccacccccuggagaagaagaucacccaguggcucgagaccaaggggguggagcgccugaagcggauggcgaucagcggcgacgacugcgucgugaagcccaucgacgaccgcuucgccaacgcccugcucgcccugaacgacaugggcaaggugcggaaggacaucccgcaguggcagcccuccaagggguggcacgacuggcagcagguccccuucugcagccaccacuuccacgagcugaucaugaaggacggccgcaagcucguggugcccugccggccgcaggacgagcugcuggggaaggcccgcaucucccagggcgcgggguggagccuccgcgagaccgccugccugggcaaggccuacgcccagauguggacccugauguacuuccaccggcgcgaccuccggcuggcgagcaacgccaucugcuccgccguccccgugcacugggugcccacgagccgcaccaccugguccauccacgcccaccaccaguggaugaccacggaggacaugcugaccgucuggaaccggguguggaucgaggacaaccccuggauggaggacaagaccccggugaccacgugggaggacguccccuaccucggcaagcgcgaggaccaguggugcgggagccugaucggccugaccucccgggccaccugggcgcagaacauccucaccgccauccagcaggugcgcagccugaucgggaacgaggaguuccuggacuacaugcccuccaugaagcgguuccgcaaggaggaggagagcgagggcgccaucugguga

SEQ ID NO: 10206 - RNA, 9873 nt, Artificial Sequence
  derived and/or modified CDS sequence (opt1) from DENV-3__EU529683__SS-prME
accagccucugccucaugaugauccugcccgcggcgcuggcguuccaccucaccagccgggacggcgagccgcggaugaucguggggaagaacgagcggggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggaccugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacacggggugcgugaucaacuggaagggcaaggagcugaagugcggcagcgggaucuucgugaccaacgagguccacaccuggaccgagcaguacaaguuccaggcggacucccccaagcgccucgccacggccaucgccggcgccugggagaacggggugugcggcauccgcagcaccacccggauggagaaccugcuguggaagcagaucgcgaacgagcucaacuacauccugugggagaacaacaucaagcugaccguggucgugggggacaucaucggcgugcucgagcagggcaagcgcacgcugacgccccagccgauggagcugaaguacuccuggaagaccugggggaaggcccggaucgucaccgccgagacgcagaacagcuccuucaucaucgacggccccaacacccccgagugccccaacaccagccgcgccuggaacgugugggagguggaggacuacggguucggcgucuucaccaccaacaucuggcucaagcugcgggagguguacacgcagcugugcgaccaccgccucauguccgcggccgugaaggacgagcgggccguccacgccgacaugggcuacuggaucgagagccagaagaacgggagcuggaagcuggagaaggccucccugaucgaggugaagaccugcaccuggcccaagagccacacccucugguccaacggcgugcuggagagcgacaugaucauccccaagucccuggcggggcccaucagccagcacaacuaccgcccgggcuaccacacgcagaccgccgggcccuggcaccucggcaagcuggagcuggacuucaacuacugcgagggcaccaccgucgugaucacggagaacugcgggacccggggccccucccuccgcaccaccacggugagcgggaagcugauccacgaguggugcugccgguccugcacccugcccccgcuccgcuacaugggcgaggacgggugcugguacggcauggagauccggcccaucagcgagaaggaggagaacauggucaagucccuggugagcgccggcuccggggagguggacaacuucaccaugggcguccugugccucgccauccuguucgaggaggugaugcgcgggaaguucggcaagaagcacaugaucgccgggguguucuucaccuucguccugcuccugagcggccagaucacguggcgggacauggcgcacacccugaucaugaucggcuccaacgccaccgaccgcauggggaugggcgugaccuaccucgcccugaucgccacguucaagauccagcccuuccuggcccucggguucuuccugcggaagcugaccagccgcgagaaccuccugcugggcgugggccucgcgauggccaccacccugcagcugcccgaggacaucgagcagauggccaacgggaucgcccucggccugauggcgcugaagcucaucacgcaguucgagaccuaccagcuguggaccgcccugaucucccugaccugcagcaacacgaucuucacccugaccgucgccuggcggaccgccacgcugauccucgccggggugagccugcugccggucugccaguccagcuccaugcgcaagaccgacuggcuccccaugaccguggcggccaugggcgugccgccccucccgcuguucaucuucagccucaaggacacccugaagcgccgguccuggccccugaacgagggggucauggccgugggccucgugagcauccuggccuccagccugcuccgcaacgacguccccauggccggcccccugguggccggcgggcugcucaucgccugcuacgugaucacggggaccuccgccgaccugaccgucgagaaggccgccgacgugaccugggaggaggaggcggagcagaccggggugagccacaaccugaugaucacggucgacgacgacgggaccaugcggaucaaggacgacgagaccgagaacauccucaccgugcugcugaagacggcccuccugaucguguccggcaucuucccguacagcauccccgccacccugcucgucuggcacaccuggcagaagcagacccagcgcuccggcgugcugugggacgugcccagcccgcccgagacgcagaaggccgagcuggaggagggggucuaccggaucaagcagcagggcaucuucgggaagacccaggugggcguggggguccagaaggagggcguguuccacaccauguggcacgugacccgcggcgccguccucacguacaacgggaagcggcuggagcccaacugggcguccgugaagaaggaccugaucagcuacggcgggggcuggcgccucuccgcccaguggcagaagggggaggaggugcaggucaucgccguggagcccggcaagaaccccaagaacuuccagaccaugcccggcaccuuccagaccacgaccggggagaucggcgccaucgcgcuggacuucaagcccgggaccagcggcucccccaucaucaaccgggagggcaagguggucgggcuguacggcaacgggguggugaccaagaacggcggguacgucagcggcaucgcccagacgaacgccgagccggacggccccacccccgagcuggaggaggagauguucaagaagcgcaaccucaccaucauggaccugcaccccgggagcggcaagacccggaaguaccugccggccaucgugcgcgaggccaucaagcggcgccuccggacgcugauccuggcgcccacccgcguggucgccgccgagauggaggaggcccucaaggggcugcccauccgguaccagaccaccgccacgaaguccgagcacaccggccgcgagaucguggaccugaugugccacgcgaccuucaccaugcggcuccugagccccgugcgcgucccgaacuacaaccugaucaucauggacgaggcccacuucacggaccccgccuccaucgccgcccggggguacaucagcacccgcgugggcaugggcgaggcggccgccaucuucaugaccgccacgccgcccgggacggcggacgccuucccgcaguccaacgcccccauccaggacgaggagcgcgacauccccgagcggagcuggaacuccggcaacgaguggaucaccgacuucgccgggaagaccgugugguucguccccagcaucaaggccggcaacgacaucgcgaacugccuccgcaagaacgggaagaaggugauccagcugucccggaagaccuucgacacggaguaccagaagaccaagcugaacgacugggacuucguggucaccaccgacaucagcgagaugggcgccaacuucaaggccgaccgcgugaucgacccgcggcgcugccucaagcccgugauccugaccgacggccccgagcgggucauccuggccgggcccaugccggugacggccgcguccgccgcccagcgccggggccgcguggggcggaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgcgagaaguccgccgccaucgacggcgaguaccggcugaagggcgagucccgcaagacguucgucgagcugaugcggcgcggggaccuccccguguggcuggcccacaaggucgcgagcgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcccgcaccuacuccgacccgcuggcccucaaggaguucaaggacuucgccgccggccgcaagagcaucgcgcuggaccuggugacggagaucgggcgcguccccacccaccucgcccaccggacccgcaacgcccuggacaaccuggugaugcuccacaccuccgagcacggcgggaaggccuaccggcacgccguggaggagcugcccgagacgauggagacccugcuccugcugggccucaugauccugcugaccgggggcgcgaugcuguuccugaucagcggcaaggggaucggcaagaccuccaucgggcugaucugcgucaucgccagcagcggcaugcucuggauggccgagaucccgcugcaguggaucgccuccgccaucgugcuggaguucuucaugauggugcuccugauccccgagcccgagaagcagcgcacgccccaggacaaccagcuggcguacgucgugaucgggauccucacccuggccgccaucaucgccgccaacgagaugggccugcucgagaccaccaagcgggaccugggcaugagcaaggagccggggguggucucccccacgagcuaccuggacguggaccuccaccccgcguccgccuggacccuguacgccguggccaccaccgucaucacgcccaugcugcgccacaccaucgagaacagcaccgcgaacgugucccucgccgccaucgccaaccaggccgugguccugaugggccuggacaagggguggccgaucagcaagauggaccucggcgugccccugcuggcgcucgggugcuacucccaggugaacccccugacccugacggccgccguccuccugcugaucacccacuacgccaucaucggccccggccuccaggccaaggcgacccgggaggcccagaagcgcaccgccgccgggaucaugaagaacccgacgguggacggcaucaugaccaucgaccuggaccccgugaucuacgacagcaaguucgagaagcagcuggggcaggucaugcuccuggugcugugcgccgugcagcuccugcugaugcggaccuccugggcgcucugcgaggcccugacccuggccacgggccccaucaccacccucugggagggcagccccgggaaguucuggaacaccaccaucgccgucuccauggcgaacaucuuccgcggcagcuaccuggccggggccggccuggccuucuccaucaugaaguccguggggacgggcaagcggggcaccgggucccagggcgagacccucggggagaaguggaagaagaagcugaaccagcugagccgcaaggaguucgaccucuacaagaaguccggcaucaccgagguggaccggacggaggccaaggaggggcugaagcgcggcgagaucacccaccacgcggucagccggggcagcgccaagcugcagugguucguggagcgcaacauggugaucccggaggggcgggucaucgaccucggcugcgggcgcggcgggugguccuacuacugcgccggccugaagaaggugaccgaggugcggggcuacaccaagggcggccccgggcacgaggagcccguccccaugagcacguacggcuggaacaucgugaagcugauguccgggaaggacguguucuaccucccgcccgagaagugcgacacccugcugugcgacaucggcgagagcucccccagccccaccgucgaggagucccgcaccauccgcgugcugaagaugguggagccguggcucaagaacaaccaguucugcaucaagguccugaaccccuacaugcccgccgugaucgagcaccuggagcggcuccagcgcaagcacggcgggaugcuggugcggaacccccugagccgcaacuccacgcacgagauguacuggaucagcaacggcaccgggaacaucgucgccuccgugaacauggugagccggcuccugcugaaccgcuucaccaugacccaccggcgcccgacgaucgagaaggacgucgaccucggcgcgggcacccggcacgugaacgccgagcccgagacccccaacauggacgugaucggggagcgcaucaagcggaucaaggaggagcacaacuccaccuggcacuacgacgacgagaacccguacaagacgugggccuaccacggcagcuacgaggucaaggccaccggguccgccagcuccaugaucaacggcguggucaagcugcugaccaagcccugggacguggugcccauggucacccagauggcgaugacggacaccacccccuucgggcagcagcgcguguucaaggagaagguggacacccggacgccgcgcagcaugcccggcacccggcgcgucauggagaucaccgccgaguggcucuggcggacccugggccgcaacaagaagccccggcugugcacgcgcgaggaguucaccaagaaggugcgcaccaacgccgccaugggggcgguguucaccgaggagaaccagugggacuccgccaaggccgccgucgaggacgaggacuucuggaagcucguggaccgggagcgcgagcugcacaagcugggcaagugcgggagcugcguguacaacaugaugggcaagcgggagaagaagcucggggaguucggcaaggccaagggcagccgcgcgaucugguacauguggcugggggcccgguaccuggaguucgaggcccucggcuuccugaacgaggaccacugguucucccgcgagaacagcuacuccggggucgagggcgaggggcugcacaagcucggcuacauccugcgggacaucagcaagauccccggcggggccauguacgccgacgacacggcgggcugggacacccgcaucaccgaggacgaccugcacaacgaggagaagaucacccagcagauggacccggagcaccggcagcucgccaacgccaucuucaagcugaccuaccagaacaagguggugaagguccagcgccccacgcccaccgggaccgugauggacaucaucucccggaaggaccagcgcggcagcggccagguggggaccuacggccugaacacguucaccaacauggaggcccagcucauccggcagauggagggggagggcguccuguccaaggccgaccuggagaacccccaccucccggagaagaagaucacccaguggcuggagaccaaggggguggagcgccugaagcggauggcgaucagcggcgacgacugcguggucaagcccaucgacgaccgcuucgccaacgcccuccuggcccugaacgacaugggcaaggugcggaaggacaucccccaguggcagcccuccaagggguggcacgacuggcagcaggucccguucugcagccaccacuuccacgagcucaucaugaaggacggccgcaagcuggucgugcccugccggccccaggacgagcugaucgggcgcgcccggaucucccagggcgcgggguggagccuccgcgagacggccugccugggcaaggccuacgcccagauguggucccugauguacuuccaccgccgggaccuccgccuggcgagcaacgccaucugcuccgccgugcccguccacugggugccgaccagccggaccaccugguccauccacgcccaccaccaguggaugacgaccgaggacaugcugaccguguggaaccgcgucuggaucgaggacaaccccuggauggaggacaagacccccgugacgaccugggagaacgugcccuaccucggcaagcgggaggaccaguggugcgggagccugaucggccugaccucccgcgccaccugggcgcagaacaucccgacggccauccagcagguccggagccucaucgggaacgaggaguuccuggacuacaugcccagcaugaagcgcuuccggaaggaggaggaguccgagggcgccaucugguga

SEQ ID NO: 10207 - RNA, 9873 nt, Artificial Sequence
  derived and/or modified CDS sequence (opt1) from DENV-3__EU529684__SS-prME
accagccugugccucaugaugauccugcccgccgcccuggcguuccaccucaccagccgggacggggagccccggaugaucguggggaagaacgagcgcggcaagagccugcuguucaagacggccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcggagcguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagaagcucgccaccgccaucgccggcgccugggagaacggggugugcggcauccgcagcacgacccgcauggagaaccugcuguggaagcagaucgcgaacgagcucaacuacauccugugggagaacaacaucaagcugaccguggucgugggggacaucaucggcgugcucgagcagggcaagcggacccugacgccccagccgauggagcugaaguacuccuggaagaccugggggaaggccaagaucgucaccgccgagacccagaacagcuccuucaucaucgacggccccaacacgcccgagugccccagcgccucccgcgcguggaacgugugggagguggaggacuacggguucggcgucuucaccaccaacaucuggcucaagcugcgggagguguacacccagcugugcgaccaccgccucaugagcgccgccgugaaggacgagcgggccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccgcccgggcuaccacacccagaccgccgggcccuggcaccucggcaagcuggagcuggacuucaacuacugcgagggcacgaccgucgugaucaccgagaacugcgggacccggggccccagccuccgcacgaccaccguguccgggaagcugauccacgaguggugcugccggagcugcacccugcccccgcuccgcuacaugggcgaggacgggugcugguacggcauggagauccggcccaucuccgagaaggaggagaacauggucaagagccugguguccgccggcagcggggagguggacaacuucacgaugggcguccugugccucgccauccuguucgaggaggugaugcgcgggaaguucggcaagaagcacaugaucgcggggguguucuucaccuucguccugcuccuguccggccagaucaccuggcgggacauggcccacacccugaucaugaucggcagcaacgccuccgaccgcauggggaugggcgugacguaccucgcccugaucgccaccuucaagauccagcccuuccuggcgcucggguucuuccugcggaagcugaccagccgcgagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcggacggccacccugauccucgcgggggugagccugcugccggucugccaguccagcuccaugcgcaagaccgacuggcuccccaugaccguggccgccaugggcgugccgccccucccgcuguucaucuucagccucaaggacacgcugaagcggcgcuccuggccccugaacgagggggucauggccgugggccucgugagcauccuggccuccagccugcuccgcaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcggaucaaggacgacgagaccgagaacauccucacggugcugcugaagaccgcccuccugaucguguccggcaucuucccguacagcauccccgccacccugcucgucuggcacaccuggcagaagcagacgcagcgcuccggcgugcugugggacgugcccagcccgcccgagacccagaaggccgagcuggaggagggggucuaccggaucaagcagcagggcaucuucgggaagacccaggugggcguggggguccagaaggagggcguguuccacaccauguggcacgugacgcgcggcgcgguccucaccuacaacgggaagcggcuggagcccaacugggccuccgugaagaaggaccugaucagcuacggcgggggcuggcgccucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgggagggcaagaucguggggcuguacggcaacggggucgugacgaagaacggcggguacguguccggcaucgcccagaccaacgccgagccggacggccccacccccgagcuggaggaggagauguucaagaagcgcaaccucaccaucauggaccugcaccccgggagcggcaagacgcggaaguaccugccggccaucguccgcgaggcgaucaagcggcgccuccggacccugauccuggcccccacccgcgugguggccgccgagauggaggaggcccucaaggggcugcccauccgguaccagaccacggcgaccaaguccgagcacaccggccgcgagaucgucgaccugaugugccacgccaccuucacgaugcggcuccugagccccgugcgcgugccgaacuacaaccugaucaucauggacgaggcccacuucaccgaccccgccuccaucgccgcgcggggguacaucagcacccgcgucggcaugggcgaggccgccgccaucuucaugaccgcgacgccgcccgggaccgccgacgccuucccgcaguccaacgcccccauccaggacgaggagcgggacauccccgagcgcagcuggaacuccggcaacgaguggaucaccgacuucgccgggaagaccgugugguucgugcccagcaucaaggcgggcaacgacaucgccaacugccuccgcaagaacgggaagaaggucauccagcugucccggaagacguucgacaccgaguaccagaagaccaagcugaacgacugggacuucguggugaccacggacaucagcgagaugggcgccaacuucaaggccgaccgcgucaucgacccgcggcgcugccucaagcccgugauccugaccgacggccccgagcgggugauccuggccgggcccaugccggucaccgcggccuccgccgcccagcgccggggccgcguggggcggaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgcgagaaguccgccgccaucgacggcgaguaccggcugaagggcgagucccgcaagaccuucguggagcugaugcggcgcggggaccuccccgucuggcuggcgcacaagguggccagcgagggcaucaaguacaccgaccggaaguggugcuucgacgggcagcgcaacaaccagauccuggaggagaacauggacgucgagaucuggaccaaggagggcgagaagaagaagcuccggccccgcuggcuggacgcccggacguacuccgacccgcuggcccucaaggaguucaaggacuucgccgcgggccgcaagagcaucgcccuggaccuggugaccgagaucgggcgcgugcccacccaccucgcccaccggacccgcacggcccuggacaaccuggucaugcuccacaccuccgagcacggcgggaaggccuaccggcacgcgguggaggagcugcccgagaccauggagacccugcuccugcugggccucaugauccugcugaccggcggggccaugcuguuccugaucagcgggaaggggaucggcaagaccagcaucgggcugaucugcgugaucgccuccagcggcaugcucuggauggccgagaucccgcugcaguggaucgccuccgcgaucguccuggaguucuucaugauggugcuccugauccccgagcccgagaagcagcgcacgccccaggacaaccagcuggccuacguggucaucgggauccucacccuggccgccaucaucgccgcgaacgagaugggccugcucgagacgaccaagcgggaccugggcaugagcaaggagccggggguggugucccccaccagcuaccuggacgucgaccuccaccccgccuccgccuggacccuguacgccguggcgacgaccgugaucacccccaugcugcgccacaccaucgagaacagcacggccaacgucucccucgccgccaucgccaaccaggcgguggugcugaugggccuggacaagggguggccgaucagcaagauggaccucggcgucccccugcuggcccucgggugcuacucccaggugaacccccugacccugaccgccgccgugcuccugcugaucacccacuacgccaucaucggccccggccuccaggcgaaggccacgcgggaggcccagaagcgcaccgccgccgggaucaugaagaacccgaccgucgacggcaucaugaccaucgaccuggaccccgugaucuacgacagcaaguucgagaagcagcugggccaggugaugcuccugguccugugcgcggugcagcuccugcugaugcggacguccugggcccucugcgaggcccugacccuggccaccggccccaucaccacgcucugggagggcagccccgggaaguucuggaacaccaccaucgcgguguccauggccaacaucuuccgcggcagcuaccuggccggggccggccuggccuucuccaucaugaaguccgucgggaccggcaagcggggcaccgggucccagggcgagacgcucggggagaaguggaagaagaagcugaaccagcugagccgcaaggaguucgaccucuacaagaaguccggcaucaccgagguggaccggaccgaggcgaaggaggggcugaagcgcggcgagaucacccaccacgccgugucccggggcagcgccaagcugcagugguucgucgagcgcaacauggugaucccggaggggcgggugaucgaccucggcugcgggcgcggcgggugguccuacuacugcgccggccugaagaaggucacggaggugcggggcuacaccaagggcgggcccgggcacgaggagcccgugcccaugagcaccuacggcuggaacaucgucaagcugauguccgggaaggacguguucuaccucccgcccgagaagugcgacacccugcugugcgacaucggcgagagcucccccagccccacgguggaggagucccgcaccauccggguccugaagaugguggagccguggcucaagaacaaccaguucugcaucaaggugcugaaccccuacaugcccaccgucaucgagcaccuggagcgccuccagcgcaagcacggcgggaugcuggugcggaacccccugagccgcaacuccacccacgagauguacuggaucagcaacggcacggggaacaucguggccuccgucaacauggugagccggcuccugcugaaccgcuucaccaugacccaccggcgcccgaccaucgagaaggacguggaccucggcgcgggcacgcggcacgucaacgccgagcccgagacccccaacauggacgugaucggggagcgcaucaagcggaucaaggacgagcacaacuccaccuggcacuacgacgacgagaacccguacaagaccugggccuaccacggcagcuacgaggugaaggccacgggguccgccagcuccaugaucaacggcgucgugaagcugcugaccaagcccugggacgucgugcccauggugacccagauggcgaugaccgacacgacccccuucgggcagcagcgcgucuucaaggagaagguggacacccggaccccgcgcagcaugcccggcacgcggcgcgugaugggcaucaccgccgaguggcucuggcggacccuggggcgcaacaagaagccccggcugugcacccgcgaggaguucacgaagaagguccggaccaacgccgccaugggcgcgguguucaccgaggagaaccagugggacagcgccaaggccgccguggaggacgaggacuucuggaagcucgucgaccgcgagcgcgagcugcacaagcuggggaagugcggcuccugcguguacaacaugauggggaagcgggagaagaagcucggcgaguucggcaaggccaaggggagccgcgcgaucugguacauguggcugggcgcccgguaccuggaguucgaggcccucggguuccugaacgaggaccacugguucucccgcgagaacagcuacuccggcguggagggggagggccugcacaagcucggcuacauccugcgggacaucagcaagauccccgggggcgccauguacgccgacgacaccgcggggugggacacgcgcaucaccgaggacgaccugcacaacgaggagaagaucacccagcagauggacccggagcaccggcagcucgccaacgccaucuucaagcugaccuaccagaacaaggucgugaaggugcagcgccccacccccacgggcaccgucauggacaucaucucccggaaggaccagcgcggcagcggccaggugggcaccuacgggcugaacaccuucacgaacauggaggcccagcucauccggcagauggagggcgagggggugcuguccaaggccgaccuggagaacccccaccucccggagaagaagaucacccaguggcuggagaccaagggcgucgagcgccugaagcggauggcgaucagcggcgacgacugcguggugaagcccaucgacgaccgcuucgccaacgcccuccuggcccugaacgacauggggaagguccggaaggacaucccccaguggcagcccuccaagggcuggcacgacuggcagcaggucccguucugcagccaccacuuccacgagcucaucaugaaggacgggcgcaagcuggugguccccugccggccccaggacgagcugaucggccgcgcccggaucucccagggggcgggcuggagccuccgcgagaccgccugccugggcaaggccuacgcccagauguggucccugauguacuuccaccggcgcgaccuccgccuggcgagcaacgccaucugcuccgccgugcccgugcacugggucccgacgagccggaccaccugguccauccacgcccaccaccaguggaugaccacggaggacaugcugaccguguggaaccgcguguggaucgaggacaaccccuggauggaggacaagacccccgucaccacgugggagaacgugcccuaccucgggaagcgggaggaccaguggugcggcagccugaucgggcugaccagccgcgccaccugggcgcagaacaucccgaccgccauccagcagguccggucccucaucggcaacgaggaguuccuggacuacaugcccagcaugaagcgcuuccggaaggaggaggaguccgagggggccaucugguga

SEQ ID NO: 10208 - RNA, 9873 nt, Artificial Sequence
  derived and/or modified CDS sequence (opt1) from DENV-3__FJ182015__SS-prME
accagccugugccucaugaugauccugcccgccgcccuggcguuccaccucaccagccgggacggggagccccggaugaucguggggaagaacgagcggggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcggagcgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaaguccgagcacaccggccgggagaucguggaccugaugugccacgccaccuucacgaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucguccccagcaucaaggcgggcaacgacaucgccaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggugaccgagaucgggcggguccccacccaccucgcccaccgcacccggaacgcccuggacaaccuggugaugcuccacacguccgagcacggcgggaaggccuaccgccacgcgguggaggagcugcccgagaccauggagacccugcuccugcugggccucaugauccugcugaccgggggcgccaugcuguuccugaucagcggcaaggggaucggcaagacgagcaucgggcugaucugcgucaucgccuccagcggcaugcucuggauggccgagaucccgcugcaguggaucgccuccgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccacgaagcgcgaccugggcaugagcaaggagccggggguggucucccccaccagcuaccuggacguggaccuccaccccgccuccgccuggacccuguacgccguggcgaccacggucaucacccccaugcugcggcacaccaucgagaacagcaccgccaacgugucccucgccgccaucgccaaccaggcggugguccugaugggccuggacaagggguggccgaucagcaagauggaccucggcgugccccugcuggcccucgggugcuacucccaggugaacccccugacgcugaccgccgccguccuccugcugaucacccacuacgccaucaucggccccggccuccaggcgaaggccacccgcgaggcccagaagcggacggccgccgggaucaugaagaacccgaccguggacggcaucaugaccaucgaccuggaccccgugaucuacgacagcaaguucgagaagcagcuggggcaggucaugcuccuggugcugugcgcggugcagcuccugcugaugcgcaccuccugggcccucugcgaggcccugacgcuggccaccggccccaucaccacccucugggagggcagccccgggaaguucuggaacacgaccaucgcggucuccauggccaacaucuuccggggcagcuaccuggccggggccggccuggccuucuccaucaugaaguccguggggaccggcaagcgcggcaccgggucccagggcgagacccucggggagaaguggaagaagaagcugaaccagcugagccggaaggaguucgaccucuacaagaaguccggcaucacggagguggaccgcaccgaggcgaaggaggggcugaagcggggcgagaucacccaccacgccgucucccgcggcagcgccaagcugcagugguucguggagcggaacauggugaucccggaggggcgcgucaucgaccucggcugcgggcggggcgggugguccuacuacugcgccggccugaagaaggugaccgaggugcgcggcuacacgaagggcgggcccgggcacgaggagcccguccccaugagcaccuacggcuggaacaucgugaagcugauguccgggaaggacguguucuaccucccgcccgagaagugcgacacccugcugugcgacaucggcgagagcucccccagccccaccgucgaggagucccggacgauccgcgugcugaagaugguggagccguggcucaagaacaaccaguucugcaucaagguccugaaccccuacaugcccaccgugaucgagcaccuggagcgccuccagcggaagcacggcgggaugcuggugcgcaacccccugagccggaacuccacccacgagauguacuggaucagcaacggcaccgggaacaucgucgccuccgugaacauggugagccgccuccugcugaaccgguucacgaugacccaccgccggccgaccaucgagaaggacgucgaccucggcgcgggcacccgccacgugaacgccgagcccgagacgcccaacauggacgugaucggggagcggaucaagcgcaucaaggaggagcacaacuccaccuggcacuacgacgacgagaacccguacaagaccugggccuaccacggcagcuacgaggucaaggccaccggguccgccagcuccaugaucaacggcguggucaagcugcugacgaagcccugggacguggugcccauggucacccagauggcgaugaccgacaccacgcccuucgggcagcagcggguguucaaggagaagguggacacccgcaccccgcggagcaugcccggcacccgccgggucaugggcaucacggccgaguggcucuggcgcacccuggggcggaacaagaagccccgccugugcacccgggaggaguucaccaagaaggugcgcacgaacgccgccaugggcgcgguguucaccgaggagaaccagugggacagcgccaaggccgccgucgaggacgaggacuucuggaagcucguggaccgcgagcgggagcugcacaagcuggggaagugcggcuccugcguguacaacaugauggggaagcgcgagaagaagcucggcgaguucggcaaggccaaggggagccgggcgaucugguacauguggcugggcgcccgcuaccuggaguucgaggcccucggguuccugaacgaggaccacugguucucccgggagaacagcuacuccggcgucgagggggagggccugcacaagcucggcuacauccugcgcgacaucagcaagauccccgggggcgccauguacgccgacgacaccgcggggugggacacccggaucacggaggacgaccugcacaacgaggagaagaucacccagcagauggacccggagcaccgccagcucgccaacgccaucuucaagcugaccuaccagaacaagguggugaagguccagcggcccacccccaccggcacggugauggacaucaucucccgcaaggaccagcggggcagcggccaggugggcaccuacgggcugaacaccuucaccaacauggaggcccagcucauccgccagauggagggcgaggggguccuguccaaggccgaccuggagaacccccaccucccggagaagaagaucacgcaguggcuggagaccaagggcguggagcggcugaagcgcauggcgaucagcggcgacgacugcguggucaagcccaucgacgaccgguucgccaacgcccuccuggcccugaacgacauggggaaggugcgcaaggacaucccccaguggcagcccuccaagggcuggcacgacuggcagcaggucccguucugcagccaccacuuccacgagcucaucaugaaggacgggcggaagcuggucgugcccugccgcccccaggacgagcugaucggccgggcccgcaucucccagggggcgggcuggagccuccgggagaccgccugccugggcaaggccuacgcccagauguggucccugauguacuuccaccgccgcgaccuccggcuggcgagcaacgccaucugcuccgccgugcccguccacugggugccgaccagccgcacgaccugguccauccacgcccaccaccaguggaugaccaccgaggacaugcugacgguguggaaccgggucuggaucgaggacaaccccuggauggaggacaagacccccgugaccaccugggagaacgugcccuaccucgggaagcgcgaggaccaguggugcggcagccugaucgggcugacgagccgggccaccugggcgcagaacaucccgaccgccauccagcagguccgcucccucaucggcaacgaggaguuccuggacuacaugcccagcaugaagcgguuccgcaaggaggaggaguccgagggggccaucugguga

SEQ ID NO: 10209 - RNA, 9873 nt, Artificial Sequence
  derived and/or modified CDS sequence (opt1) from DENV-3__EU569688__SS-prME
accagccucugccucaugaugauccugcccgccgcccuggccuuccaccucaccagccgggacggggagccccggaugaucguggggaagaacgagcggggcaagagccugcuguucaagaccgccagcgggaucaacaugugcacccucaucgccauggaccugggcgagaugugcgacgacaccgugaccuacaagugcccccacaucaccgaggccgagcccgaggacaucgacugcuggugcaaccugaccagcaccugggugaccuacgggacgugcaaccaggccggcgagcaccggcgcgacaagcggagcguggcgcucgcgccccacgugggcauggggcuggacacccgcacccagaccuggaugagcgccgagggcgccuggcgccagguggagaagguggagacgugggcgcugcgccacccgggguucaccauccucgcccuguuccuggcccacuacaucggcaccucccucacccagaagguggugaucuucauccugcugaugcucgugacgcccagcaugaccaugcggugcgugggggugggcaaccgcgacuucguggagggccuguccggggccaccugggucgacguggugcuggagcacggcgggugcgucaccacgauggccaagaacaagcccacccucgacaucgagcugcagaagaccgaggcgacccagcuggccacgcuccggaagcugugcaucgagggcaagaucaccaacaucaccaccgacagccgcugccccacgcagggcgaggccgugcugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacaccgugaucaucacggugcacaccggggaccagcaccaggucggcaacgagacccagggggugaccgccgagaucacgccccaggcgagcaccaccgaggccauccugcccgaguacggcacccuggggcucgagugcuccccgcgcaccggccuggacuucaacgagaugauccugcucacgaugaagaacaaggccuggaugguccaccggcagugguucuucgaccugccccugcccuggaccagcggcgccaccaccgagacgcccaccuggaaccgcaaggagcuccuggugaccuucaagaacgcccacgcgaagaagcaggagguggucgugcuggggucccaggagggcgccaugcacaccgcccucacgggggccaccgagauccagaacagcggcgggaccuccaucuucgccggccaccugaagugccggcugaagauggacaagcucgagcugaagggcaugagcuacgcgaugugcaccaacacguucgugcugaagaaggaggucuccgagacccagcacgggaccauccucaucaagguggaguacaagggcgaggacgugccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaccaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgcgucccgggccuggaacgucugggagguggaggacuacggguucggcguguucaccaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagacgugcaccuggccgaagucccacacccucuggagcaacggcgugcuggaguccgacaugaucauccccaagagccuggccgggcccaucucccagcacaacuaccggccgggcuaccacacccagacggccgggcccuggcaccucggcaagcuggagcuggacuucaacuacugcgagggcaccaccguggucaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccuggucuccgccggcagcggggagguggacaacuucaccaugggcgugcugugccucgcgauccuguucgaggaggucaugcgggggaaguucggcaagaagcacaugaucgccgggguguucuucaccuucgugcugcuccuguccggccagaucaccuggcgcgacauggcccacacgcugaucaugaucggcagcaacgccuccgaccggauggggaugggcgucaccuaccucgcccugaucgcgaccuucaagauccagcccuuccuggcccucggguucuuccugcgcaagcugaccagccgggagaaccuccugcugggcgugggccucgccauggccacgacccugcagcugcccgaggacaucgagcagauggcgaacgggaucgcccucggccugauggcccugaagcucaucacccaguucgagaccuaccagcuguggacggcccugaucagccugaccugcuccaacaccaucuucacccugacgguggccuggcgcaccgcgacccugauccucgccggggucagccugcugccggugugccaguccagcuccaugcggaagaccgacuggcuccccaugacggucgccgccaugggcgugccgccccucccgcuguucaucuucagccucaaggacacccugaagcgccgcuccuggccccugaacgagggggugauggccgucggccucgugagcauccuggcguccagccugcuccggaacgacgugcccauggccggcccccuggucgccgggggccugcucaucgccugcuacgugaucaccgggaccuccgccgaccugacgguggagaaggcggccgacgucaccugggaggaggaggccgagcagaccggcgugagccacaaccugaugaucaccguggacgacgacgggaccaugcgcaucaaggacgacgagacggagaacauccucaccguccugcugaagaccgcccuccugaucguguccggcaucuucccguacagcauccccgccacccugcucguguggcacacguggcagaagcagacccagcgguccggcguccugugggacgugcccagcccgcccgagacccagaaggcggagcuggaggaggggguguaccgcaucaagcagcagggcaucuucgggaagacccaggucggcgugggggugcagaaggagggcgucuuccacacgauguggcacgugacccggggcgccgugcucaccuacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccaugcccggcacguuccagaccaccaccggggagaucggcgccaucgcccuggacuucaagcccgggacgagcggcagccccaucaucaaccgcgagggcaaggugguggggcuguacggcaacggggucgugaccaagaacggcggguacguguccggcaucgcccagaccaacgccgagccggacggccccacccccgagcuggaggaggagauguucaagaagcggaaccucacgaucauggaccugcaccccgggagcggcaagacccgcaaguaccugccggcgaucguccgggaggccaucaagcgccggcuccgcacccugauccuggcccccacccgggugguggccgccgagauggaggaggcgcucaaggggcugcccauccgcuaccagacgaccgccaccaaguccgagcacaccggccgggagaucgucgaccugaugugccacgccacguucaccaugcgccuccugagccccgugcgggugccgaacuacaaccugaucaucauggacgaggcccacuucaccgaccccgccuccaucgcggcccgcggguacaucagcacccgggucggcaugggcgaggccgccgcgaucuucaugacggccacgccgcccgggaccgccgacgccuucccgcaguccaacgcccccauccaggacgaggagcgcgacauccccgagcgcagcuggaacuccggcaacgaguggaucaccgacuucgcggggaagacggugugguucgugcccagcaucaaggccggcaacgacaucgccaacugccuccggaagaacgggaagaaggucauccagcugucccgcaagaccuucgacaccgaguaccagaagaccaagcugaacgacugggacuucguggugacgaccgacaucagcgagaugggcgccaacuucaaggccgaccgggucaucgacccgcgccggugccucaagcccgugauccugaccgacggccccgagcgcgugauccuggcggggcccaugccggucaccgccgccuccgccgcccagcggcgcggccggguggggcgcaacccccagaaggagaacgaccaguacaucuucaccggccagccccucaacaacgacgaggaccacgcgcacuggacggaggccaagaugcugcuggacaacaucaacacccccgaggggaucaucccggcccucuucgagcccgagcgggagaaguccgccgcgaucgacggcgaguaccgccugaagggcgagucccggaagaccuucguggagcugaugcgccgcggggaccuccccgucuggcuggcccacaagguggccagcgagggcaucaaguacaccgaccgcaaguggugcuucgacgggcagcggaacaaccagauccuggaggagaacauggacgucgagaucuggacgaaggagggcgagaagaagaagcuccgcccccgguggcuggacgcccgcaccuacuccgacccgcuggcccucaaggaguucaaggacuucgcggccggccgcaagagcaucgcccuggaccuggugaccgagaucgggcgggugcccacccaccucgcccaccgcacgcggaacgcccuggacaaccuggucaugcuccacaccuccgagcacggcgggaaggcguaccgccacgccguggaggagcugcccgagaccauggagacccugcuccugcugggccucaugauccugcugaccggcggggccaugcuguuccugaucagcgggaaggggaucggcaagaccagcaucgggcugaucugcgugaucgccuccagcggcaugcucuggauggccgagaucccgcugcaguggaucgcguccgccaucguccuggaguucuucaugauggugcuccugauccccgagcccgagaagcagcggacgccccaggacaaccagcuggccuacguggucaucgggauccucacccuggccgccaucaucgcggccaacgagaugggccugcucgagacgaccaagcgcgaccugggcaugagcaaggagccggggguggugucccccaccagcuaccuggacgucgaccuccaccccgccuccgccuggacccuguacgcgguggccacgaccgugaucacccccaugcugcggcacaccaucgagaacagcacggccaacgucucccucgccgccaucgcgaaccaggccguggugcugaugggccuggacaagggguggccgaucagcaagauggaccucggcgucccccugcuggcccucgggugcuacucccaggugaacccccugacccugaccgccgccgugcuccugcugaucacccacuacgcgaucaucggccccggccuccaggccaaggccacgcgcgaggcccagaagcggaccgccgcggggaucaugaagaacccgaccgucgacggcaucaugaccaucgaccuggaccccgugaucuacgacagcaaguucgagaagcagcugggccaggugaugcuccugguccugugcgccgugcagcuccugcugaugcgcacguccugggcccucugcgaggcccugacccuggcgaccggccccaucaccacgcucugggagggcagccccgggaaguucuggaacaccaccaucgccguguccauggccaacaucuuccggggcagcuaccuggccggggccggccuggcguucuccaucaugaaguccgucgggaccggcaagcgcggcaccgggucccagggcgagacgcucggggagaaguggaagaagaagcugaaccagcugagccggaaggaguucgaccucuacaagaaguccggcaucaccgagguggaccgcaccgaggccaaggaggggcugaagcggggcgagaucacccaccacgccgugucccgcggcagcgccaagcugcagugguucgucgagcggaacauggugaucccggaggggcgcgugaucgaccucggcugcgggcggggcgggugguccuacuacugcgccggccugaagaaggucacggaggugcgcggcuacaccaagggcgggcccgggcacgaggagcccgugcccaugagcaccuacggcuggaacaucgucaagcugauguccgggaaggacguguucuaccucccgcccgagcggugcgacacccugcugugcgacaucggcgagagcucccccagccccacgguggaggagucccgcaccauccgcguccugaagaugguggagccguggcucaagaacaaccaguucugcaucaaggugcugaaccccuacaugcccaccgucaucgagcaccuggagcggcuccagcgcaagcacggcgggaugcuggugcggaacccccugagccgcaacuccacccacgagauguacuggaucagcaacggcacggggaacaucguggcguccgucaacauggugagccggcuccugcugaaccgcuucaccaugacccaccggcgcccgaccaucgagaaggacguggaccucggcgccggcacgcggcacgucaacgccgagcccgagacccccaacauggacgugaucggggagcgcaucaagcggaucaaggaggagcacaacuccaccuggcacuacgacgacgagaacccguacaagaccugggccuaccacggcagcuacgaggugaaggccacgggguccgcgagcuccaugaucaacggcgucgugaagcugcugaccaagcccugggacgucgugcccauggugacccagauggccaugaccgacacgacccccuucgggcagcagcgcgucuucaaggagaagguggacacccggaccccgcgcagcaugcccggcacgcggcgcgugaugggcaucaccgccgaguggcucuggcggacccuggggcgcaacaagaagccccggcugugcacccgcgaggaguucacgaagaagguccgcaccaacgccgcgaugggcgccguguucaccgaggagaaccagugggacagcgccaaggccgccguggaggacgaggacuucuggaagcucgucgaccgggagcgcgagcugcacaagcuggggaagugcggcuccugcguguacaacaugauggggaagcgggagaagaagcucggcgaguucggcaaggcgaaggggagccgcgccaucugguacauguggcugggcgcccgguaccuggaguucgaggcccucggguuccugaacgaggaccacugguucucccgcgagaacagcuacuccggcguggagggggagggccugcacaagcucggcuacauccugcgggacaucagcaagauccccgggggcgccauguacgcggacgacaccgccgggugggacacgcgcaucaccgaggacgaccugcacaacgaggagaagaucacccagcagauggacccggagcaccggcagcucgccaacgccaucuucaagcugaccuaccagaacaaggucgugaaggugcagcgccccacccccacgggcaccgucauggacaucaucucccggaaggaccagcgcggcagcggccaggugggcaccuacgggcugaacaccuucacgaacauggaggcccagcucauccggcagauggagggcgagggggugcuguccaaggcggaccuggagaacccccaccucccggagaagaagaucacccaguggcuggagaccaagggcgucgagcgccugaagcggauggccaucagcggcgacgacugcguggugaagcccaucgacgaccgcuucgccaacgcccuccuggcccugaacgacauggggaagguccggaaggacaucccccaguggcagcccuccaagggcuggcacgacuggcagcaggucccguucugcagccaccacuuccacgagcucaucaugaaggacgggcgcaagcuggugguccccugccggccccaggacgagcugaucggccgcgcgcggaucucccagggggccggcuggagccuccgcgagaccgccugccugggcaaggccuacgcgcagauguggucccugauguacuuccaccgccgggaccuccgccuggccagcaacgccaucugcuccgccgugcccgugcacugggucccgacgagccggaccaccugguccauccacgcccaccaccaguggaugaccacggaggacaugcugaccguguggaaccgcguguggaucgaggacaaccccuggauggaggacaagacccccgucaccacgugggagaacgugcccuaccucgggaagcgggaggaccaguggugcggcagccugaucgggcugaccagccgcgcgaccugggcccagaacaucccgaccgccauccagcagguccggucccucaucggcaacgaggaguuccuggacuacaugcccagcaugaagcgcuuccggaaggaggaggaguccgagggggccaucugguga

SEQ ID NO: 10210 - RNA, 9873 nt, Artificial Sequence
  derived and/or modified CDS sequence (opt1) from DENV-3__EU529686__SS-prME
accagccugugccucaugaugauccugcccgccgcccuggcguuccaccucaccagccgggacggggagccccggaugaucguggggaagaacgagcggggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcggagcgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaaguccgagcacaccggccgggagaucguggaccugaugugccacgccaccuucacgaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucguccccagcaucaaggcgggcaacgacaucgccaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggugaccgagaucgggcggguccccacccaccucgcccaccgcacccggaacgcccuggacaaccuggugaugcuccacacguccgagcacggcgggaaggccuaccgccacgcgguggaggagcugcccgagaccauggagacccugcuccugcugggccucaugauccugcugaccgggggcgccaugcuguuccugaucagcggcaaggggaucggcaagacgagcaucgggcugaucugcgucaucgccuccagcggcaugcucuggauggccgagaucccgcugcaguggaucgccuccgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccacgaagcgcgaccugggcaugagcaaggagccggggguggucucccccaccagcuaccuggacguggaccuccaccccgccuccgccuggacccuguacgccguggcgaccacggucaucacccccaugcugcggcacaccaucgagaacagcaccgccaacgugucccucgccgccaucgccaaccaggcggugguccugaugggccuggacaagggguggccgaucagcaagauggaccucggcgugccccugcuggcccucgggugcuacucccaggugaacccccugacgcugaccgccgccguccuccugcugaucacccacuacgccaucaucggccccggccuccaggcgaaggccacccgcgaggcccagaagcggacggccgccgggaucaugaagaacccgaccguggacggcaucaugaccaucgaccuggaccccgugaucuacgacagcaaguucgagaagcagcuggggcaggucaugcuccuggugcugugcgcggugcagcuccugcugaugcgcaccuccugggcccucugcgaggcccugacgcuggccaccggccccaucaccacccucugggagggcagccccgggaaguucuggaacacgaccaucgcggucuccauggccaacaucuuccggggcagcuaccuggccggggccggccuggccuucuccaucaugaaguccguggggaccggcaagcgcggcaccgggucccagggcgagacccucggggagaaguggaagaagaagcugaaccagcugagccggaaggaguucgaccucuacaagaaguccggcaucacggagguggaccgcaccgaggcgaaggaggggcugaagcggggcgagaucacccaccacgccgucucccgcggcagcgccaagcugcagugguucguggagcggaacauggugaucccggaggggcgcgucaucgaccucggcugcgggcggggcgggugguccuacuacugcgccggccugaagaaggugaccgaggugcgcggcuacacgaagggcgggcccgggcacgaggagcccguccccaugagcaccuacggcuggaacaucgugaagcugauguccgggaaggacguguucuaccucccgcccgagaagugcgacacccugcugugcgacaucggcgagagcucccccagccccaccgucgaggagucccggacgauccgcgugcugaagaugguggagccguggcucaagaacaaccaguucugcaucaagguccugaaccccuacaugcccaccgugaucgagcaccuggagcgccuccagcggaagcacggcgggaugcuggugcgcaacccccugagccggaacuccacccacgagauguacuggaucagcaacggcaccgggaacaucgucgccuccgugaacauggugagccgccuccugcugaaccgguucacgaugacccaccgccggccgaccaucgagaaggacgucgaccucggcgcgggcacccgccacgugaacgccgagcccgagacgcccaacauggacgugaucggggagcggaucaagcgcaucaaggaggagcacaacuccaccuggcacuacgacgacgagaacccguacaagaccugggccuaccacggcagcuacgaggucaaggccaccggguccgccagcuccaugaucaacggcguggucaagcugcugacgaagcccugggacguggugcccauggucacccagauggcgaugaccgacaccacgcccuucgggcagcagcggguguucaaggagaagguggacacccgcaccccgcggagcaugcccggcacccgccgggucaugggcaucacggccgaguggcucuggcgcacccuggggcggaacaagaagccccgccugugcacccgggaggaguucaccaagaaggugcgcacgaacgccgccaugggcgcgguguucaccgaggagaaccagugggacagcgccaaggccgccgucgaggacgagaacuucuggaagcucguggaccgcgagcgggagcugcacaagcuggggaagugcggcuccugcguguacaacaugauggggaagcgcgagaagaagcucggcgaguucggcaaggccaaggggagccgggcgaucugguacauguggcugggcgcccgcuaccuggaguucgaggcccucggguuccugaacgaggaccacugguucucccgggagaacagcuacuccggcgucgagggggagggccugcacaagcucggcuacauccugcgcgacaucagcaagauccccgggggcgccauguacgccgacgacaccgcggggugggacacccggaucacggaggacgaccugcacaacgaggagaagaucacccagcagauggacccggagcaccgccagcucgccaacgccaucuucaagcugaccuaccagaacaagguggugaagguccagcggcccacccccaccggcacggugauggacaucaucucccgcaaggaccagcggggcagcggccaggugggcaccuacgggcugaacaccuucaccaacauggaggcccagcucauccgccagauggagggcgaggggguccuguccaaggccgaccuggagaacagccaccuccccgagaagaagaucacgcaguggcuggagaccaagggcguggagcggcugaagcgcauggcgaucuccggcgacgacugcguggucaagccgaucgacgaccgguucgccaacgcccuccuggcccugaacgacauggggaaggugcgcaaggacaucccccaguggcagcccagcaagggcuggcacgacuggcagcagguccccuucugcucccaccacuuccacgagcucaucaugaaggacgggcggaagcuggucgugccgugccgcccccaggacgagcugaucggccgggcccgcaucagccagggggcgggcuggucccuccgggagaccgccugccugggcaaggccuacgcccagauguggagccugauguacuuccaccgccgcgaccuccggcuggcguccaacgccaucugcagcgccgugcccguccacugggugcccaccucccgcacgaccuggagcauccacgcccaccaccaguggaugaccaccgaggacaugcugacgguguggaaccgggucuggaucgaggacaacccguggauggaggacaagacccccgugaccaccugggagaacgugcccuaccucgggaagcgcgaggaccaguggugcggcagccugaucgggcugacgucccgggccaccugggcgcagaacauccccaccgccauccagcagguccgcagccucaucggcaacgaggaguuccuggacuacaugccguccaugaagcgguuccgcaaggaggaggagagcgagggggccaucugguga

SEQ ID NO: 10211 - RNA, 9873 nt, Artificial Sequence
  derived and/or modified CDS sequence (opt1) from DENV-3__EU529687__SS-prME
accagccugugccucaugaugauccugcccgccgcccuggcguuccaccucaccagccgggacggggagccccggaugaucguggggaagaacgagcgcggcaagagccugcuguucaagacggccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaaguccgagcacaccggccgggagaucguggaccugaugugccacgccaccuucacgaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagaaggacauccccgagcgcagcuggaacuccggcaacgaguggaucaccgacuucgccgggaagaccgugugguucguccccagcaucaaggcgggcaacgacaucgccaacugccuccgcaagaacgggaagaaggugauccagcugucccggaagacguucgacaccgaguaccagaagaccaagcugaacgacugggacuucguggucaccacggacaucagcgagaugggcgccaacuucaaggccgaccgcgugaucgacccgcggcgcugccucaagcccgugauccugaccgacggccccgagcgggucauccuggccgggcccaugccggugaccgcggccuccgccgcccagcgccggggccgcguggggcggaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgcgagaaguccgccgccaucgacggcgaguaccggcugaagggcgagucccgcaagaccuucgucgagcugaugcggcgcggggaccuccccguguggcuggcgcacaaggucgccagcgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcccggacguacuccgacccgcuggcccucaaggaguucaaggacuucgccgcgggccgcaagagcaucgcccuggaccuggugaccgagaucgggcgcguccccucccaccucgcccaccggacccgcaacgcccuggacaaccuggugaugcuccacaccagcgagcacggcgggaaggccuaccggcacgcgguggaggagcugcccgagacgauggagacccugcuccugcugggccucaugauccugcugaccgggggcgccaugcuguuccugaucagcggcaaggggaucggcaagaccuccaucgggcugaucugcgucaucgccagcuccggcaugcucuggauggccgagaucccgcugcaguggaucgccagcgcgaucgugcuggaguucuucaugauggugcuccugauccccgagcccgagaagcagcgcacgccccaggacaaccagcuggccuacgucgugaucgggauccucacccuggccgccaucaucgccgcgaacgagaugggccugcucgagaccaccaagcgggaccugggcauguccaaggagccggggguggucagccccacguccuaccuggacguggaccuccaccccgccagcgccuggacccuguacgccguggcgaccaccgucaucacgcccaugcugcgccacaccaucgagaacuccaccgccaacgugagccucgccgccaucgccaaccaggcggugguccugaugggccuggacaagggguggccgaucuccaagauggaccucggcgugccccugcuggcccucgggugcuacagccaggugaacccccugacccugacggccgccguccuccugcugaucacccacuacgccaucaucggccccggccuccaggcgaaggccacccgggaggcccagaagcgcaccgccgccgggaucaugaagaacccgacgguggacggcaucaugaccaucgaccuggaccccgugaucuacgacuccaaguucgagaagcagcuggggcaggucaugcuccuggugcugugcgcggugcagcuccugcugaugcggaccagcugggcccucugcgaggcccugacccuggccacgggccccaucaccacccucugggagggcucccccgggaaguucuggaacaccacgaucgcggucagcauggccaacaucuuccgcggcuccuaccuggccggggccggccuggccuucagcaucaugaaguccguggggaccggcaagcggggcaccgggagccagggcgagacccucggggagaaguggaagaagaagcugaaccagcugagccgcaaggaguucgaccucuacaagaaguccggcaucaccgagguggaccggacggaggcgaaggaggggcugaagcgcggcgagaucacccaccacgccgucagccggggcuccgccaagcugcagugguucguggagcgcaacauggugaucccggaggggcgggucaucgaccucggcugcgggcgcggcggguggagcuacuacugcgccggccugaagaaggugaccgaggugcggggcuacaccaagggcgggcccgggcacgaggagcccguccccauguccacguacggcuggaacaucgugaagcugaugagcgggaaggacguguucuaccucccgcccgagaagugcgacacccugcugugcgacaucggcgaguccagccccucccccaccgucgaggagagccgcaccauccgggugcugaagaugguggagccguggcucaagaacaaccaguucugcaucaagguccugaaccccuacaugcccacggugaucgagcaccuggagcgccuccagcgcaagcacggcgggaugcuggugcggaacccccugucccgcaacagcacccacgagauguacuggaucuccaacggcaccgggaacaucgucgccagcgugaacauggugucccggcuccugcugaaccgcuucaccaugacgcaccggcgcccgaccaucgagaaggacgucgaccucggcgcgggcacccggcacgugaacgccgagcccgagacccccaacauggacgugaucggggagcgcaucaagcggaucaaggaggagcacaacagcacguggcacuacgacgacgagaacccguacaagaccugggccuaccacggcuccuacgaggucaaggccaccgggagcgccuccagcaugaucaacggcguggucaagcugcugaccaagcccugggacguggugcccauggucacgcagauggcgaugaccgacaccacccccuucgggcagcagcgcguguucaaggagaagguggacacgcggaccccgcgcagcaugcccggcacccggcgcgucaugggcaucaccgccgaguggcucuggcggacgcuggggcgcaacaagaagccccggcugugcacccgcgaggaguucaccaagaaggugcggaccaacgccgccaugggcgcgguguucacggaggagaaccagugggacuccgccaaggccgccgucgaggacgaggacuucuggaagcucguggaccgcgagcgcgagcugcacaagcuggggaagugcggcagcugcguguacaacaugauggggaagcgggagaagaagcucggcgaguucggcaaggccaaggggucccgcgcgaucugguacauguggcugggcgcccgguaccuggaguucgaggcccucggguuccugaacgaggaccacugguucagccgcgagaacuccuacagcggcgucgagggggagggccugcacaagcucggcuacauccugcgggacaucuccaagauccccgggggcgccauguacgccgacgacaccgcggggugggacacccgcaucaccgaggacgaccugcacaacgaggagaagaucacgcagcagauggacccggagcaccggcagcucgccaacgccaucuucaagcugaccuaccagaacaagguggugaagguccagcgccccacccccaccggcaccgugauggacaucaucagccggaaggaccagcgcggcuccggccaggugggcacguacgggcugaacaccuucaccaacauggaggcccagcucauccggcagauggagggcgaggggguccugagcaaggccgaccuggagaacccccaccucccggagaagaagaucacccaguggcuggagacgaagggcguggagcgccugaagcggauggcgaucuccggcgacgacugcguggucaagcccaucgacgaccgcuucgccaacgcccuccuggcccugaacgacauggggaaggugcggaaggacaucccccaguggcagcccagcaagggcuggcacgacuggcagcaggucccguucugcucccaccacuuccacgagcucaucaugaaggacgggcgcaagcuggucgugcccugccggccccaggacgagcugaucggccgcgcccggaucagccagggggcgggcuggucccuccgcgagaccgccugccugggcaaggccuacgcccagauguggagccugauguacuuccaccggcgcgaccuccgccuggcguccaacgccaucugcagcgccgugcccguccacugggugccgaccucccggaccacguggagcauccacgcccaccaccaguggaugaccaccgaggacaugcugaccguguggaaccgcgucuggaucgaggacaaccccuggauggaggacaagacgcccgugaccaccugggagaacgugcccuaccucgggaagcgggaggaccaguggugcggcagccugaucgggcugaccucccgcgccacgugggcgcagaacaucccgaccgccauccagcagguccggagccucaucggcaacgaggaguuccuggacuacaugcccuccaugaagcgcuuccggaaggaggaggagagcgagggggccaucugguga

SEQ ID NO: 10212 - RNA, 9873 nt, Artificial Sequence
  derived and/or modified CDS sequence (opt1) from DENV-3__KF955449__SS-prME
accagccugugccucaugaugauccugcccgccgcccuggcguuccaccucaccagccgggacggggagccccggaugaucguggggaagaacgagcgcggcaagagccugcuguucaagacggccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucguccugcugaugcucgugacgcccagcaugaccaugcggugcgugggggucggcaaccgcgacuucguggagggccuguccggggccaccuggguggacgucgugcuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccguccugccggaggagcaggaccagaacuacgugugcaagcacaccuacguggaccggggguggggcaacgggugcggccucuucgggaagggcucccuggugaccugcgccaaguuccagugccuggagcccaucgagggcaagguggugcaguacgagaaccucaaguacaccgucaucaucacggugcacaccggggaccagcaccaggucggcaacgagacccagggggugaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggucaccuucaagaacgcccacgccaagaagcaggagguggugguccuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucgugcugaagaaggagguguccgagacccagcacgggaccauccucaucaaggucgaguacaagggcgaggacgugccgugcaagauccccuucagcaccgaggacgggcagggcaaggcgcacaacggccgccugaucacggccaaccccguggucaccaagaaggaggagcccgugaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgucggcggggugcucaacagccugggcaagauggugcaccagaucuucggguccgcguacacggcccuguucagcggcgucuccugggugaugaagaucggcaucggggugcuccugaccuggaucggccugaacagcaagaacaccuccaugagcuucuccugcaucgccaucgggaucaucacccucuaccugggcgccgucgugcaggccgacauggggugcgugaucaacuggaagggcaaggagcugaagugcggcagcgggaucuucgucacgaacgaggugcacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccgucguggugggggacaucaucggcguccucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgccucccgggcguggaacgugugggaggucgaggacuacggguucggcguguucaccaccaacaucuggcucaagcugcgcgagguguacacccagcugugcgaccaccggcucaugagcgccgccgucaaggacgagcgcgccgugcacgccgacaugggcuacuggaucgagagccagaagaacggguccuggaagcuggagaaggcgagccugaucgaggugaagaccugcacguggccgaagucccacacccucuggagcaacggcguccuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggaggucgacaacuucacgaugggcgugcugugccucgccauccuguucgaggaggugaugcgggggaaguucggcaagaagcacaugaucgcgggggucuucuucaccuucgugcugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgucggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccguggccuggcgcacggccacccugauccucgcgggggucagccugcugccggugugccaguccagcuccaugcggaagaccgacuggcuccccaugaccguggccgccaugggcgugccgccccucccgcuguucaucuucagccucaaggacacgcugaagcgccgcuccuggccccugaacgagggggugauggccgugggccucgucagcauccuggccuccagccugcuccggaacgacgugcccauggcgggcccccugguggccgggggccugcucaucgccugcuacgucaucaccgggaccuccgccgaccugaccguggagaaggccgcggacgugacgugggaggaggaggccgagcagaccggcgucagccacaaccugaugaucaccguggacgacgacgggaccaugcgcaucaaggacgacgagaccgagaacauccucacggugcugcugaagaccgcccuccugaucgucuccggcaucuucccguacagcauccccgccacccugcucguguggcacaccuggcagaagcagacgcagcgguccggcgugcugugggacguccccagcccgcccgagacccagaaggccgagcuggaggaggggguguaccgcaucaagcagcagggcaucuucgggaagacccaggugggcgucggggugcagaaggagggcguguuccacaccauguggcacgucacgcggggcgcggugcucaccuacaacgggaagcgccuggagcccaacugggccuccgugaagaaggaccugaucagcuacggcgggggcuggcggcucuccgcccaguggcagaagggggaggagguccaggugaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaaggucguggggcuguacggcaacgggguggucacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccgggucguggccgccgagauggaggaggcccucaaggggcugcccauccgcuaccagaccacggcgaccaaguccgagcacaccggccgggagaucguggaccugaugugccacgccaccuucacgaugcgccuccugagccccguccgggugccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgucugguucgugcccagcaucaaggcgggcaacgacaucgccaacugccuccggaagaacgggaagaaggugauccagcugucccgcaagacguucgacaccgaguaccagaagaccaagcugaacgacugggacuucgucgugaccacggacaucagcgagaugggcgccaacuucaaggccgaccgggugaucgacccgcgccggugccucaagcccgucauccugaccgacggccccgagcgcgugauccuggccgggcccaugccggugaccgcggccuccgccgcccagcggcgcggccgggucgggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcgcacaagguggccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggucaccgagaucgggcgggugcccucccaccucgcccaccgcacccggaacgcccuggacaaccuggugaugcuccacaccagcgagcacggcgggaaggccuaccgccacgcggucgaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucgugcuggaguucuucaugaugguccuccugauccccgagcccgagaagcagcggacgccccaggacaaccagcuggccuacguggugaucgggauccucacccuggccgccaucaucgccgcgaacgagaugggccugcucgagaccaccaagcgcgaccugggcauguccaaggagccgggggucgugagccccacguccuaccuggacguggaccuccaccccgccagcgccuggacccuguacgccgucgcgaccaccgugaucacgcccaugcugcggcacaccaucgagaacuccaccgccaacgugagccucgccgccaucgccaaccaggcggucgugcugaugggccuggacaagggguggccgaucuccaagauggaccucggcgugccccugcuggcccucgggugcuacagccaggucaacccccugacccugacggccgccgugcuccugcugaucacccacuacgccaucaucggccccggccuccaggcgaaggccacccgcgaggcccagaagcggaccgccgccgggaucaugaagaacccgacgguggacggcaucaugaccaucgaccuggaccccgucaucuacgacuccaaguucgagaagcagcugggccaggugaugcuccuggugcugugcgcgguccagcuccugcugaugcgcaccagcugggcccucugcgaggcccugacccuggccacgggccccaucaccacccucugggagggcucccccgggaaguucuggaacaccacgaucgcggugagcauggccaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggaguucgaccucuacaagaaguccggcaucaccgaggucgaccgcacggaggcgaaggaggggcugaagcggggcgagaucacccaccacgccgugagccgcggcuccgccaagcugcagugguucguggagcggaacauggucaucccggaggggcgcgugaucgaccucggcugcgggcggggcggguggagcuacuacugcgccggccugaagaaggugaccgagguccgcggcuacaccaagggcgggcccgggcacgaggagcccgugcccauguccacguacggcuggaacaucgugaagcugaugagcgggaaggacgucuucuaccucccgcccgagaagugcgacacccugcugugcgacaucggcgaguccagccccucccccaccguggaggagagccggaccauccgcgugcugaagauggucgagccguggcucaagaacaaccaguucugcaucaaggugcugaaccccuacaugcccacggugaucgagcaccuggagcgccuccagcggaagcacggcgggaugcugguccgcaacccccugucccggaacagcacccacgagauguacuggaucuccaacggcaccgggaacaucguggccagcgugaacauggucucccgccuccugcugaaccgguucaccaugacgcaccgccggccgaccaucgagaaggacguggaccucggcgcgggcacccgccacgugaacgccgagcccgagacccccaacauggacgucaucggggagcggaucaagcgcaucaaggaggagcacaacagcacguggcacuacgacgacgagaacccguacaagaccugggccuaccacggcuccuacgaggugaaggccaccgggagcgccuccagcaugaucaacggcgucgugaagcugcugaccaagcccugggacgugguccccauggugacgcagauggcgaugaccgacaccacccccuucgggcagcagcggguguucaaggagaaggucgacacgcgcaccccgcggagcaugcccggcacccgccgggugaugggcaucaccgccgaguggcucuggcgcacgcuggggcggaacaagaagccccgccugugcacccgggaggaguucaccaagaaggugcgcaccaacgccgccaugggcgcggucuucacggaggagaaccagugggacuccgccaaggccgccguggaggacgaggacuucuggaagcucguggaccgcgagcgggagcugcacaagcuggggaagugcggcagcugcgucuacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgccgacgacaccgcggggugggacacccggaucaccgaggacgaccugcacaacgaggagaagaucacgcagcagauggacccggagcaccgccagcucgccaacgccaucuucaagcugaccuaccagaacaagguggucaaggugcagcggcccacccccaccggcaccgugauggacaucaucagccgcaaggaccagcggggcuccgggcaggucggcacguacgggcugaacaccuucaccaacauggaggcccagcucauccgccagauggagggcgagggggugcugagcaaggccgaccuggagaacccccaccucccggagaagaagaucacccaguggcuggagacgaagggcguggagcggcugaagcgcauggcgaucuccggcgacgacugcgucgugaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcugguggugcccugccgcccccaggacgagcugaucggccgggcccgcaucagccagggggcgggcuggucccuccgggagaccgccugccugggcaaggccuacgcccagauguggagccugauguacuuccaccgccgcgaccuccggcuggcguccaacgccaucugcagcgccguccccgugcacugggugccgaccucccgcaccacguggagcauccacgcccaccaccaguggaugaccaccgaggacaugcugaccgucuggaaccggguguggaucgaggacaaccccuggauggaggacaagacgcccgugaccaccugggagaacguccccuaccucgggaagcgcgaggaccaguggugcggcagccugaucgggcugaccucccgggccacgugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10213 - RNA, 9873 nt, Artificial Sequence
  derived and/or modified CDS sequence (opt1) from DENV-3__FJ373303__SS-prME
accagccugugccucaugaugauccugcccgccgcccuggcguuccaccucaccagccgggacggggagccccggaugaucguggggaagaacgagcgcggcaagagccugcuguucaagacggccuccgggaucaacaugugcacccucaucgccauggaccugggggagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacgugaagcugaccgucguggugggggacaucaucggcguccucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgccucccgggcguggaacgugugggaggucgaggacuacggguucggcguguucaccaccaacaucuggcucaagcugcgcgagguguacacccagcugugcgaccaccggcucaugagcgccgccgucaaggacgagcgcgccgugcacgccgacaugggcuacuggaucgagagccagaagaacggguccuggaagcuggagaaggcgagccugaucgaggugaagaccugcacguggccgaagucccacacccucuggagcaacggcguccuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggaggucgacaacuucacgaugggcgugcugugccucgccauccuguucgaggaggugaugcgggggaaguucggcaagaagcacaugaucgcgggggucuucuucaccuucgugcugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgucggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccguggccuggcgcacggccacccugauccucgcgggggucagccugcugccggugugccaguccagcuccaugcggaagaccgacuggcuccccaugaccguggccgccaugggcgugccgccccucccgcuguucaucuucagccucaaggacacgcugaagcgccgcuccuggccccugaacgagggggugauggccgugggccucgucagcauccuggccuccagccugcuccggaacgacgugcccauggcgggcccccugguggccgggggccugcucaucgccugcuacgucaucaccgggaccuccgccgaccugaccguggagaaggccgcggacgugacgugggaggaggaggccgagcagaccggcgucagccacaaccugaugaucaccguggacgacgacgggaccaugcgcaucaaggacgacgagaccgagaacauccucacggugcugcugaagaccgcccuccugaucgucuccggcaucuucccguacagcauccccgccacccugcucguguggcacaccuggcagaagcagacgcagcgguccggcgugcugugggacguccccagcccgcccgagacccagaaggccgagcuggaggaggggguguaccgcaucaagcagcagggcaucuucgggaagacccaggugggcgucggggugcagaaggagggcguguuccacaccauguggcacgucacgcggggcgcggugcucaccuacaacgggaagcgccuggagcccaacugggccuccgugaagaaggaccugaucagcuacggcgggggcuggcggcucuccgcccaguggcagaagggggaggagguccaggugaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaaggucguggggcuguacggcaacgggguggucacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccgggucguggccgccgagauggaggaggcccucaaggggcugcccauccgcuaccagaccacggcgaccaaguccgagcacaccggccgggagaucguggaccugaugugccacgccaccuucacgaugcgccuccugagccccguccgggugccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgucugguucgugcccagcaucaaggcgggcaacgacaucgccaacugccuccggaagaacgggaagaaggugauccagcugucccgcaagacguucgacaccgaguaccagaagaccaagcugaacgacugggacuucgucgugaccacggacaucagcgagaugggcgccaacuucaaggccgaccgggugaucgacccgcgccggugccucaagcccgucauccugaccgacggccccgagcgcgugauccuggccgggcccaugccggugaccgcggccuccgccgcccagcggcgcggccgggucgggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcgcacaagguggccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggucaccgagaucgggcgggugcccucccaccucgcccaccgcacccggaacgcccuggacaaccuggugaugcuccacaccagcgagcacggcgggaaggccuaccgccacgcggucgaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucgugcuggaguucuucaugaugguccuccugauccccgagcccgagaagcagcggacgccccaggacaaccagcuggccuacguggugaucgggauccucacccuggccgccaucaucgccgcgaacgagaugggccugcucgagaccaccaagcgcgaccugggcauguccaaggagccgggggucgugagccccacguccuaccuggacguggaccuccaccccgccagcgccuggacccuguacgccgucgcgaccaccgugaucacgcccaugcugcggcacaccaucgagaacuccaccgccaacgugagccucgccgccaucgccaaccaggcggucgugcugaugggccuggacaagggguggccgaucuccaagauggaccucggcgugccccugcuggcccucgggugcuacagccaggucaacccccugacccugacggccgccgugcuccugcugaucacccacuacgccaucaucggccccggccuccaggcgaaggccacccgcgaggcccagaagcggaccgccgccgggaucaugaagaacccgacgguggacggcaucaugaccaucgaccuggaccccgucaucuacgacuccaaguucgagaagcagcugggccaggugaugcuccuggugcugugcgcgguccagcuccugcugaugcgcaccagcugggcccucugcgaggcccugacccuggccacgggccccaucaccacccucugggagggcucccccgggaaguucuggaacaccacgaucgcggugagcauggccaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggaguucgaccucuacaagaaguccggcaucaccgaggucgaccgcacggaggcgaaggaggggcugaagcggggcgagaucacccaccacgccgugagccgcggcuccgccaagcugcagugguucguggagcggaacauggucaucccggaggggcgcgugaucgaccucggcugcgggcggggcggguggagcuacuacugcgccggccugaagaaggugaccgagguccgcggcuacaccaagggcgggcccgggcacgaggagcccgugcccauguccacguacggcuggaacguggucaagcugaugagcgggaaggacguguucuaccucccgcccgagaagugcgacacccugcugugcgacaucggcgaguccagccccucccccaccguggaggagagccggaccauccgcguccugaagaugguggagccguggcucaagaacaaccaguucugcaucaaggugcugaaccccuacaugcccacggucaucgagcaccuggagcgccuccagcggaagcacggcgggaugcuggugcgcaacccccugucccggaacagcacccacgagauguacuggaucuccaacggcaccgggaacaucguggccagcgucaacauggugucccgccuccugcugaaccgguucaccaugacgcaccgccggccgaccaucgagaaggacguggaccucggcgcgggcacccgccacgucaacgccgagcccgagacccccaacauggacgugaucggggagcggaucaagcgcaucaaggaggagcacaacagcacguggcacuacgacgacgagaacccguacaagaccugggccuaccacggcuccuacgaggucaaggccaccgggagcgccuccagcaugaucaacggcguggugaagcugcugaccaagcccugggacgucgugcccauggugacgcagauggcgaugaccgacaccacccccuucgggcagcagcgggucuucaaggagaagguggacacgcgcaccccgcggagcaugcccggcacccgccgggugaugggcaucaccgccgaguggcucuggcgcacgcuggggcggaacaagaagccccgccugugcacccgggaggaguucaccaagaagguccgcaccaacgccgccaugggcgcgguguucacggaggagaaccagugggacuccgccaaggccgccguggaggacgaggacuucuggaagcucgucgaccgcgagcgggagcugcacaagcuggggaagugcggcagcugcguguacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgccgacgacaccgcggggugggacacccggaucaccgaggacgaccugcacaacgaggagaagaucacgcagcagauggacccggagcaccgccagcucgccaacgccaucuucaagcugaccuaccagaacaaggucgugaaggugcagcggcccacccccaccggcaccgucauggacaucaucagccgcaaggaccagcggggcuccggccaggugggcacguacgggcugaacaccuucaccaacauggaggcccagcucauccgccagauggagggcgagggggugcugagcaaggccgaccuggagaacccccaccucccggagaagaagaucacccaguggcuggagacgaagggcgucgagcggcugaagcgcauggcgaucuccggcgacgacugcguggugaagcccaucgacgaccgguucgccaacgcccuccuggcccugaacgacauggggaagguccgcaaggacaucccccaguggcagcccagcaagggcuggcacgacuggcagcaggucccguucugcucccaccacuuccacgagcucaucaugaaggacgggcggaagcuggugguccccugccgcccccaggacgagcugaucggccgggcccgcaucagccagggggcgggcuggucccuccgggagaccgccugccugggcaaggccuacgcccagauguggagccugauguacuuccaccgccgcgaccuccggcuggcguccaacgccaucugcagcgccgugcccgugcacugggucccgaccucccgcaccacguggagcauccacgcccaccaccaguggaugaccaccgaggacaugcugaccguguggaaccggguguggaucgaggacaaccccuggauggaggacaagacgcccgucaccaccugggagaacgugcccuaccucgggaagcgcgaggaccaguggugcggcagccugaucgggcugaccucccgggccacgugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10214 - RNA, 9873 nt, Artificial Sequence
  derived and/or modified CDS sequence (opt1) from DENV-3__KF955451__SS-prME
accagccugugccucaugaugauccugcccgcggcgcuggcguuccaccucaccagccgggacggcgagccgcggaugaucguggggaagaacgagcggggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcgugggggacaacgcccugaagaucaacugguacaagaagggcuccagcaucgggaagauguucgaggcgaccgcccggggcgcccgccggauggccauccugggcgacaccgccugggacuucggguccgucggcggggugcucaacagccugggcaagauggugcaccagaucuucggguccgcguacacggcccuguucagcggcgucuccugggugaugaagaucggcaucggggugcuccugaccuggaucggccugaacagcaagaacaccuccaugagcuucuccugcaucgccaucgggaucaucacccucuaccugggcgucguggugcaggccgacauggggugcgucaucaacuggaagggcaaggagcugaagugcggcagcgggaucuucgugacgaacgaggugcacaccuggaccgagcaguacaaguuccaggccgacucccccaagcgccucgcgaccgccaucgccggcgccugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggcgaagaucgugaccgccgagacccagaacagcuccuucaucaucgacggccccaacacgcccgagugccccagcgccucccgggccuggaacgucugggagguggaggacuacggguucggcguguucaccaccaacaucuggcucaagcugcgcgaggucuacacccagcugugcgaccaccggcucaugagcgcggccgugaaggacgagcgcgccgugcacgccgacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggcggggcccaucucccagcacaacuaccggccgggcuaccacacccagaccgccgggcccuggcaccucggcaagcuggagcuggacuucaacuacugcgagggcacgaccguggucaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcggggagguggacaacuucacgaugggcgugcugugccucgccauccuguucgaggaggucaugcgggggaaguucggcaagaagcacaugaucgccgggguguucuucaccuucgugcugcuccuguccggccagaucaccuggcgcgacauggcgcacacccugaucaugaucggcagcaacgccuccgaccggauggggaugggcgucacguaccucgcccugaucgccaccuucaagauccagcccuuccuggcccucggguucuuccugcgcaagcugaccagccgggagaaccuccugcugggcgugggccucgcgauggccaccacgcugcagcugcccgaggacgucgagcagauggccaacgggaucgcccucggccugauggcgcugaagcucaucacccaguucgagaccuaccagcuguggaccgcccugaucagccucacgugcuccaacaccaucuucacccugaccguggccuggcgcacggccacccugauccucgccggggugagccugcugccggucugccaguccagcuccaugcggaagaccgacuggcuccccaugaccguggcggccaugggcgugccgccccucccgcuguucaucuucagccucaaggacacgcugaagcgccgcuccuggccccugaacgagggggucauggccgugggccucgugagcauccuggccuccagccugcuccggaacgacguccccauggccggcccccugguggccggcgggcugcucaucgccugcuacgugaucaccgggaccuccgccgaccugaccgucgagaaggccgccgacgugacgugggaggaggaggcggagcagaccggggugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgccguccucaccuacaacgggaagcgccuggagcccaacugggcguccgugaagaaggaccugaucagcuacggcgggggcuggcggcucaacgcccaguggcagaagggggaggaggugcaggucaucgccguggagcccggcaagaaccccaagaacuuccagaccaugcccggcaccuuccagacgaccaccggggagaucggcgccaucgcgcuggacuucaagcccgggaccuccggcagccccaucaucaaccgcgagggcaagguggucgggcuguacggcaacgggguggugacgaagaacggcggguacgucagcggcaucgcccagaccaacgccgagccggacggccccacccccgagcuggaggaggagauguucaagaagcggaaccucaccaucauggaccugcaccccggguccggcaagacgcgcaaguaccugccggccaucgugcgggaggccaucaagcgccggcuccgcacccugauccuggcgcccacccggguggucgccgccgagauggaggaggcccucaaggggcugcccauccgcuaccagaccacggccaccaagagcgagcacaccggccgggagaucguggaccugaugugccacgcgaccuucacgaugcgccuccugucccccgugcgggucccgaacuacaaccugaucaucauggacgaggcccacuucaccgaccccgccagcaucgccgcccgcggguacaucuccacccgggugggcaugggcgaggcggccgccaucuucaugaccgccacgccgcccgggaccgcggacgccuucccgcagagcaacgcccccauccaggacgaggagcgcgacauccccgagcgcuccuggaacagcggcaacgaguggaucaccgacuucgccgggaagaccgugugguucguccccuccaucaaggccggcaacgacaucgcgaacugccuccggaagaacgggaagaaggugauccagcugagccgcaagacguucgacaccgaguaccagaagaccaagcugaacgacugggacuucguggucaccacggacaucuccgagaugggcgccaacuucaaggccgaccgggugaucgacccgcgccggugccucaagcccgugauccugaccgacggccccgagcgcgucauccuggccgggcccaugccggugaccgccgcgagcgccgcccagcggcgcggccgggucgggcgcaacccccagaaggagaacgaccaguacaucuucaccggccagccccucaacaacgacgaggaccacgcccacuggaccgaggccaagaugcugcuggacaacaucaacacgcccgaggggaucaucccggcccucuucgagcccgagcgggagaaguccgccgccaucgacggcgaguaccgccugaagggcgagagccggaagaccuucguggagcugaugcgccgcggggaccuccccguguggcuggcccacaaggucgcguccgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacagcgacccgcuggcccucaaggaguucaaggacuucgccgccggccgcaaguccaucgcgcuggaccuggugaccgagaucgggcggguccccacccaccucgcccaccgcacccggagcgcccuggacaaccuggugaugcuccacacguccgagcacggcgggaaggccuaccgccacgccguggaggagcugcccgagaccauggagacccugcuccugcugggccucaugauccugcugaccgggggcgcgaugcuguuccugaucagcggcaaggggaucggcaagacgagcaucgggcugaucugcgucaucgccuccagcggcaugcucuggauggccgagaucccgcugcaguggaucgccuccgccaucgugcuggaguucuucaugauggugcuccugauccccgagcccgagaagcagcggacgccccaggacaaccagcuggcguacgucgugaucgggauccucacccuggccgccaucaucgccgccaacgagaugggccugcucgagaccacgaagcgcgaccugggcaugagcaaggagccggggguggucucccccaccagcuaccuggacguggaccuccaccccgcguccgccuggacccuguacgccguggccaccacggucaucacccccaugcugcggcacaccaucgagaacagcaccgcgaacgugucccucgccgccaucgccaaccaggccgugguccugaugggccuggacaagggguggccgaucagcaagauggaccucggcgugccccugcuggcgcucgggugcuacucccaggugaacccccugacgcugaccgccgccguccuccugcugaucacccacuacgccaucaucggccccggccuccaggccaaggcgacccgcgaggcccagaagcggacggccgccgggaucaugaagaacccgaccguggacggcaucaugaccaucgaccuggaccccgugaucuacgacagcaaguucgagaagcagcuggggcaggucaugcuccuggugcugugcgccgugcagcuccugcugaugcgcaccuccugggcgcucugcgaggcccugacgcuggccaccggccccaucaccacccucugggagggcagccccgggaaguucuggaacacgaccaucgccgucuccauggcgaacaucuuccggggcagcuaccuggccggggccggccuggccuucuccaucaugaaguccguggggaccggcaagcgcggcaccgggucccagggcgagacccucggggagaaguggaagcggaagcugaaccagcugagccgcaaggaguucgaccucuacaagaaguccggcaucacggagguggaccggaccgaggccaaggaggggcugaagcgcggcgagaucacccaccacgcggucucccggggcagcgccaagcugcagugguucguggagcgcaacauggugaucccggaggggcgggucaucgaccucggcugcgggcgcggcgggugguccuacuacugcgccggccugaagaaggugaccgaggugcggggcuacacgaagggcgggcccgggcacgaggagcccguccccaugagcaccuacggcuggaacaucgugaagcugauguccgggaaggacguguucuaccucccgcccgagaagugcgacacccugcugugcgacaucggcgagagcucccccagccccaccgucgaggagucccgcacgauccgcgugcugaagaugguggagccguggcucaagaacaaccaguucugcaucaagguccugaaccccuacaugcccaccgugaucgagcaccuggagcggcuccagcgcaagcacggcgggaugcuggugcggaacccccugagccgcaacuccacccacgagauguacuggaucagcaacggcaccgggaacaucgucgccuccgugaacauggugagccggcuccugcugaaccgcuucacgaugacccaccggcgcccgaccaucgagaaggacgucgaccucggcgccggcacccggcacgugaacgcggagcccgagacgcccaacauggacgucaucggggagcgcaucaagcggaucaaggaggagcacaacuccaccuggcacuacgacgacgagaacccguacaagaccugggccuaccacggcagcuacgaggugaaggccaccggguccgccagcuccaugaucaacggcguggucaagcugcugacgaagcccugggacguggugcccauggucacccagauggccaugaccgacaccacgcccuucgggcagcagcgcguguucaaggagaagguggacacccggaccccgcgccccaugcccggcacccggcgcgucaugggcaucacggcggaguggcucuggcggacccuggggcgcaacaagaagccccggcugugcacccgcgaggaguucaccaagaaggugcgcacgaacgccgccaugggcgccguguucaccgaggagaaccagugggacagcgcgaaggccgccgucgaggacgaggacuucuggaagcucguggaccgggagcgcgagcugcacaagcuggggaagugcggcagcugcguguacaacaugauggggaagcgggagaagaagcucggcgaguucggcaaggccaaggggucccgcgccaucugguacauguggcugggcgcgcgguaccuggaguucgaggcccucggguuccugaacgaggaccacugguucagccgcgagaacuccuacagcggcgucgagggggagggccugcacaagcucggcuacauccugcgggacaucuccaagauccccgggggcgccauguacgccgacgacaccgccgggugggacacccgcaucacggaggacgaccugcacaacgaggagaagaucacccagcagauggaccccgagcaccggcagcucgcgaacgccaucuucaagcugaccuaccagaacaagguggugaagguccagcgccccacccccaccggcacggugauggacaucaucagccggaaggaccagcgcggcuccggccaggugggcaccuacgggcugaacaccuucaccaacauggaggcccagcucauccggcagauggagggcgaggggguccugagcaaggccgaccuggagaacccgcaccucuccgagaagaagaucacgcaguggcuggagaccaagggcguggagcgccugaagcggauggccaucagcggcgacgacugcguggucaagcccaucgacgaccgcuucgcgaacgcccuccuggcccugaacgacauggggaaggugcggaaggacaucccccaguggcagcccuccaagggcuggcacgacuggcagcaggucccguucugcagccaccacuuccacgagcucaucaugaaggacgggcgcaagcuggucgugcccugccggccccaggacgagcugaucggccgcgcccggaucucccagggggccggcuggagccuccgcgagaccgcgugccugggcaaggccuacgcccagauguggucccugauguacuuccaccgccgggaccuccgccuggccagcaacgcgaucugcuccgccgugcccguccacugggugccgaccagccggacgaccugguccauccacgcccaccaccaguggaugaccaccgaggacaugcugacgguguggaaccgcgucuggaucgaggacaaccccuggauggaggacaagacccccgugaccaccugggagaacgugcccuaccucgggaagcgggaggaccaguggugcggcagccugaucgggcugacgagccgcgccaccugggcccagaacaucccgaccgcgauccagcagguccggucccucaucggcaacgaggaguuccuggacuacaugcccagcaugaagcgcuuccggaaggaggaggaguccgagggggccaucugguga

SEQ ID NO: 10215 - RNA, 9873 nt, Artificial Sequence
  derived and/or modified CDS sequence (opt1) from DENV-3__KF955453__SS-prME
accagccugugccucaugaugauccugcccgcgacccuggccuuccaccucaccagccgggacggggagccgcggaugaucguggggaagaacgagcggggcaagagccugcuguucaagaccgcguccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagacguggaugagcgcggagggcgccuggcgccagguggagaaggucgagaccugggcccugcgccacccgggguucaccauccucgcccuguuccuggcgcacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacaucaccacggacagccgcugccccacccagggcgaggcggugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacacggugaucaucaccguccacaccggggaccagcaccaggugggcaacgagacccagggggucacggccgagaucacgccccaggccagcaccaccgaggccacccugcccgaguacggcacgcuggggcucgagugcuccccgcgcaccggccuggacuucaacgagaugauccugcucaccaugaagaacaaggcguggauggugcaccggcagugguucuucgaccugccccugcccuggaccagcggcgccacgaccgagacccccaccuggaaccgcaaggagcuccuggugacguucaagaacgcccacgccaagaagcaggaggucguggugcuggggucccaggagggcgccaugcacaccgcgcucaccggggccaccgagauccagaacagcggcgggacguccaucuucgccggccaccugaagugccggcugaagauggacaagcucgagcugaagggcaugagcuacgccaugugcaccaacaccuucguccugaagaaggagguguccgagacccagcacgggacgauccucaucaagguggaguacaagggcgaggacgucccgugcaagauccccuucagcaccgaggacgggcagggcaaggcccacaacggccgccugaucaccgcgaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggccacggcgcggggcgcccgccggauggccauccugggcgacaccgccugggacuucggguccgugggcgggguccucaacagccugggcaagauggugcaccagaucuucggguccgccuacaccgcgcuguucagcggcguguccugggucaugaagaucggcaucggggugcuccugaccuggaucggccugaacagcaagaacacguccaugagcuucuccugcaucgccaucgggaucaucacccucuaccugggcgccgugguccaggccgacauggggugcgugaucaacuggaagggcaaggagcugaagugcggcagcgggaucuucgugaccaacgagguccacaccuggacggagcaguacaaguuccaggccgacucccccaagcgccucgcgaccgccaucgccggcgccugggagaacggggugugcggcauccgcagcaccacccggauggagaaccugcuguggaagcagaucgccaacgagcucaacuacauccugugggagaacaacaucaagcugacgguggucgugggggacaucaucggcgugcucgagcagggcaagcgcacccugacgccccagccgauggagcugaaguacuccuggaagaccugggggaaggcgaagaucgucacggccgagacccagaacagcuccuucaucaucgacggccccaacacccccgagugccccagcgccucccgggccuggaacgugugggagguggaggacuacggguucggcgucuucaccaccaacaucuggcucaagcugcgcgagguguacacgcagcugugcgaccaccggcucaugagcgcggccgugaaggacgagcgcgccguccacgccgacaugggcuacuggaucgagagccagaagaacggguccuggaagcuggagaaggccagccugaucgaggugaagaccugcaccuggccgaagucccacacccucuggagcaacggcgugcuggaguccgacaugaucauccccaagagccuggcggggcccaucucccagcacaacuaccggccgggcuaccacacgcagaccgccgggcccuggcaccucggcaagcuggagcuggacuucaacuacugcgagggcaccaccgucgugaucacggagaacugcgggacccgcggccccagccuccggaccaccacgguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucaccaugggcguccugugccucgccauccuguucgaggaggugaugcgggggaaguucggcaagaagcacaugaucgccgggguguucuucaccuucguccugcuccuguccggccagaucacguggcgcgacauggcgcacacccugaucaugaucggcagcaacgccuccgaccggauggggaugggcgugaccuaccucgcccugaucgccaccuucaagauccagcccuuccuggcccucggguucuuccugcgcaagcugacgagccgggagaaccuccugcugggcgugggccucgcgauggccaccacccugcagcugcccgaggacaucgagcagauggccaacgggaucgcccucggccugauggcgcugaagcucaucacccaguucgagacguaccagcuguggaccgcccugaucagccugaccugcuccaacaccaucuucacgcugaccgucgccuggcgcaccgccacccugauccucgccggggugagccugcugccggucugccaguccagcuccaugcggaagacggacuggcuccccaugaccguggcggccaugggcgugccgccccucccgcuguucaucuucaaccucaaggacacccugaagcgccgcagcuggccccugaacgagggggucauggccgugggccucguguccauccuggccagcucccugcuccggaacgacguccccauggccggcccccugguggccggcgggcugcucaucgccugcuacgugaucaccgggacgagcgccgaccugaccgucgagaaggccgccgacgugaccugggaggaggaggcggagcagaccggggugucccacaaccugaugaucaccgucgacgacgacgggacgaugcgcaucaaggacgacgagaccgagaacauccucaccgugcugcugaagaccgcccuccugaucgugagcggcaucuucccguacuccauccccgccacgcugcucgucuggcacaccuggcagaagcagacccagcggagcggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacccggggcgccguccucaccuacaacgggaagcgccuggagcccaacugggcgagcgugaagaaggaccugaucuccuacggcgggggcuggcggcucagcgcccaguggcagaagggggaggaggugcaggucaucgccguggagcccggcaagaaccccaagaacuuccagacgaugcccggcaccuuccagaccaccacgggggagaucggcgccaucgcgcuggacuucaagcccgggaccuccggcagccccaucaucaaccgcgagggcaagaucguggggcuguacggcaacggggucgugaccaagaacggcggguacgugagcggcaucgcccagaccaacgccgagccggacggccccacgcccgagcuggaggaggagauguucaagaagcggaaccucaccaucauggaccugcaccccggguccggcaagacccgcaaguaccugccggccaucguccgggaggccaucaagcgccggcuccgcacccugauccuggcgcccacgcgggugguggccgccgagauggaggaggcccucaaggggcugcccauccgcuaccagaccaccgccaccaagagcgagcacacgggccgggagaucgucgaccugaugugccacgcgaccuucaccaugcgccuccugucccccgugcgggugccgaacuacaaccugaucaucauggacgaggcccacuucaccgaccccgccagcaucgccgcccgcggguacaucuccacgcgggucggcaugggcgaggcggccgccaucuucaugaccgccacgccgcccgggaccgcggacgccuucccgcagagcaacgcccccauccaggacgaggagcgcgacauccccgagcgcuccuggaacagcggcaacgaguggaucacggacuucgccgggaagaccgugugguucgugcccuccaucaaggccggcaacgacaucgcgaacugccuccggaagaacgggaagaaggucauccagcugagccgcaagaccuucgacaccgaguaccagaagacgaagcugaacgacugggacuucguggugaccaccgacaucuccgagaugggcgccaacuucaaggccgaccgggucaucgacccgcgccggugccucaagcccgugauccugaccgacggccccgagcgcgugauccuggccgggcccaugccggucaccgccgcgagcgccgcccagcggcgcggccggguggggcgcaacccccagaaggagaacgaccaguacaucuucacgggccagccccucaacaacgacgaggaccacgcccacuggaccgaggccaagaugcugcuggacaacaucaacacccccgaggggaucaucccggcccucuucgagcccgagcgggagaaguccgccgccaucgacggcgaguaccgccugaagggcgagagccggaagaccuucguggagcugaugcgccgcggggaccuccccgucuggcuggcccacaagguggcguccgagggcaucaaguacacggaccgcaaguggugcuucgacgggcagcggaacaaccagauccuggaggagaacauggacgucgagaucuggaccaaggagggcgagaagaagaagcuccgcccccgguggcuggacgcccgcaccuacagcgacccgcuggcccucaaggaguucaaggacuucgccgccggccgcaaguccaucgcgcuggaccuggugaccgagaucgggcgggugcccacgcaccucgcccaccgcacccggaacgcccuggacaaccuggucaugcuccacaccagcgagcacggcgggaaggccuaccgccacgccguggaggagcugcccgagaccauggagacgcugcuccugcugggccucaugaucucccugaccgggggcgcgaugcuguuccucaucagcggcaaggggaucggcaagaccagcaucgggcugaucugcgugaucgccuccagcggcaugcuguggauggccgagaucccgcuccaguggaucgccuccgccaucguccuggaguucuucaugauggugcugcucauccccgagcccgagaagcagcggacgccccaggacaaccagcuggcguacguggucaucgggauccugacgcucgccgccaucaucgccgccaacgagaugggccugcuggagaccaccaagcgcgaccucggcaugagcaaggagccggggguggugucccccaccagcuaccuggacgucgaccugcaccccgcguccgccuggacgcucuacgccguggccaccaccgugaucacccccaugcugcggcacacgaucgagaacagcaccgcgaacgucucccuggccgccaucgccaaccaggccguggugcucaugggccuggacaagggguggccgaucagcaagauggaccugggcgucccccuccuggcgcuggggugcuacucccaggugaacccccucacccugaccgccgccgugcugcuccugaucacgcacuacgccaucaucggccccggccugcaggccaaggcgacccgcgaggcccagaagcggaccgccgccgggaucaugaagaacccgaccgucgacggcaucaugacgaucgaccucgaccccgugaucuacgacagcaaguucgagaagcagcugggccaggugaugcugcucguccugugcgccgugcagcugcuccugaugcgcaccuccugggcgcugugcgaggcccucacccuggccaccggccccaucacgacccugugggagggcagccccgggaaguucuggaacaccaccaucgccguguccauggcgaacaucuuccggggcagcuaccucgccggggccggccuggccuucuccaucaugaaguccgucgggaccggcaagcgcggcacggggucccagggcgagacccugggggagaaguggaagaagaagcucaaccagcugagccggaaggaguucgaccuguacaagaaguccggcaucaccgagguggaccgcaccgaggccaaggaggggcucaagcggggcgagaucacgcaccacgcggugucccgcggcagcgccaagcugcagugguucgucgagcggaacauggugaucccggaggggcgcgugaucgaccugggcugcgggcggggcgggugguccuacuacugcgccggccucaagaaggucaccgaggugcgcggcuacaccaagggcgggcccgggcacgaggagcccgugcccaugagcaccuacggcuggaacaucgucaagcugauguccgggaaggacguguucuaccugccgcccgagaagugcgacacgcuccugugcgacaucggcgagagcucccccagccccaccguggaggagucccggaccauccgcguccugaagaugguggagccguggcugaagaacaaccaguucugcaucaaggugcucaaccccuacaugcccaccgucaucgagcaccuggagcgccugcagcggaagcacggcgggaugcucgugcgcaacccccugagccggaacuccacgcacgagauguacuggaucagcaacggcaccgggaacaucguggccuccgucaacauggugagccgccugcuccugaaccgguucaccaugacccaccgccggccgacgaucgagaaggacguggaccugggcgccggcacccgccacgucaacgcggagcccgagacccccaacauggacgugaucggggagcggaucaagcgcaucaaggaggagcacaacuccaccuggcacuacgacgacgagaacccguacaagacgugggccuaccacggcagcuacgaggugaaggccaccggguccgccagcuccaugaucaacggcgucgugaagcuccugaccaagcccugggacgucgugcccauggugacccagauggccaugacggacaccacccccuucgggcagcagcgggucuucaaggagaagguggacacccgcacgccgcggagcaugcccggcacccgccgggugaugggcaucaccgcggaguggcuguggcgcacccucgggcggaacaagaagccccgccugugcacgcgggaggaguucaccaagaagguccgcaccaacgccgccaugggcgccguguucaccgaggagaaccagugggacagcgcgaaggccgccguggaggacgaggacuucuggaagcuggucgaccgcgagcgggagcuccacaagcuggggaagugcggcuccugcguguacaacaugauggggaagcgcgagaagaagcugggcgaguucggcaaggccaaggggagccgggccaucugguacauguggcucggcgcgcgcuaccuggaguucgaggcccugggguuccucaacgaggaccacugguucucccgggagaacagcuacuccggcguggagggggagggccugcacaagcugggcuacauccuccgcgacaucagcaagauccccgggggcgccauguacgccgacgacacggccgggugggacacccggaucaccgaggacgaccugcacaacgaggagaagaucacccagcagauggacccggagcaccgccagcuggcgaacgccaucuucaagcucaccuaccagaacaaggucgugaaggugcagcggcccacgcccaccggcaccgucauggacaucaucucccgcaaggaccagcggggcagcggccaggugggcaccuacgggcugaacacguucaccaacauggaggcccagcugauccgccagauggagggcgagggggugcucuccaaggccgaccuggagaacccccaccuccccgagaagaagaucacccaguggcuggagaccaagggcgucgagcggcugaagcgcauggccaucagcggcgacgacugcguggugaagcccaucgacgaccgguucgcgaacgcccugcucgcccugaacgacauggggaagguccgcaaggacaucccccaguggcagcccuccaagggcuggcacgacuggcagcaggucccguucugcagccaccacuuccacgagcugaucaugaaggacgggcggaagcucgugguccccugccgcccccaggacgagcugaucggccgggcccgcaucucccagggggccggcuggagccugcgggagacggcgugccucggcaaggccuacgcccagauguggucccugauguacuuccaccgccgcgaccugcggcucgccagcaacgcgaucugcuccgccgugcccgugcacugggucccgaccagccgcaccaccugguccauccacgcccaccaccaguggaugacgaccgaggacaugcugaccguguggaaccggguguggaucgaggacaaccccuggauggaggacaagacccccgucacgaccugggagaacgugcccuaccuggggaagcgcgaggaccaguggugcggcagccucaucgggcugaccagccgggccaccugggcccagaacaucccgacggcgauccagcagguccgcucccugaucggcaacgaggaguuccucgacuacaugcccagcaugaagcgguuccgcaaggaggaggaguccgagggggccaucugguga

SEQ ID NO: 10216 - RNA, 9873 nt, Artificial Sequence
  derived and/or modified CDS sequence (opt1) from DENV-3__FJ373304__SS-prME
accagccucugccucaugaugauccugcccgccgcccuggcguuccaccucaccagccgggacggcgagccccggaugaucguggggaagaacgagcgcggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcggagcguggcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagguggugcaccagaucuucggguccgcguacacggcccuguucagcggcgucuccugggugaugaagaucggcaucggggugcuccugaccuggaucggccugaacagcaagaacaccuccaugagcuucuccugcaucgccaucgggaucaucacccucuaccugggcgccgucgugcaggccgacauggggugcgugaucaacuggaagggcaaggagcugaagugcggcagcgggaucuucgucacgaacgaggugcacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccgucguggugggggacaccaucggcguccucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgccucccgggcguggaacgugugggaggucgaggacuacggguucggcguguucaccaccaacaucuggcucaagcugcgcgagguguacacccagcugugcgaccaccggcucaugagcgccgccgucaaggacgagcgcgccgugcacgccgacaugggcuacuggaucgagagccagaagaacggguccuggaagcuggagaaggcgagccugaucgaggugaagacgugcaccuggccgaagucccacacccucuggagcaacggcguccuggaguccgacaugaucauccccaagagccuggccgggcccaucucccagcacaacuaccggccgggcuaccacacccagacggccgggcccuggcaccucggcaagcuggagcuggacuucaacuacugcgagggcaccaccguggugaucaccgagaacugcgggacgcgcggccccagccuccggaccaccaccgucuccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcggggaggucgacaacuucaccaugggcgugcugugccucgccauccuguucgaggaggugaugcgggggaaguucggcaagaagcacaugaucgcgggggucuucuucaccuucgugcugcuccuguccggccagaucaccuggcgcgacauggcccacacgcugaucaugaucggcagcaacgccuccgaccggauggggaugggcgugaccuaccucgcccugaucgccaccuucaagauccagcccuuccuggcgcucggguucuuccugcgcaagcugaccagccgggagaaccuccugcugggcgucggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccaucuucacccugacgguggccuggcgcaccgccacccugauccucgcgggggucagccugcugccggugugccaguccagcuccaugcggaagaccgacuggcuccccaugacgguggccgccaugggcgugccgccccucccgcuguucaucuucagccucaaggacacccugaagcgccgcuccuggccccugaacgagggggugauggccgugggccucgucagcauccuggccuccagccugcuccggaacgacgugcccauggcgggcccccugguggccgggggccugcucaucgccugcuacgucaucaccgggaccuccgccgaccugacgguggagaaggccgcggacgugaccugggaggaggaggccgagcagaccggcgucagccacaaccugaugaucaccguggacgacgacgggaccaugcgcaucaaggacgacgagacggagaacauccucaccgugcugcugaagaccgcccuccugaucgucuccggcaucuucccguacagcauccccgccacccugcucguguggcacacguggcagaagcagacccagcgguccggcgugcugugggacguccccagcccgcccgagacccagaaggccgagcuggaggaggggguguaccgcaucaagcagcagggcaucuucgggaagacccaggugggcgucggggugcagaaggagggcguguuccacacgauguggcacgucacccggggcgcggugcucaccuacaacgggaagcgccuggagcccaacugggccuccgugaagaaggaccugaucagcuacggcgggggcuggcggcucuccgcccaguggcagaagggggaggagguccaggugaucgccguggagcccggcaagaaccccaagaacuuccagaccaugcccggcacguuccagaccaccaccggggagaucggcgcgaucgcccuggacuucaagcccgggacgagcggcagccccaucaucaaccgcgagggcaaggucguggggcuguacggcaacgggguggucaccaagaacggcggguacguguccggcaucgcccagaccaacgccgagccggacggccccacccccgagcuggaggaggagauguucaagaagcggaaccucacgaucauggaccugcaccccgggagcggcaagacccgcaaguaccugccggccaucgugcgggaggcgaucaagcgccggcuccgcacccugauccuggcccccacccgggucguggccgccgagauggaggaggcccucaaggggcugcccauccgcuaccagacgaccgcgaccaaguccgagcacaccggccgggagaucguggaccugaugugccacgccacguucaccaugcgccuccugagccccguccgggugccgaacuacaaccugaucaucauggacgaggcccacuucaccgaccccgccuccaucgccgcgcgcggguacaucagcacccgggugggcaugggcgaggccgccgccaucuucaugacggcgacgccgcccgggaccgccgacgccuucccgcaguccaacgcccccauccaggacgaggagcgcgacauccccgagcgcagcuggaacuccggcaacgaguggaucaccgacuucgccgggaagacggucugguucgugcccagcaucaaggcgggcaacgacaucgccaacugccuccggaagaacgggaagaaggugauccagcugucccgcaagaccuucgacaccgaguaccagaagaccaagcugaacgacugggacuucgucgugacgaccgacaucagcgagaugggcgccaacuucaaggccgaccgggugaucgacccgcgccggugccucaagcccgucauccugaccgacggccccgagcgcgugauccuggccgggcccaugccggugaccgcggccuccgccgcccagcggcgcggccgggucgggcgcaacccccagaaggagaacgaccaguacaucuucaccggccagccccucaacaacgacgaggaccacgcccacuggacggaggcgaagaugcugcuggacaacaucaacacccccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcgcacaagguggccagcgagggcaucaaguacaccgaccgcaaguggugcuucgacgggcagcggaacaaccagauccuggaggagaacauggacguggagaucuggacgaaggagggcgagaagaagaagcuccgcccccgguggcuggacgcccgcaccuacuccgacccgcuggcccucaaggaguucaaggacuucgccgcgggccgcaagagcaucgcccuggaccuggucaccgagaucgggcgggugcccacccaccucgcccaccgcacgcggaacgcccuggacaaccuggugaugcuccacaccuccgagcacggcgggaaggccuaccgccacgcggucgaggagcugcccgagaccauggagacccugcuccugcugggccucaugauccugcugaccggcggggccaugcuguuccugaucagcgggaaggggaucggcaagaccagcaucgggcugaucugcgugaucgccuccagcggcaugcucuggauggccgagaucccgcugcaguggaucgccuccgcgaucauccuggaguucuucaugauggugcuccugauccccgagcccgagaagcagcggacgccccaggacaaccagcuggccuacgucgugaucgggauccucacccuggccgccaucaucgccgcgaacgagaugggccugcucgagacgaccaagcgcgaccugggcaugagcaaggagccggggguggucucccccaccagcuaccuggacguggaccuccaccccgccuccgccuggacccuguacgccguggcgacgaccgucaucacccccaugcugcggcacaccaucgagaacagcacggccaacgugucccucgccgccaucgccaaccaggcggugguccugaugggccuggacaagggguggccgaucagcaagauggaccucggcgugccccugcuggcccucgggugcuacucccaggugaacccccugacccugaccgccgccguccuccugcugaucacccacuacgccaucaucggccccggccuccaggcgaaggccacgcgcgaggcccagaagcggaccgccgccgggaucaugaagaacccgaccguggacggcaucaugaccaucgaccuggaccccgugaucuacgacagcaaguucgagaagcagcuggggcaggucaugcuccuggugcugugcgcggugcagcuccugcugaugcgcacguccugggcccucugcgaggcccugacccuggccaccggccccaucaccacgcucugggagggcagccccgggaaguucuggaacaccaccaucgcggucuccauggccaacaucuuccggggcagcuaccuggccggggccggccuggccuucuccaucaugaaguccguggggaccggcaagcgcggcaccgggucccagggcgagacgcucggggagaaguggaagaagaagcugaaccagcugagccggaaggaguucgaccucuacaagaaguccggcaucaccgagguggaccgcaccgaggcgaaggaggggcugaagcggggcgagaucacccaccacgccgucucccgcggcagcgccaagcugcagugguucguggagcggaacauggugaucccggaggggcgcgucaucgaccucggcugcgggcggggcgggugguccuacuacugcgccggccugaagaaggugacggaggugcgcggcuacaccaagggcgggcccgggcacgaggagcccguccccaugagcaccuacggcuggaacaucgugaagcugauguccgggaaggacguguucuaccucccgcccgagaagugcgacacccugcugugcgacaucggcgagagcucccccagccccacggucgaggagucccggaccauccgcgugcugaagaugguggagccguggcucaagaacaaccaguucugcaucaagguccugaaccccuacaugcccaccgugaucgagcaccuggagcgccuccagcggaagcacggcgggaugcuggugcgcaacccccugagccggaacuccacccacgagauguacuggaucagcaacggcacggggaacaucgucgccuccgugaacauggugagccgccuccugcugaaccgguucaccaugacccaccgccggccgaccaucgagaaggacgucgaccucggcgcgggcacgcgccacgugaacgccgagcccgagacccccaacauggacgugaucggggagcggaucaagcgcaucaaggaggagcacaacuccaccuggcacuacgacgacgagaacccguacaagaccugggccuaccacggcagcuacgaggucaaggccacgggguccgccagcuccaugaucaacggcguggucaagcugcugaccaagcccugggacguggugcccauggucacccagauggcgaugaccgacacgacccccuucgggcagcagcggguguucaaggagaagguggacacccgcaccccgcggagcaugcccggcacgcgccgggucaugggcaucaccgccgaguggcucuggcgcacccuggggcggaacaagaagccccgccugugcacccgggaggaguucacgaagaaggugcgcaccaacgccgccaugggcgcgguguucaccgaggagaaccagugggacagcgccaaggccgccgucgaggacgaggacuucuggaagcucguggaccgcgagcgggagcugcacaagcuggggaagugcggcuccugcguguacaacaugauggggaagcgcgagaagaagcucggcgaguucggcaaggccaaggggagccgggcgaucugguacauguggcugggcgcccgcuaccuggaguucgaggcccucggguuccugaacgaggaccacugguucucccgggagaacagcuacuccggcgucgagggggagggccugcacaagcucggcuacauccugcgcgacaucagcaagauccccgggggcgccauguacgccgacgacaccgcggggugggacacgcggaucaccgaggacgaccugcacaacgaggagaagaucacccagcagauggacccggagcaccgccagcucgccaacgccaucuucaagcugaccuaccagaacaagguggugaagguccagcggcccacccccacgggcaccgugauggacaucaucucccgcaaggaccagcggggcagcggccaggugggcaccuacgggcugaacaccuucacgaacauggaggcccagcucauccgccagauggagggcgaggggguccuguccaaggccgaccuggagaacccccaccucccggagaagaagaucacccaguggcuggagaccaagggcguggagcggcugaagcgcauggcgaucagcggcgacgacugcguggucaagcccaucgacgaccgguucgccaacgcccuccuggcccugaacgacauggggaaggugcgcaaggacaucccccaguggcagcccuccaagggcuggcacgacuggcagcaggucccguucugcagccaccacuuccacgagcucaucaugaaggacgggcggaagcuggucgugcccugccgcccccaggacgagcugaucggccgggcccgcaucucccagggggcgggcuggagccuccgggagaccgccugccugggcaaggccuacgcccagauguggucccugauguacuuccaccgccgcgaccuccggcuggcgagcaacgccaucugcuccgccgugcccguccacugggugccgacgagccgcaccaccugguccauccacgcccaccaccaguggaugaccacggaggacaugcugaccguguggaaccgggucuggaucgaggacaaccccuggauggaggacaagacccccgugaccacgugggagaacgugcccuaccucgggaagcgcgaggaccaguggugcggcagccugaucgggcugaccagccgggccaccugggcgcagaacaucccgaccgccauccagcagguccgcucccucaucggcaacgaggaguuccuggacuacaugcccagcaugaagcgguuccgcaaggaggaggaguccgagggggccaucugguga

SEQ ID NO: 10217 - RNA, 9873 nt, Artificial Sequence
  derived and/or modified CDS sequence (opt1) from DENV-3__EU854291__SS-prME
accagccucugccucaugaugauccugcccgccgcccuggcguuccaccucaccucccgggacggcgagccgcggaugaucguggggaagaacgagcggggcaagagccugcuguucaagaccgccuccgggaucaacaugugcacccucaucgccauggaccugggcgagaugugcgacgacaccaucaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgucggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaaggucgugaucuucauccugcugaugcucgugacgcccagcaugaccaugcggugcgucggggugggcaaccgcgacuucguggagggccuguccggggccaccugggucgacguggugcuggagcacggcgggugcgucaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacaccgugaucaucacggugcacaccggggaccagcaccaggucggcaacgagacccagggggugaccgccgagaucacgccccaggccagcaccaccgaggcgauccugcccgaguacggcacccuggggcucgagugcuccccgcgcaccggccuggacuucaacgagaugauccugcucacgaugaagaacaaggccuggaugguccaccggcagugguucuucgaccugccccugcccuggaccagcggcgccaccaccgagacgcccaccuggaaccgcaaggagcuccuggugaccuucaagaacgcccacgccaagaagcaggagguggucgugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucgugcugaagaaggaggucuccgagacccagcacgggaccauccucaucaagguggaguacaagggcgaggacgugccgugcaagauccccuucagcaccgaggacgggcagggcaaggcgcacaacggccgccugaucacggccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacaccgccugggacuucggguccgugggcggggugcucaacagccugggcaagaugguccaccagaucuucggguccgcguacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggccgacauggggugcgucaucaacuggaagggcaaggagcugaagugcggcagcgggaucuucgugacgaacgaggugcacaccuggaccgagcaguacaaguuccaggcggacucccccaagcgccucgccaccgccaucgccggcgccugggagaacggggucugcggcauccgcagcacgacccggauggagaaccugcuguggaagcagaucgcgaacgagcucaacuacauccugugggagaacaacaucaagcugaccgugguggucggggacaccaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgccucccgggcguggaacgucugggagguggaggacuacggguucggcguguucaccaccaacaucuggcucaagcugcgcgaggucuacacccagcugugcgaccaccggcucaugagcgccgccgugaaggacgagcgcgccgugcacgccgacaugggcuacuggaucgagagccagaagaacggguccuggaagcuggagaaggcgagccugaucgaggucaagacgugcaccuggccgaagucccacacccucuggagcaacggcgugcuggaguccgacaugaucauccccaagagccuggccgggcccaucucccagcacaacuaccggccgggcuaccacacccagacggccgggcccuggcaccucggcaagcuggagcuggacuucaacuacugcgagggcaccaccguggucaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccguguccgagaaggaggagaacauggucaagagccugguguccgccggcagcggggagguggacaacuucaccaugggcguccugugccucgccauccuguucgaggaggugaugcgggggaaguucggcaagaagcacaugaucgcggggguguucuucaccuucguccugcuccuguccggccagaucaccuggcgcgacauggcccacacgcugaucaugaucggcagcaacgccuccgaccggauggggaugggcgugaccuaccucgcccugaucgccaccuucaagauccagcccuuccuggcgcucggguucuuccugcgcaagcugaccagccgggagaaccuccugcugggcgugggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccaucuucacccugacggucgccuggcgcaccgccacccugauccucgcgggggugagccugcugccggucugccaguccagcuccaugcggaagaccgacuggcuccccaugacgguggccgccaugggcgugccgccccucccgcuguucaucuucagccucaaggacacccugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugacggucgagaaggccgcggacgugaccugggaggaggaggccgagcagaccggcgugagccacaaccugaugaucaccgucgacgacgacgggaccaugcgcaucaaggacgacgagacggagaacauccucaccgugcugcugaagaccgcccuccugaucguguccggcaucuucccguacagcauccccgccacccugcucgucuggcacacguggcagaagcagacccagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacacgauguggcacgugacccggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcacguuccagaccaccaccggggagaucggcgcgaucgcccuggacuucaagcccgggacgagcggcagccccaucaucaaccgcgagggcaagguggucgggcuguacggcaacgggguggugaccaagaacggcggguacgucuccggcaucgcccagaccaacgccgagccggacggccccacccccgagcuggaggaggagauguucaagaagcggaaccucacgaucauggaccugcaccccgggagcggcaagacccgcaaguaccugccggccaucgugcgggaggcgaucaagcgccggcuccgcacccugauccuggcccccacccggguggucgccgccgagauggaggaggcccucaaggggcugcccauccgcuaccagacgaccgcgaccaaguccgagcacaccggccgggagaucguggaccugaugugccacgccacguucaccaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugacggcgacgccgcccgggaccgccgacgccuucccgcaguccaacgcccccauccaggacgaggagcgcgacauccccgagcgcagcuggaacuccggcaacgaguggaucaccgacuucgccgggaagacggugugguucguccccagcaucaaggcgggcaacgacaucgccaacugccuccggaagaacgggaagaaggugauccagcugucccgcaagaccuucgacaccgaguaccagaagaccaagcugaacgacugggacuucguggucacgaccgacaucagcgagaugggcgccaacuucaaggccgaccgggugaucgacccgcgccggugccucaagcccgugauccugaccgacggcuccgagcgcgucauccuggccgggcccaugcccgugaccgcggccagcgccgcccagcggcgcggccggguggggcgcaacccgcagaaggagaacgaccaguacaucuucaccggccagccccucaacaacgacgaggaccacgcccacuggacggaggcgaagaugcugcuggacaacaucaacacccccgaggggaucauccccgcccucuucgagccggagcgggagaaguccgccgccaucgacggcgaguaccgccugaagggcgagagccggaagaccuucgucgagcugaugcgccgcggggaccuccccguguggcuggcgcacaaggucgccuccgagggcaucaaguacaccgaccgcaaguggugcuucgacgggcagcggaacaaccagauccuggaggagaacauggacguggagaucuggacgaaggagggcgagaagaagaagcuccgcccccgguggcuggacgcccgcaccuacagcgacccccuggcccucaaggaguucaaggacuucgccgcgggccgcaaguccaucgcccuggaccuggugaccgagaucgggcgggucccgacccaccucgcccaccgcacgcggaacgcccuggacaaccuggugaugcuccacaccagcgagcacggcgggaaggccuaccgccacgcgguggaggagcugcccgagaccauggagacccugcuccugcugggccucaugauccugcugaccggcggggccaugcuguuccugaucagcgggaaggggaucggcaagaccuccaucgggcugaucugcgucaucgccagcuccggcaugcucuggauggccgagaucccccugcaguggaucgccagcgcgaucgugcuggaguucuucaugauggugcuccugaucccggagcccgagaagcagcggacgccccaggacaaccagcuggccuacgucgugaucgggauccucacccuggccgccacgaucgccgcgaacgagaugggccugcucgagaccaccaagcgcgaccugggcauguccaaggagcccgggguggucagcccgaccuccuaccuggacguggaccuccaccccgccagcgccuggacgcuguacgccguggcgaccaccgucaucacccccaugcugcggcacacgaucgagaacuccaccgccaacgugagccucgccgccaucgccaaccaggcggugguccugaugggccuggacaagggguggcccaucuccaagauggaccucggcgugccgcugcuggcccucgggugcuacagccaggugaacccccugacccugaccgccgccguccuccugcugaucacgcacuacgccaucaucggccccggccuccaggcgaaggccacccgcgaggcccagaagcggaccgccgccgggaucaugaagaaccccaccguggacggcaucaugacgaucgaccuggacccggugaucuacgacuccaaguucgagaagcagcuggggcaggucaugcuccuggugcugugcgcggugcagcuccugcugaugcgcaccagcugggcccucugcgaggcccugacccuggccaccggccccaucacgacccucugggagggcucccccgggaaguucuggaacaccaccaucgcggucagcauggccaacaucuuccggggcuccuaccuggccggggccggccuggccuucagcaucaugaaguccguggggaccggcaagcgcggcacggggagccagggcgagacccucggggagaaguggaagaagaagcugaaccagcugagccggaaggaguucgaccucuacaagaaguccggcaucaccgagguggaccgcaccgaggcgaaggaggggcugaagcggggcgagaucacgcaccacgccgucagccgcggcuccgccaagcugcagugguucguggagcggaacauggugauccccgaggggcgcgucaucgaccucggcugcgggcggggcggguggagcuacuacugcgccggccugaagaaggugaccgaggugcgcggcuacaccaagggcgggccggggcacgaggagcccguccccauguccaccuacggcuggaacaucgugaagcugaugagcgggaaggacguguucuaccucccgcccgagaagugcgacacgcugcugugcgacaucggcgaguccagccccucccccaccgucgaggagagccggaccauccgcgugcugaagaugguggagcccuggcucaagaacaaccaguucugcaucaagguccugaaccccuacaugcccaccgugaucgagcaccuggagcgccuccagcggaagcacggcgggaugcuggugcgcaacccccugucccggaacagcacgcacgagauguacuggaucuccaacggcaccgggaacaucgucgccagcgugaacauggugucccgccuccugcugaaccgguucaccaugacccaccgccggcccacgaucgagaaggacgucgaccucggcgcgggcacccgccacgugaacgccgagccggagacccccaacauggacgugaucggggagcggaucaagcgcaucaaggaggagcacaacagcaccuggcacuacgacgacgagaaccccuacaagacgugggccuaccacggcuccuacgaggucaaggccaccgggagcgccuccagcaugaucaacggcguggucaagcugcugaccaagccgugggacguggugcccauggucacccagauggcgaugacggacaccacccccuucgggcagcagcggguguucaaggagaagguggacacccgcacgccccggccgaugcccggcacccgccgggucaugggcaucaccgccgaguggcucuggcgcacccuggggcggaacaagaagccccgccugugcacgcgggaggaguucaccaagaaggugcgcaccaacgccgccaugggcgcgguguucaccgaggagaaccagugggacagcgccaaggccgccgucgaggacgaggacuucuggaagcucguggaccgcgagcgggagcugcacaagcuggggaagugcggcuccugcguguacaacaugauggggaagcgcgagaagaagcucggcgaguucggcaaggccaaggggagccgggcgaucugguacauguggcugggcgcccgcuaccuggaguucgaggcccucggguuccugaacgaggaccacugguucucccgggagaacagcuacuccggcgucgagggggagggccugcacaagcucggcuacauccugcgcgacaucagcaagauccccgggggcgccauguacgccgacgacacggcggggugggacacccggaucaccgaggacgaccugcacaacgaggagaagaucacccagcagauggacccggagcaccgccagcucgccaacgccaucuucaagcugaccuaccagaacaagguggugaagguccagcggcccacgcccaccggcaccgugauggacaucaucucccgcaaggaccagcggggcagcggccaggugggcaccuacgggcugaacacguucaccaacauggaggcccagcucauccgccagauggagggcgaggggguccuguccaaggccgaccuggagaacccccaccucccggagaagaagaucacccaguggcuggagaccaagggcguggagcggcugaagcgcauggcgaucagcggcgacgacugcguggucaagcccaucgacgaccgguucgccaacgcccuccuggcccugaacgacauggggaaggugcgcaaggacaucccccaguggcagcccuccaagggcuggcacgacuggcagcaggucccguucugcagccaccacuuccacgagcucaucaugaaggacgggcggaagcuggucgugcccugccgcccccaggacgagcugaucggccgggcccgcaucucccagggggcgggcuggagccuccgggagacggccugccugggcaaggccuacgcccagauguggucccugauguacuuccaccgccgcgaccuccggcuggcgagcaacgccaucugcuccgccgugcccguccacugggugccgaccagccgcaccaccugguccauccacgcccaccaccaguggaugacgaccgaggacaugcugaccguguggaaccgggucuggaucgaggacaaccccuggauggaggacaagacccccgugacgaccugggagaacgugcccuaccucgggaagcgcgaggaccaguggugcggcagccugaucgggcugaccagccgggccaccugggcgcagaacaucccgacggccauccagcagguccgcucccucaucggcaacgaggaguuccuggacuacaugcccagcaugaagcgguuccgcaaggaggaggaguccgagggggccaucugguga

SEQ ID NO: 10218 - RNA, 9873 nt, Artificial Sequence
  derived and/or modified CDS sequence (opt1) from DENV-3__KF955454__SS-prME
accagccugugccucaugaugauccugcccgccgcccuggcguuccaccucaccucccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgggacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggagggggacaugaucauccccaagucccuggccggccccaucagccagcacaacuaccggccgggguaccacacccagaccgccggccccuggcaccucggcaagcuggagcuggacuucaacuacugcgaggggacgaccgucgugaucaccgagaacugcggcacccgcgggcccucccuccggacgaccaccgugagcggcaagcugauccacgaguggugcugccgcuccugcacccugcccccgcuccgguacaugggggaggacggcugcugguacggcauggagauccgccccaucagcgagaaggaggagaacauggucaagucccuggugagcgccggguccggcgagguggacaacuucacgauggggguccugugccucgccauccuguucgaggaggugaugcggggcaaguucgggaagaagcacaugaucgcgggcguguucuucaccuucguccugcuccugagcggccagaucaccuggcgcgacauggcccacacccugaucaugaucggguccaacgccagcgaccggaugggcaugggggugacguaccucgcccugaucgccaccuucaagauccagcccuuccuggcgcucggcuucuuccugcgcaagcugaccucccgggagaaccuccugcugggcguggggcucgccauggccaccacgcugcagcugcccgaggacaucgagcagauggccaacggcaucgcgcucgggcugauggcccugaagcucaucacccaguucgagaccuaccagcuguggaccgcccugaucagccucacgugcagcaacaccaucuucacccugaccgucgccuggcgcacggccacccugauccucgcgggcgugucccugcugccggucugccagagcuccagcaugcggaagaccgacuggcuccccaugaccguggccgccaugggggugccgccccugccgcuguucaucuucucccucaaggacacgcugaagcgccgcagcuggccccugaacgagggcgucauggccgugggccucguguccauccuggccagcucccugcuccggaacgacguccccauggcggggccccugguggccggcgggcugcucaucgccugcuacgugaucaccggcaccagcgccgaccugaccgucgagaaggccgcggacgugacgugggaggaggaggccgagcagaccggggugucccacaaccugaugaucaccgucgacgacgacggcaccaugcgcaucaaggacgacgagaccgagaacauccucacggugcugcugaagaccgcccuccugaucgugagcggcaucuucccguacuccauccccgccacccugcucgucuggcacaccuggcagaagcagacgcagcggagcggggugcugugggacgugcccagcccgcccgagacccagaaggccgagcuggaggagggcgucuaccgcaucaagcagcaggggaucuucggcaagacccaggugggggugggcguccagaaggagggcguguuccacaccauguggcacgugacgcgcggggcgguccucaccuacaacggcaagcgccuggagcccaacugggccagcgugaagaaggaccugaucuccuacgggggcggguggcggcucagcgcccaguggcagaagggcgaggaggugcaggucaucgccguggagcccggcaagaaccccaagaacuuccagaccaugcccgggaccuuccagacgaccaccggcgagaucggggcgaucgcccuggacuucaagcccggcaccuccggcagccccaucaucaaccgcgaggggaagguggucggccuguacgggaacggcguggugacgaagaacgggggcuacgucagcggcaucgcccagaccaacgccgagccggacgggcccacccccgagcuggaggaggagauguucaagaagcggaaccucaccaucauggaccugcaccccggcuccgggaagacgcgcaaguaccugccggccaucgugcgggaggcgaucaagcgccggcuccgcacccugauccuggcccccacccggguggucgccgccgagauggaggaggcccucaagggccugcccauccgcuaccagaccacggcgaccaagagcgagcacaccgggcgggagaucguggaccugaugugccacgccaccuucacgaugcgccuccugucccccgugcgggucccgaacuacaaccugaucaucauggacgaggcccacuucaccgaccccgccagcaucgccgcgcgcggcuacaucuccacccgggugggcaugggggaggccgccgccaucuucaugaccgcgacgccgcccggcaccgccgacgccuucccgcagagcaacgcccccauccaggacgaggagcgcgacauccccgagcgcuccuggaacagcgggaacgaguggaucaccgacuucgccggcaagaccgugugguucguccccuccaucaaggcggggaacgacaucgccaacugccuccggaagaacggcaagaaggugauccagcugagccgcaagacguucgacaccgaguaccagaagaccaagcugaacgacugggacuucguggucaccacggacaucuccgagaugggcgccaacuucaaggccgaccgggugaucgacccgcgccggugccucaagcccgugauccugaccgacgggcccgagcgcgucauccuggccggccccaugccggugaccgcggccagcgccgcccagcggcgcgggcgggugggccgcaacccccagaaggagaacgaccaguacaucuucaccgggcagccccucaacaacgacgaggaccacgcccacuggaccgaggcgaagaugcugcuggacaacaucaacacgcccgagggcaucaucccggcccucuucgagcccgagcgggagaaguccgccgccaucgacggcgaguaccgccugaagggggagagccggaagaccuuccuggagcucaugcgccggggcgaccugcccgucuggcuggcguacaagguggccuccgaggggaucaaguacaccgaccgcaaguggugcuucgacggccagcggaacaaccagauccucgaggagaacauggacgucgagaucuggaccaaggagggcgagaagaagaagcugcgcccccgguggcuggacgcccgcacguacagcgacccgcucgcccugaaggaguucaaggacuucgccgcggggcgcaaguccaucgcccuggaccucgugaccgagaucggccgggugcccacccaccuggcccaccgcacccggaacgcccuggacaaccucgucaugcugcacacgagcgagcacgggggcaaggccuaccgccacgcgguggaggagcugcccgagaccauggagacccuccugcugcucgggcugaugauccugcucaccggcggcgccaugcuguuccugaucuccgggaagggcaucgggaagacgagcaucggccucaucugcgugaucgccagcuccgggaugcuguggauggccgagaucccgcugcaguggaucgccagcgcgaucguccucgaguucuucaugauggugcugcugauccccgagcccgagaagcagcggacgccccaggacaaccagcucgccuacguggucaucggcauccugacccuggccgccaucaucgccgcgaacgagaugggccuccuggagaccacgaagcgcgaccuggggauguccaaggagccgggcguggugagccccaccuccuaccucgacgucgaccugcaccccgccagcgccuggacccuguacgccguggcgaccacggugaucacccccaugcuccggcacaccaucgagaacuccaccgccaacgucagccuggccgccaucgccaaccaggcgguggugcugauggggcucgacaagggcuggccgaucuccaagauggaccugggggucccccugcucgcccugggcugcuacagccaggugaacccccugacgcucaccgccgccgugcugcugcucaucacccacuacgccaucaucggccccgggcugcaggcgaaggccacccgcgaggcccagaagcggacggccgccggcaucaugaagaacccgaccgucgacgggaucaugaccaucgaccuggaccccgugaucuacgacuccaaguucgagaagcagcucggccaggugaugcugcugguccucugcgcggugcagcugcugcucaugcgcaccagcugggcccugugcgaggcccugacgcucgccaccggccccaucaccacccugugggaggggucccccggcaaguucuggaacacgaccaucgcggugagcauggccaacaucuuccggggguccuaccuggccggcgccgggcucgccuucagcaucaugaaguccgucggcaccggcaagcgcgggaccggcagccagggggagacccugggcgagaaguggaagaagaagcugaaccagcucucccggaaggaguucgaccuguacaagaaguccgggaucacggagguggaccgcgcggaggccaaggagggccugaagcggggcgagaucacccaccacgccgugagccgcggguccgccaagcuccagugguucgucgagcggaacauggugaucccggagggccgcgugaucgaccuggggugcggccgcgggggcuggagcuacuacugcgccggccugaagaaggucaccgaggugcgcggguacaccaagggcgggcccggccacgaggagcccgugcccauguccacguacggguggaacaucgucaagcucaugagcggcaaggacguguucuaccugccgcccgagaagugcgacacccugcugugcgacaucggcgaguccagccccucccccaccguggaggagagccggaccauccgcguccucaagaugguggagccguggcugaagaacaaccaguucugcaucaaggugcugaaccccuacaugcccacggucaucgagcaccucgagcgccugcagcggaagcacgggggcaugcuggugcgcaacccccucucccggaacagcacccacgagauguacuggaucuccaacgggaccggcaacaucguggcgagcgucaacauggugucccgccugcugcucaaccgguucaccaugacgcaccgccggccgaccaucgagaaggacguggaccugggcgccgggacccgccacgucaacgccgagcccgagacccccaacauggacgugaucggcgagcggaucaagcgcaucaaggaggagcacaacagcacguggcacuacgacgacgagaacccguacaagaccugggccuaccacggguccuacgaggugaaggccaccggcagcgcguccagcaugaucaacggggucgugaagcugcucaccaagcccugggacgucgugcccauggugacgcagauggccaugaccgacaccacccccuucggccagcagcgggucuucaaggagaagguggacacgcgcaccccgcgguccaugcccggcacccgccgggugauggggaucaccgccgaguggcuguggcgcacgcugggccggaacaagaagccccgccucugcacccgggaggaguucaccaagaagguccgcaccaacgccgcgaugggggccguguucacggaggagaaccagugggacagcgccaaggccgccguggaggacgaggacuucuggaagcuggucgaccgcgagcgggagcugcacaagcucggcaagugcgggagcugcguguacaacaugaugggcaagcgcgagaagaagcugggcgaguucgggaaggcgaagggcucccgggccaucugguacauguggcugggggcccgcuaccucgaguucgaggcccugggcuuccugaacgaggaccacugguucagccgggagaacuccuacagcgggguggagggcgagggccuccacaagcugggguacauccugcgcgacaucuccaagauccccggcggggccauguacgcggacgacaccgccggcugggacacccggaucaccgaggacgaccuccacaacgaggagaagaucacgcagcagauggacccggagcaccgccagcuggccaacgccaucuucaagcugaccuaccagaacaaggucgugaaggugcagcggcccacccccaccggcaccgucauggacaucaucagccgcaaggaccagcggggguccggccagguggggacguacggccucaacaccuucaccaacauggaggcccagcugauccgccagauggagggggagggcgugcugagcaaggcggaccucgagaacccccacccgcccgagaagaagaucacccaguggcuggagacgaagggcgucgagcggcugaagcgcauggccaucuccggggacgacugcguggugaagcccaucgacgaccgguucgccaacgcccuccuggcccugaacgacaugggcaagguccgcaaggacaucccccaguggcagccgagcaagggguggcacgacuggcagcagguccccuucugcucccaccacuuccacgagcucaucaugaaggacggccggaagcuggugguccccugccgcccccaggacgagcugaucgggcgggcgcgcaucagccagggcgccggcuggucccuccgggagaccgccugccuggggaaggccuacgcgcagauguggagccugauguacuuccaccgccgcgaccuccggcuggccuccaacgccaucugcagcgccgugccggugcacuggguccccaccucccgcaccacguggagcauccacgcccaccaccaguggaugaccaccgaggacaugcugaccguguggaaccggguguggaucgaggacaaccccuggauggaggacaagacgcccgucaccaccugggagaacgugccguaccucggcaagcgcgaggaccaguggugcgggucccugaucggccugaccagccgggcgacgugggcccagaacauccccaccgccauccagcagguccgcagccucaucgggaacgaggaguuccuggacuacaugcccuccaugaagcgguuccgcaaggaggaggagagcgagggcgccaucugguga

SEQ ID NO: 10219 - RNA, 9873 nt, Artificial Sequence
  derived and/or modified CDS sequence (opt1) from DENV-3__EU854292__SS-prME
accagccugugccucaugaugauccugcccgcggcccuggcguuccaccucaccagccgggacggggagccgcggaugaucguggggaagaacgagcgcggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcguggggaucggcaaccgcgacuucguggagggccuguccggggccaccugggucgacguggugcuggagcacggcgggugcgucaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgcccugccggaggagcaggaccagaacuacgugugcaagcacaccuacguggaccggggguggggcaacgggugcggccucuucgggaagggcucccuggugaccugcgccaaguuccagugccuggagcccaucgagggcaagguggugcagcacgagaaccucaaguacaccgucaucaucacggugcacaccggggaccagcaccaggugggcaacgagacccagggggucaccgccgagaucacgccccaggcgagcaccaccgaggccauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggucaccuucaagaacgcccacgcgaagaagcaggagguggugguccuggggucccaggagggcgccaugcacaccgcccucacgggggccaccgagauccagaacagcggcgggaccuccaucuucgccggccaccugaagugccggcugaagauggacaagcucgagcugaagggcaugagcuacgcgaugugcaccaacacguucgugcugaagaaggagguguccgagacccagcacgggaccauccucaucaaggucgaguacaagggcgaggacgccccgugcaagauccccuucagcaccgaggacgggcagggcaaggcccacaacggccgccugaucacggccaaccccguggugaccaagaaggaggagcccgucaacaucgaggcggagccgcccuucggggagagcaacaucgugaucggcaucggggacaacgcccugaagaucaacugguacaagaagggcuccagcaucgggaagauguucgaggccaccgcccggggcgcccgccggauggcgauccugggcgacaccgccugggacuucggguccgugggcgggguccucaacagccugggcaagauggugcaccagaucuucggguccgccuacacggcccuguucagcggcguguccugggucaugaagaucggcaucggggugcuccugaccuggaucggccugaacagcaagaacaccuccaugagcuucuccugcaucgccaucgggaucaucacccucuaccugggcgcggugguccaggccgacauggggugcgugaucaacuggaagggcaaggagcugaagugcggcagcgggaucuucgugacgaacgagguccacaccuggaccgagcaguacaaguuccaggccgacucccccaagcgccucgccaccgccaucgcgggcgccugggagaacggggugugcggcauccgcagcacgacccggauggagaaccugcuguggaagcagaucgccaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgcggagacccagaacagcuccuucaucaucgacggccccaacacgcccgagugccccagcgccgcccgggccuggaacgugugggagguggaggacuacggguucggcgucuucaccaccaacaucuggcucaagcugcgcgagguguacacccagcugugcgaccaccggcucauguccgccgcggugaaggacgagcgcgccguccacgccgacaugggcuacuggaucgagagccagaagaacgggagcuggaagcuggagaaggccucccugaucgaggugaagaccugcacguggcccaagagccacacccucugguccaacggcgugcuggagagcgacaugaucauccccaagucccuggccgggcccaucagccagcacaaccaccggccgggcuaccacacccagaccgcggggcccuggcaccucggcaagcuggagcuggacuucaacuacugcgagggcacgaccgucgugaucaccgagaacugcgggacccgcggccccucccuccggacgaccaccgugagcgggaagcugauccacgaguggugcugccgcuccugcacccugcccccgcuccgguacaugggcgaggacgggugcugguacggcauggagauccgccccaucagcgagaaggaggagaacauggucaagucccuggugagcgccggcuccgggaagguggacaacuucacgaugggcguccugugccucgccauccuguucgaggaggugaugcgggggaaguucggcaagaagcacaugaucgccgggguguucuucaccuucguccugcuccugagcggccagaucaccuggcgcgacauggcccacacccugaucaugaucggcuccaacgcgagcgaccggauggggaugggcgugacguaccucgcccugaucgccaccuucaagauccagcccuuccuggcccucggguucuuccugcgcaagcugaccucccgggagaaccuccugcugggcgugggccucgcgauggccaccacgcugcagcugcccgaggacaucgagcagauggccaacgggaucgcccucggccugauggcccugaagcucaucacccaguucgagaccuaccagcuguggaccgcgcugaucagccucacgugcagcaacaccaucuucacccugaccgucgccuggcgcacggccacccugauccucgccggggugucccugcugccggugugccagagcuccagcaugcggaagaccgacuggcuccccauggccgucgcggccaugggcgugccgccccucccgcuguucaucuucugccucaaggacacccugaagcgccgcuccuggccccugaacgagggggucauggccgugggccucgugagcauccuggccuccagccugcuccggaacgacguccccauggccggcccccugguggccggcgggcugcucaucgccugcuacgugaucacggggaccuccgccgaccugaccgucgagaaggccgccgacaucaccugggaggaggaggcggagcagacgggggugagccacaaccugaugaucaccguggacgacgacgggaccaugcgcaucaaggacgacgagaccgagaacauccucaccguccugcugaagacggcccuccugaucguguccggcaucuucccguacagcauccccgccacccugcucguguggcacaccuggcagaagcagacccagcgguccggcguccugugggacgugcccagcccgcccgagacgcagaaggccgagcuggaggaggggguguaccgcaucaagcagcagggcaucuucgggaagacccaggucggcgugggggugcagaaggagggcgucuuccacaccauguggcacgugacccggggcgcggugcucacguacaacgggaagcgccuggagcccaacugggccuccgucaagaaggaccugaucagcuacggcgggggcuggcggcucuccgcccaguggcagaagggggaggagguccaggugaucgccgucgagcccggcaagaaccccaagaacuuccagaccaugcccggcaccuuccagaccacgaccggggagaucggcgccaucgcgcuggacuucaagcccgggaccagcggcucccccaucaucaaccgcgagggcaaggugguggggcuguacggcaacggggucgugaccaagaacggcggguacgugagcggcaucgcccagacgaacgccgagccggacggccccacccccgagcuggaggaggagauguucaagaagcggaaccucaccaucauggaccugcaccccgggagcggcaagacccgcaaguaccugccggccaucguccgggaggccaucaagcgccggcuccgcacgcugauccuggcgcccacccgggugguggccgccgagauggaggaggcccucaaggggcugcccauccgcuaccagaccaccgccacgaaguccgagcacaccggccgggagaucgucgaccugaugugccacgcgaccuucaccaugcgccuccugagccccgugcgggugccgaacuacaaccugaucaucauggacgaggcccacuucacggaccccgccuccaucgccgcgcgcggguacaucagcacccgggucggcaugggcgaggccgccgccaucuucaugaccgccacgccgcccgggacggcggacgccuucccgcaguccaacgcccccauccaggacgaggagcgcgacauccccgagcgcagcuggaacuccggcaacgaguggaucaccgacuucgccgggaagaccgugugguucgugcccagcaucaaggccggcaacgacaucgcgaacugccuccggaagaacgggaagaaggucauccagcugucccgcaagaccuucgacacggaguaccagaagaccaagcugaacgacugggacuucguggugaccaccgacaucagcgagaugggcgccaacuucaaggccgaccgggucaucgacccgcgccggugccucaagcccgugauccugacggacggccccgagcgcgugauccuggccgggcccaugccggucaccgccgcguccgccgcccagcggcgcggccggguggggcgcaacccccacaaggagaacgaccaguacaucuucaccggccagccccucaacaacgacgaggaccacgcccacuggaccgaggcgaagaugcugcuggacaacaucaacacccccgaggggaucaucccggcccucuucgagcccgagcgggagaaguccgccgccaucgacggcgaguaccgccugaagggcgagucccggaagacguucguggagcugaugcgccgcggggaccuccccgucuggcuggcccacaagguggcgagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcaccuacuccgacccgcuggcccucaaggaguucaaggacuucgccgccggccgcaagagcaucgcgcuggaccuggucacggagaucgggcgggugcccucccaccucgcccaccgcacccggaacgcccuggacaaccuggucaugcuccacaccagcgagcacggcgggcgcgccuaccggcacgccguggaggagcugcccgagaccauggagacgcugcuccugcugggccucaugauccugcugaccgggggcgcgaugcuguuccugaucuccggcaaggggaucggcaagaccagcaucgggcugaucugcgugaucgccagcuccggcaugcucuggauggccgagaucccgcugcaguggaucgccagcgccaucguccuggaguucuucaugauggugcuccugauccccgagcccgagaagcagcgcacgccccaggacaaccagcuggcguacguggucaucgggauccucacgcuggccgccaucaucgccgcgaacgagaugggccugcucgagaccaccaagcgggaccugggcauguccaaggagccggggguggugagccccaccuccuaccuggacgucgaccuccaccccgccagcgccuggacgcuguacgccguggccaccaccgugaucacccccaugcugcgccacacgaucgagaacuccaccgcgaacgucagccucgccgccaucgccaaccaggccguggugcugaugggccuggacaagggguggccgaucuccaagauggaccucggcgucccccugcuggcgcucgggugcuacagccaggugaacccccugacccugaccgccgccgugcuccugcugaucacgcacuacgccaucaucggccccggccuccaggccaaggcgacccgggaggcccagaagcgcaccgccgccgggaucaugaagaacccgaccgucgacggcaucaugacgaucgaccuggaccccgugaucuacgacuccaaguucgagaagcagcugggccaggugaugcuccugguccugugcgcggugcagcuccugcugaugcggaccagcugggcccucugcgaggcccugacccuggccaccggccccaucacgacccucugggagggcucccccgggaaguucuggaacaccaccaucgccgugagcauggcgaacaucuuccgcggcuccuaccuggccggggccggccuggccuucagcaucaugaaguccgucgggacgggcaagcggggcaccgggagccagggcgagacccucggggagaaguggaagaagaagcugaaccagcugucccgcaaggaguucgaccucuacaagaaguccggcaucaccgagguggaccggaccgaggccaaggaggggcugaagcgcggcgagaucacgcaccacgcggugagccggggcuccgccaagcugcagugguucgucgagcgcaacauggugaucccggaggggcgggugaucgaccucggcugcgggcgcggcggguggagcuacuacugcgccggccugaagaaggucaccgaggugcggggcuacaccaagggcgggcccgggcacgaggagcccgugcccauguccaccuacggcuggaacaucgucaagcugaugagcgggaaggacguguucuaccucccgcccgagaagugcgacacgcugcugugcgacaucggcgaguccagccccucccccaccguggaggagagccgcaccauccgcguccugaagaugguggagccguggcucaagaacaaccaguucugcaucaaggugcugaaccccuacaugcccaccgucaucgagcaccuggagcggcuccagcgcaagcacggcgggaugcuggugcggaacccccugucccgcaacagcacgcacgagauguacuggaucuccaacggcaccgggaacaucguggccagcgucaacauggugucccggcuccugcugaaccgcuucaccaugacccaccggcgcccgacgaucgagaaggacguggaccucggcgccggcacccggcacgucaacgcggagcccgagacccccaacauggacgugaucggggagcgcaucaagcggaucaaggaggagcacaacagcaccuggcacuacgacgacgagaacccguacaagacgugggccuaccacggcuccuacgaggugaaggccaccgggagcgccuccagcaugaucaacggcgucgugaagcugcugaccaagcccugggacgugguccccauggugacccagauggcgaugacggacaccacccccuucgggcagcagcgcgucuucaaggagaagguggacacccggacgccgcgcuccaugcccggcacccggcgcgugaugggcaucaccgccgaguggcucuggcggacccuggggcgcaacaagaagccccggcugugcacgcgcgaggaguucaccaagaagguccgcaccaacgccgccaugggcgccguguucaccgaggagaaccagugggacagcgcgaaggccgccguggaggacgaggacuucuggaagcucgucgaccgggagcgcgagcugcacaagcuggggaagugcggcagcugcguguacaacaugauggggaagcgggagaagaagcucggcgaguucggcaaggccaaggggucccgcgccaucugguacauguggcugggcgcgcgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgccgacgacacggccgggugggacacccgcaucaccgaggacgaccugcacaacgaggagaagaucacccagcagauggacccggagcaccggcagcucgcgaacgccaucuucaagcugacguaccagaacaaggucgugaaggugcagcgccccacccccaccggcaccgucauggacaucaucagccggaaggaccagcgcggcuccggccaggugggcaccuacgggcugaacacguucaccaacauggaggcccagcucauccggcagauggagggcgagggggugcugagcaaggccgaccuggagaacccccaccucccggagaagaagaucacccaguggcuggagaccaagggcgucgagcgccugaagcggauggccaucuccggcgacgacugcguggugaagcccaucgacgaccgcuucgcgaacgcccuccuggcccugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcccggaucagccagggggcgggcuggucccucaaggagacggccugccugggcaaggccuacgcccagauguggagccugauguacuuccaccgccgcgaccuccggcuggccuccaacgcgaucugcagcgccgugcccgugcacugggucccgaccucccgcaccaccuggagcauccacgcccaccaccaguggaugacgaccgaggacaugcugaccguguggaaccggguguggaucgaggacaaccccuggauggaggacaagacccccgucacgaccugggagaacgugcccuaccucgggaagcgcgaggaccaguggugcggcucccugaucgggcugaccagccgggccaccugggcccagaacaucccgacggcgauccagcagguccgcagccucaucggcaacgaggaguuccuggacuacaugcccuccaugaagcgguuccgcaaggaggaggagagcgagggggccaucugguga

SEQ ID NO: 10220 - RNA, 9873 nt, Artificial Sequence
  derived and/or modified CDS sequence (opt1) from DENV-3__FJ639746__SS-prME
accagccugugccucaugaugauccugcccgccgcccuggcguuccaccucaccagccgggacggcgagccccggaugaucguggggaagaacgagcggggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaaguccgagcacaccggccgggagaucguggaccugaugugccacgccaccuucacgaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucguccccagcaucaaggcgggcaacgacaucgccaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggugaccgagaucgggcggguccccucccaccucgcccaccgcacccggaacgcccuggacaaccuggugaugcuccacaccagcgagcacggcgggaaggccuaccgccacgcgguggaggagcugcccgagacgauggagacccugcuccugcugggccucaugauccugcugaccgggggcgccaugcuguuccugaucagcggcaaggggaucggcaagaccuccaucgggcugaucugcgucaucgccagcuccggcaugcucuggauggccgagaucccgcugcaguggaucgccagcgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccaccaagcgcgaccugggcauguccaaggagccggggguggucagccccacguccuaccuggacguggaccuccaccccgccagcgccuggacccuguacgccguggcgaccaccgucaucacgcccaugcugcggcacaccaucgagaacuccaccgccaacgugagccucgccgccaucgccaaccaggcggugguccugaugggccuggacaagggguggccgaucuccaagauggaccucggcgugccccugcuggcccucgggugcuacagccaggugaacccccugacccugacggccgccguccuccugcugaucacccacuacgccaucaucggccccggccuccaggcgaaggccacccgcgaggcccagaagcggaccgccgccgggaucaugaagaacccgacgguggacggcaucaugaccaucgaccuggaccccgugaucuacgacuccaaguucgagaagcagcuggggcaggucaugcuccuggugcugugcgcggugcagcuccugcugaugcgcaccagcugggcccucugcgaggcccugacccuggccacgggccccaucaccacccucugggagggcucccccgggaaguucuggaacaccacgaucgcggucagcauggccaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggaguucgaccucuacaagaaguccggcaucaccgagguggaccgcacggaggcgaaggaggggcugaagcggggcgagaucacccaccacgccgucagccgcggcuccgccaagcugcagugguucguggagcggaacauggugaucccggaggggcgcgucaucgaccucggcugcgggcggggcggguggagcuacuacugcgccggccugaagaaggugaccgaggugcgcggcuacaccaagggcgggcccgggcacgaggagcccguccccauguccacguacggcuggaacaucgugaagcugaugagcgggaaggacguguucuaccucccgcccgagaagugcgacacccugcugugcgacaucggcgaguccagccccucccccaccgucgaggagagccggaccauccgcgugcugaagaugguggagccguggcucaagaacaaccaguucugcaucaagguccugaaccccuacaugcccacggugguggagcaccuggagcgccuccagcggaagcacggcgggaugcugguccgcaacccccugucccggaacagcacccacgagauguacuggaucuccaacggcaccgggaacaucguggccagcgugaacauggucucccgccuccugcugaaccgguucaccaugacgcaccgccggccgaccaucgagaaggacguggaccucggcgcgggcacccgccacgugaacgccgagcccgagacccccaacauggacgucaucggggagcggaucaagcgcaucaaggaggagcacaacagcacguggcacuacgacgacgagaacccguacaagaccugggccuaccacggcuccuacgaggugaaggccaccgggagcgccuccagcaugaucaacggcgucgugaagcugcugaccaagcccugggacgugguccccauggugacgcagauggcgaugaccgacaccacccccuucgggcagcagcggguguucaaggagaaggucgacacgcgcaccccgcggagcaugcccggcacccgccgggugaugggcaucaccgccgaguggcucuggcgcacgcuggggcggaacaagaagccccgccugugcacccgggaggaguucaccaagaaggugcgcaccaacgccgccaugggcgcggucuucacggaggagaaccagugggacuccgccaaggccgccguggaggacgaggacuucuggaagcucguggaccgcgagcgggagcugcacaagcuggggaagugcggcagcugcgucuacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgccgacgacaccgcggggugggacacccggaucaccgaggacgaccugcacaacgaggagaagaucacgcagcagauggacccggagcaccgccagcucgccaacgccaucuucaagcugaccuaccagaacaagguggucaaggugcagcggcccacccccaccggcaccgugauggacaucaucagccgcaaggaccagcggggcuccgggcaggucggcacguacgggcugaacaccuucaccaacauggaggcccagcucauccgccagauggagggcgagggggugcugagcaaggccgaccuggagaacccccggcucccggagaagaagaucacccaguggcuggagacgaagggcguggagcgccugaagcggauggcgaucuccggcgacgacugcgucgugaagcccaucgacgaccgcuucgccaacgcccuccuggcccugaacgacauggggaaggugcggaaggacaucccccaguggcagcccagcaagggcuggcacgacuggcagcaggucccguucugcucccaccacuuccacgagcucaucaugaaggacgggcgcaagcugguggugcccugccggccccaggacgagcugaucggccgcgcccggaucagccagggggcgggcuggucccuccgcgagaccgccugccugggcaaggccuacgcccagauguggagccugauguacuuccaccgccgggaccuccgccuggcguccaacgccaucugcagcgccguccccgugcacugggugccgaccucccggaccacguggagcauccacgcccaccaccaguggaugaccaccgaggacaugcugaccgucuggaaccgcguguggaucgaggacaaccccuggauggaggacaagacgcccaucaccaccugggagaacgugcccuaccucgggaagcgggaggaccaguggugcggcagccugaucgggcugaccucccgcgccacgugggcgcagaacaucccgaccgccauccagcagguccggagccucaucggcaacgaggaguuccuggacuacaugcccuccaugaagcgcuuccggaaggaggaggagagcgagggggccaucugguga

SEQ ID NO: 10221 - RNA, 9873 nt, Artificial Sequence
  derived and/or modified CDS sequence (opt1) from DENV-3__FJ639750__SS-prME
accagccugugccucaugaugauccugcccgccgcccuggcguuccaccucaccagccgggacggggagccccggaugaucguggggaagaacgagcggggcaagagccugcuguucaagacggccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaaguccgagcacaccggccgggagaucguggaccugaugugccacgccaccuucacgaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucguccccagcaucaaggcgggcaacgacaucgccaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggugaccgagaucgggcggguccccucccaccucgcccaccgcacccggaacgcccuggacaaccuggugaugcuccacaccagcgagcacggcgggaaggccuaccgccacgcgguggaggagcugcccgagacgauggagacccugcuccugcugggccucaugauccugcugaccgggggcgccaugcuguuccugaucagcggcaaggggaucggcaagaccuccaucgggcugaucugcgucaucgccagcuccggcaugcucuggauggccgagaucccgcugcaguggaucgccagcgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccaccaagcgcgaccugggcauguccaaggagccggggguggucagccccacguccuaccuggacguggaccuccaccccgccagcgccuggacccuguacgccguggcgaccaccgucaucacgcccaugcugcggcacaccaucgagaacuccaccgccaacgugagccucgccgccaucgccaaccaggcggugguccugaugggccuggacaagggguggccgaucuccaagauggaccucggcgugccccugcuggcccucgggugcuacagccaggugaacccccugacccugacggccgccguccuccugcugaucacccacuacgccaucaucggccccggccuccaggcgaaggccacccgcgaggcccagaagcggaccgccgccgggaucaugaagaacccgacgguggacggcaucaugaccaucgaccuggaccccgugaucuacgacuccaaguucgagaagcagcuggggcaggucaugcuccuggugcugugcgcggugcagcuccugcugaugcgcaccagcugggcccucugcgaggcccugacccuggccacgggccccaucaccacccucugggagggcucccccgggaaguucuggaacaccacgaucgcggucagcauggccaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggaguucgaccucuacaagaaguccggcaucaccgagguggaccgcacggaggcgaaggaggggcugaagcggggcgagaucacccaccacgccgucagccgcggcuccgccaagcugcagugguucguggagcggaacauggugaucccggaggggcgcgucaucgaccucggcugcgggcggggcggguggagcuacuacugcgccggccugaagaaggugaccgaggugcgcggcuacaccaagggcgggcccgggcacgaggagcccguccccauguccacguacggcuggaacaucgugaagcugaugagcgggaaggacguguucuaccucccgcccgagaagugcgacacccugcugugcgacaucggcgaguccagccccucccccaccgucgaggagagccggaccauccgcgugcugaagaugguggagccguggcucaagaacaaccaguucugcaucaagguccugaaccccuacaugcccacggugaucgagcaccuggagcgccuccagcggaagcacggcgggaugcuggugcgcaacccccugucccggaacagcacccacgagauguacuggaucuccaacggcaccgggaacaucgucgccagcgugaacauggugucccgccuccugcugaaccgguucaccaugacgcaccgccggccgaccaucgagaaggacgucgaccucggcgcgggcacccgccacgugaacgccgagcccgagacccccaacauggacgugaucggggagcggaucaagcgcaucaaggaggagcacaacagcacguggcacuacgacgacgagaacccguacaagaccugggccuaccacggcuccuacgaggucaaggccaccgggagcgccuccagcaugaucaacggcguggucaagcugcugaccaagcccugggacguggugcccauggucacgcagauggcgaugaccgacaccacccccuucgggcagcagcggguguucaaggagaagguggacacgcgcaccccgcggagcaugcccggcacccgccgggucaugggcaucaccgccgaguggcucuggcgcacgcuggggcggaacaagaagccccgccugugcacccgggaggaguucaccaagaaggugcgcaccaacgccgccaugggcgcgguguucacggaggagaaccagugggacuccgccaaggccgccgucgaggacgaggacuucuggaagcucguggaccgcgagcgggagcugcacaagcuggggaagugcggcagcugcguguacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcgucgagggggagggccugcacaagcucggcuacauccugcgcgacaucuccaagauccccgggggcgccauguacgccgacgacaccgcggggugggacacccggaucaccgaggacgaccugcacaacgaggagaagaucacgcagcagauggacccggagcaccgccagcucgccaacgccaucuucaagcugaccuaccagaacaagguggugaagguccagcggcccacccccaccggcaccgugauggacaucaucagccgcaaggaccagcggggcuccggccaggugggcacguacgggcugaacaccuucaccaacauggaggcccagcucauccgccagauggagggcgaggggguccugagcaaggccgaccuggagaacccccaccucccggagaagaagaucacccaguggcuggagacgaagggcguggagcggcugaagcgcauggcgaucuccggcgacgacugcguggucaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcuggucgugcccugccgcccccaggacgagcugaucggccgggcccgcaucagccagggggcgggcuggucccuccgggagaccgccugccugggcaaggccuacgcccagauguggagccugauguacuuccaccgccgcgaccuccggcuggcguccaacgccaucugcagcgccgugcccguccacugggugccgaccucccgcaccacguggagcauccacgcccaccaccaguggaugaccaccgaggacaugcugaccguguggaaccgggucuggaucgaggacaaccccuggauggaggacaagacgcccgugaccaccugggagaacgugcccuaccucgggaagcgcgaggaccaguggugcggcagccugaucgggcugaccucccgggccacgugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10222 - RNA, 9873 nt, Artificial Sequence
  derived and/or modified CDS sequence (opt1) from DENV-3__FJ639754__SS-prME
accagccugugccucaugaugauccugcccgccgcccuggcguuccaccucaccagccgggacggggagccccggaugaucguggggaagaacgagcggggcaagagccugcuguucaagacggccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcggagcgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaaguccgagcacaccggccgggagaucguggaccugaugugccacgccaccuucacgaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucguccccagcaucaaggcgggcaacgacaucgccaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggugaccgagaucgggcggguccccucccaccucgcccaccgcacccggaacgcccuggacaaccuggugaugcuccacaccagcgagcacggcgggaaggccuaccgccacgcgguggaggagcugcccgagacgauggagacccugcuccugcugggccucaugauccugcugaccgggggcgccaugcuguuccugaucagcggcaaggggaucggcaagaccuccaucgggcugaucugcgucaucgccagcuccggcaugcucuggauggccgagaucccgcugcaguggaucgccagcgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccaccaagcgcgaccugggcauguccaaggagccggggguggucagccccacguccuaccuggacguggaccuccaccccgccagcgccuggacccuguacgccguggcgaccaccgucaucacgcccaugcugcggcacaccaucgagaacuccaccgccaacgugagccucgccgccaucgccaaccaggcggugguccugaugggccuggacaagggguggccgaucuccaagauggaccucggcgugccccugcuggcccucgggugcuacagccaggugaacccccugacccugacggccgccguccuccugcugaucacccacuacgccaucaucggccccggccuccaggcgaaggccacccgcgaggcccagaagcggaccgccgccgggaucaugaagaacccgacgguggacggcaucaugaccaucgaccuggaccccgugaucuacgacuccaaguucgagaagcagcuggggcaggucaugcuccuggugcugugcgcggugcagcuccugcugaugcgcaccagcugggcccucugcgaggcccugacccuggccacgggccccaucaccacccucugggagggcucccccgggaaguucuggaacaccacgaucgcggucagcauggccaacaucuuccggggcaacuaccuggccggggccggccuggccuucuccaucaugaaguccguggggaccggcaagcgcggcaccgggucccagggcgagacccucggggagaaguggaagaagaagcugaaccagcugagccggaaggaguucgaccucuacaagaaguccggcaucaccgagguggaccgcacggaggcgaaggaggggcugaagcggggcgagaucacccaccacgccgucucccgcggcagcgccaagcugcagugguucguggagcggaacauggugaucccggaggggcgcgucaucgaccucggcugcgggcggggcgggugguccuacuacugcgccggccugaagaaggugaccgaggugcgcggcuacaccaagggcgggcccgggcacgaggagcccguccccaugagcacguacggcuggaacaucgugaagcugauguccgggaaggacguguucuaccucccgcccgagaagugcgacacccugcugugcgacaucggcgagagcucccccagccccaccgucgaggagucccggaccauccgcgugcugaagaugguggagccguggcucaagaacaaccaguucugcaucaagguccugaaccccuacaugcccacggugaucgagcaccuggagcgccuccagcggaagcacggcgggaugcuggugcgcaacccccugagccggaacuccacccacgagauguacuggaucagcaacggcaccgggaacaucgucgccuccgugaacauggugagccgccuccugcugaaccgguucaccaugacgcaccgccggccgaccaucgagaaggacgucgaccucggcgcgggcacccgccacgugaacgccgagcccgagacccccaacauggacgugaucggggagcggaucaagcgcaucaaggaggagcacaacuccacguggcacuacgacgacgagaacccguacaagaccugggccuaccacggcagcuacgaggucaaggccaccggguccgccagcuccaugaucaacggcguggucaagcugcugaccaagcccugggacguggugcccauggucacgcagauggcgaugaccgacaccacccccuucgggcagcagcggguguucaaggagaagguggacacgcgcaccccgcggagcaugcccggcacccgccgggucaugggcaucaccgccgaguggcucuggcgcacgcuggggcggaacaagaagccccgccugugcacccgggaggaguucaccaagaaggugcgcaccaacgccgccaugggcgcgguguucacggaggagaaccagugggacagcgccaaggccgccgucgaggacgaggacuucuggaagcucguggaccgcgagcgggagcugcacaagcuggggaagugcggcuccugcguguacaacaugauggggaagcgcgagaagaagcucggcgaguucggcaaggccaaggggagccgggcgaucugguacauguggcugggcgcccgcuaccuggaguucgaggcccucggguuccugaacgaggaccacugguucucccgggagaacagcuacuccggcgucgagggggagggccugcacaagcucggcuacauccugcgcgacaucagcaagauccccgggggcgccauguacgccgacgacaccgcggggugggacacccggaucaccgaggacgaccugcacaacgaggagaagaucacgcagcagauggacccggagcaccgccagcucgccaacgccaucuucaagcugaccuaccagaacaagguggugaagguccagcggcccacccccaccggcaccgugauggacaucaucucccgcaaggaccagcggggcagcggccaggugggcacguacgggcugaacaccuucaccaacauggaggcccagcucauccgccagauggagggcgaggggguccuguccaaggccgaccuggagaacccccaccucccggagaagaagaucacccaguggcuggagacgaagggcguggagcggcugaagcgcauggcgaucagcggcgacgacugcguggucaagcccaucgacgaccgguucgccaacgcccuccuggcccugaacgacauggggaaggugcgcaaggacaucccccaguggcagcccuccaagggcuggcacgacuggcagcaggucccguucugcagccaccacuuccacgagcucaucaugaaggacgggcggaagcuggucgugcccugccgcccccaggacgagcugaucggccgggcccgcaucucccagggggcgggcuggagccuccgggagaccgccugccugggcaaggccuacgcccagauguggucccugauguacuuccaccgccgcgaccuccggcuggcgagcaacgccaucugcuccgccgugcccguccacugggugccgaccagccgcaccacgugguccauccacgcccaccaccaguggaugaccaccgaggacaugcugaccguguggaaccgggucuggaucgaggacaaccccuggauggaggacaagacgcccgugaccaccugggagaacgugcccuaccucgggaagcgcgaggaccaguggugcggcagccugaucgggcugaccagccgggccacgugggcgcagaacaucccgaccgccauccagcagguccgcucccucaucggcaacgaggaguuccuggacuacaugcccagcaugaagcgguuccgcaaggaggaggaguccgagggggccaucugguga

SEQ ID NO: 10223 - RNA, 9873 nt, Artificial Sequence
  derived and/or modified CDS sequence (opt1) from DENV-3__FJ639757__SS-prME
accagccugugccucaugaugauccugcccgccgcccuggcguuccaccucaccucccgggacggggagccgcggaugaucguggggaagaacgagcggggcaagagccugcuguucaagaccgccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacuccgcccugaagaucaacugguacaagaagggcagcuccaucgggaagauguucgaggcgaccgcccggggcgcccgccggauggccauccugggcgacaccgccugggacuucgggagcgugggcgggguccucaacucccugggcaagauggugcaccagaucuucgggagcgcguacacggcccuguucuccggcgugagcugggucaugaagaucggcaucggggugcuccugaccuggaucggccugaacuccaagaacaccagcauguccuucagcugcaucgccaucgggaucaucacccucuaccugggcgccgugguccaggccgacauggggugcgugaucaacuggaagggcaaggagcugaagugcggcuccgggaucuucgugacgaacgagguccacaccuggaccgagcaguacaaguuccaggcggacagccccaagcgccucgccaccgccaucgccggcgccugggagaacggggugugcggcauccgcuccacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacagcuggaagaccugggggaaggccaagaucgucaccgccgagacccagaacuccagcuucaucaucgacggccccaacacgcccgagugccccuccgccagccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagucccagaagaacgggagcuggaagcuggagaaggcgucccugaucgaggugaagaccugcacguggcccaagucccacacccucugguccaacggcgugcuggagagcgacaugaucauccccaagucccuggccgggcccaucagccagcacaacuaccggccgggcuaccacacccagaccgccgggcccuggcaccucggcaagcuggagcuggacuucaacuacugcgagggcacgaccgucgugaucaccgagaacugcgggacccgcggccccucccuccggacgaccaccgugagcgggaagcugauccacgaguggugcugccgcuccugcacccugcccccgcuccgguacaugggcgaggacgggugcugguacggcauggagauccgccccaucagcgagaaggaggagaacauggucaagucccuggugagcgccggcuccggggagguggacaacuucacgaugggcguccugugccucgccauccuguucgaggaggugaugcgggggaaguucggcaagaagcacaugaucgcggggguguucuucaccuucguccugcuccugagcggccagaucaccuggcgcgacauggcccacacccugaucaugaucggcuccaacgccagcgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucucccucacgugcagcaacaccaucuucacccugaccgucgccuggcgcacggccacccugauccucgcgggggugucccugcugccggucugccagagcuccagcaugcggaagaccgacuggcuccccaugaccguggccgccaugggcgugccgccccucccgcuguucaucuucucccucaaggacacgcugaagcgccgcagcuggccccugaacgagggggucauggccgugggccucguguccauccuggccagcucccugcuccggaacgacguccccauggcgggcccccugguggccgggggccugcucaucgccugcuacgugaucaccgggaccagcgccgaccugaccgucgagaaggccgcggacgugacgugggaggaggaggccgagcagaccggcgugucccacaaccugaugaucaccgucgacgacgacgggaccaugcgcaucaaggacgacgagaccgagaacauccucacggugcugcugaagaccgcccuccugaucgugagcggcaucuucccguacuccauccccgccacccugcucgucuggcacaccuggcagaagcagacgcagcggagcggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccagcgugaagaaggaccugaucuccuacggcgggggcuggcggcucagcgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcucccccaucaucaaccgcgagggcaagguggucgggcuguacggcaacgggguggugacgaagaacggcggguacgucagcggcaucgcccagaccaacgccgagccggacggccccacccccgagcuggaggaggagauguucaagaagcggaaccucaccaucauggaccugcaccccggguccggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaagagcgagcacaccggccgggagaucguggaccugaugugccacgccaccuucacgaugcgccuccugucccccgugcgggucccgaacuacaaccugaucaucauggacgaggcccacuucaccgaccccgccagcaucgccgcgcgcggguacaucuccacccgggugggcaugggcgaggccgccgccaucuucaugaccgcgacgccgcccgggaccgccgacgccuucccgcagagcaacgcccccauccaggacgaggagcgcgacauccccgagcgcuccuggaacagcggcaacgaguggaucaccgacuucgccgggaagaccgugugguucguccccuccaucaaggcgggcaacgacaucgccaacugccuccggaagaacgggaagaaggugauccagcugagccgcaagacguucgacaccgaguaccagaagaccaagcugaacgacugggacuucguggucaccacggacaucuccgagaugggcgccaacuucaaggccgaccgggugaucgacccgcgccggugccucaagcccgugauccugaccgacggccccgagcgcgucauccuggccgggcccaugccggugaccgcggccagcgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagagccggaagaccuucgucgagcugaugcgccgcggggaccuccccguguggcuggcgcacaaggucgccuccgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacagcgacccgcuggcccucaaggaguucaaggacuucgccgcgggccgcaaguccaucgcccuggaccuggugaccgagaucgggcggguccccacccaccucgcccaccgcacccggaacgcccuggacaaccuggugaugcuccacacgagcgagcacggcgggaaggccuaccgccacgcgguggaggagcugcccgagaccauggagacccugcuccugcugggccucaugauccugcugaccgggggcgccaugcuguuccugaucagcggcaaggggaucggcaagacguccaucgggcugaucugcgucaucgccagcuccggcaugcucuggauggccgagaucccgcugcaguggaucgccagcgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccacgaagcgcgaccugggcauguccaaggagccggggguggucagccccaccuccuaccuggacguggaccuccaccccgccagcgccuggacccuguacgccguggcgaccacggucaucacccccaugcugcggcacaccaucgagaacuccaccgccaacgugagccucgccgccaucgccaaccaggcggugguccugaugggccuggacaagggguggccgaucuccaagauggaccucggcgugccccugcuggcccucgggugcuacagccaggugaacccccugacgcugaccgccgccguccuccugcugaucacccacuacgccaucaucggccccggccuccaggcgaaggccacccgcgaggcccagaagcggacggccgccgggaucaugaagaacccgaccguggacggcaucaugaccaucgaccuggaccccgugaucuacgacuccaaguucgagaagcagcuggggcaggucaugcuccuggugcugugcgcggugcagcuccugcugaugcgcaccagcugggcccucugcgaggcccugacgcuggccaccggccccaucaccacccucugggagggcucccccgggaaguucuggaacacgaccaucgcggucagcauggccaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggaguucgaccucuacaagaaguccggcaucacggagguggaccgcaccgaggcgaaggaggggcugaagcggggcgagaucacccaccacgccgucagccgcggcuccgccaagcugcagugguucguggagcggaacauggugaucccggaggggcgcgucaucgaccucggcugcgggcggggcggguggagcuacuacugcgccggccugaagaaggugaccgaggugcgcggcuacacgaagggcgggcccgggcacgaggagcccguccccauguccaccuacggcuggaacaucgugaagcugaugagcgggaaggacguguucuaccucccgcccgagaagugcgacacccugcugugcgacaucggcgaguccagccccucccccaccgucgaggagagccggacgauccgcgugcugaagaugguggagccguggcucaagaacaaccaguucugcaucaagguccugaaccccuacaugcccaccgugaucgagcaccuggagcgccuccagcggaagcacggcgggaugcuggugcgcaacccccugucccggaacagcacccacgagauguacuggaucuccaacggcaccgggaacaucgucgccagcgugaacauggugucccgccuccugcugaaccgguucacgaugacccaccgccggccgaccaucgagaaggacgucgaccucggcgcgggcacccgccacgugaacgccgagcccgagacgcccaacauggacgugaucggggagcggaucaagcgcaucaaggaggagcacaacagcaccuggcacuacgacgacgagaacccguacaagaccugggccuaccacggcuccuacgaggucaaggccaccgggagcgccuccagcaugaucaacggcguggucaagcugcugacgaagcccugggacguggugcccauggucacccagauggcgaugaccgacaccacgcccuucgggcagcagcggguguucaaggagaagguggacacccgcaccccgcggagcaugcccggcacccgccgggucaugggcaucacggccgaguggcucuggcgcacccuggggcggaacaagaagccccgccugugcacccgggaggaguucaccaagaaggugcgcacgaacgccgccaugggcgcgguguucaccgaggagaaccagugggacuccgccaaggccgccgucgaggacgaggacuucuggaagcucguggaccgcgagcgggagcugcacaagcuggggaagugcggcagcugcguguacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcgucgagggggagggccugcacaagcucggcuacauccugcgcgacaucuccaagauccccgggggcgccauguacgccgacgacaccgcggggugggacacccggaucacggaggacgaccugcacaacgaggagaagaucacccagcagauggacccggagcaccgccagcucgccaacgccaucuucaagcugaccuaccagaacaagguggugaagguccagcggcccacccccaccggcacggugauggacaucaucagccgcaaggaccagcggggcuccggccaggugggcaccuacgggcugaacaccuucaccaacauggaggcccagcucauccgccagauggagggcgaggggguccugagcaaggccgaccuggagaacccccaccucccggagaagaagaucacgcaguggcuggagaccaagggcguggagcggcugaagcgcauggcgaucuccggcgacgacugcguggucaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcuggucgugcccugccgcccccaggacgagcugaucggccgggcccgcaucagccagggggcgggcuggucccuccgggagaccgccugccugggcaaggccuacgcccagauguggagccugauguacuuccaccgccgcgaccuccggcuggcguccaacgccaucugcagcgccgugcccguccacugggugccgaccucccgcacgaccuggagcauccacgcccaccaccaguggaugaccaccgaggacaugcugacgguguggaaccgggucuggaucgaggacaaccccuggauggaggacaagacccccgugaccaccugggagaacgugcccuaccucgggaagcgcgaggaccaguggugcggcagccugaucgggcugacgucccgggccaccugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10224 - RNA, 9873 nt, Artificial Sequence
  derived and/or modified CDS sequence (opt1) from DENV-3__FJ639758__SS-prME
accagccugugccucaugaugauccugcccgccgcccuggcguuccaccucaccagccgggacggggagccccggaugaucguggggaagaacgagcgcggcaagagccugcuguucaagacggccuccgggaucaacaugugcacccucaucgccauggaccugggggagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacgugaucggcguccucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgccucccgggcguggaacgugugggaggucgaggacuacggguucggcguguucaccaccaacaucuggcucaagcugcgcgagguguacacccagcugugcgaccaccggcucaugagcgccgccgucaaggacgagcgcgccgugcacgccgacaugggcuacuggaucgagagccagaagaacggguccuggaagcuggagaaggcgagccugaucgaggugaagaccugcacguggccgaagucccacacccucuggagcaacggcguccuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggaggucgacaacuucacgaugggcgugcugugccucgccauccuguucgaggaggugaugcgggggaaguucggcaagaagcacaugaucgcgggggucuucuucaccuucgugcugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgucggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccguggccuggcgcacggccacccugauccucgcgggggucagccugcugccggugugccaguccagcuccaugcggaagaccgacuggcuccccaugaccguggccgccaugggcgugccgccccucccgcuguucaucuucagccucaaggacacgcugaagcgccgcuccuggccccugaacgagggggugauggccgugggccucgucagcauccuggccuccagccugcuccggaacgacgugcccauggcgggcccccugguggccgggggccugcucaucgccugcuacgucaucaccgggaccuccgccgaccugaccguggagaaggccgcggacgugacgugggaggaggaggccgagcagaccggcgucagccacaaccugaugaucaccguggacgacgacgggaccaugcgcaucaaggacgacgagaccgagaacauccucacggugcugcugaagaccgcccuccugaucgucuccggcaucuucccguacagcauccccgccacccugcucguguggcacaccuggcagaagcagacgcagcgguccggcgugcugugggacguccccagcccgcccgagacccagaaggccgagcuggaggaggggguguaccgcaucaagcagcagggcaucuucgggaagacccaggugggcgucggggugcagaaggagggcguguuccacaccauguggcacgucacgcggggcgcggugcucaccuacaacgggaagcgccuggagcccaacugggccuccgugaagaaggaccugaucagcuacggcgggggcuggcggcucuccgcccaguggcagaagggggaggagguccaggugaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaaggucguggggcuguacggcaacgggguggucacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccgggucguggccgccgagauggaggaggcccucaaggggcugcccauccgcuaccagaccacggcgaccaaguccgagcacaccggccgggagaucguggaccugaugugccacgccaccuucacgaugcgccuccugagccccguccgggugccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgucugguucgugcccagcaucaaggcgggcaacgacaucgccaacugccuccggaagaacgggaagaaggugauccagcugucccgcaagacguucgacaccgaguaccagaagaccaagcugaacgacugggacuucgucgugaccacggacaucagcgagaugggcgccaacuucaaggccgaccgggugaucgacccgcgccggugccucaagcccgucauccugaccgacggccccgagcgcgugauccuggccgggcccaugccggugaccgcggccuccgccgcccagcggcgcggccgggucgggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcgcacaagguggccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggucaccgagaucgggcgggugcccucccaccucgcccaccgcacccggaacgcccuggacaaccuggugaugcuccacaccagcgagcacggcgggaaggccuaccgccacgcggucgaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucgugcuggaguucuucaugaugguccuccugauccccgagcccgagaagcagcggacgccccaggacaaccagcuggccuacguggugaucgggauccucacccuggccgccaucaucgccgcgaacgagaugggccugcucgagaccaccaagcgcgaccugggcauguccaaggagccgggggucgugagccccacguccuaccuggacguggaccuccaccccgccagcgccuggacccuguacgccgucgcgaccaccgugaucacgcccaugcugcggcacaccaucgagaacuccaccgccaacgugagccucgccgccaucgccaaccaggcggucgugcugaugggccuggacaagggguggccgaucuccaagauggaccucggcgugccccugcuggcccucgggugcuacagccaggucaacccccugacccugacggccgccgugcuccugcugaucacccacuacgccaucaucggccccggccuccaggcgaaggccacccgcgaggcccagaagcggaccgccgccgggaucaugaagaacccgacgguggacggcaucaugaccaucgaccuggaccccgucaucuacgacuccaaguucgagaagcagcugggccaggugaugcuccuggugcugugcgcgguccagcuccugcugaugcgcaccagcugggcccucugcgaggcccugacccuggccacgggccccaucaccacccucugggagggcucccccgggaaguucuggaacaccacgaucgcggugagcauggccaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggaguucgaccucuacaagaaguccggcaucaccgaggucgaccgcacggaggcgaaggaggggcugaagcggggcgagaucacccaccacgccgugagccgcggcuccgccaagcugcagugguucguggagcggaacauggucaucccggaggggcgcgugaucgaccucggcugcgggcggggcggguggagcuacuacugcgccggccugaagaaggugaccgagguccgcggcuacaccaagggcgggcccgggcacgaggagcccgugcccauguccacguacggcuggaacaucgugaagcugaugagcgggaaggacgucuucuaccucccgcccgagaagugcgacacccugcugugcgacaucggcgaguccagccccucccccaccguggaggagagccggaccauccgcgugcugaagauggucgagccguggcucaagaacaaccaguucugcaucaaggugcugaaccccuacaugcccacgguggucgagcaccuggagcgccuccagcggaagcacggcgggaugcuggugcgcaacccccugucccggaacagcacccacgagauguacuggaucuccaacggcaccgggaacaucguggccagcgucaacauggugucccgccuccugcugaaccgguucaccaugacgcaccgccggccgaccaucgagaaggacguggaccucggcgcgggcacccgccacgucaacgccgagcccgagacccccaacauggacgugaucggggagcggaucaagcgcaucaaggaggagcacaacagcacguggcacuacgacgacgagaacccguacaagaccugggccuaccacggcuccuacgaggucaaggccaccgggagcgccuccagcaugaucaacggcguggugaagcugcugaccaagcccugggacgucgugcccauggugacgcagauggcgaugaccgacaccacccccuucgggcagcagcgggucuucaaggagaagguggacacgcgcaccccgcggagcaugcccggcacccgccgggugaugggcaucaccgccgaguggcucuggcgcacgcuggggcggaacaagaagccccgccugugcacccgggaggaguucaccaagaagguccgcaccaacgccgccaugggcgcgguguucacggaggagaaccagugggacuccgccaaggccgccguggaggacgaggacuucuggaagcucgucgaccgcgagcgggagcugcacaagcuggggcgcugcggcagcugcguguacaacaugauggggaagcgggagaagaagcucggcgaguucggcaaggccaaggggucccgcgcgaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgccgacgacaccgcggggugggacacccgcaucaccgaggacgaccugcacaacgaggagaagaucacgcagcagauggacccggagcaccggcagcucgccaacgccaucuucaagcugaccuaccagaacaaggucgugaaggugcagcgccccacccccaccggcaccgucauggacaucaucagccggaaggaccagcgcggcuccggccaggugggcacguacgggcugaacaccuucaccaacauggaggcccagcucauccggcagauggagggcgagggggugcugagcaaggccgaccuggagaacccccgccucccggagaagaagaucacccaguggcuggagacgaagggcgucgagcggcugaagcgcauggcgaucuccggcgacgacugcguggugaagcccaucgacgaccgguucgccaacgcccuccuggcccugaacgacauggggaagguccgcaaggacaucccccaguggcagcccagcaagggcuggcacgacuggcagcaggucccguucugcucccaccacuuccacgagcucaucaugaaggacgggcggaagcuggugguccccugccgcccccaggacgagcugaucggccgggcccgcaucagccagggggcgggcuggucccuccgcgagaccgccugccugggcaaggccuacgcccagauguggagccugauguacuuccaccggcgcgaccuccggcuggcguccaacgccaucugcagcgccgugcccgugcacugggucccgaccucccgcaccacguggagcauccacgcccaccaccaguggaugaccaccgaggacaugcugaccguguggaaccggguguggaucgaggacaaccccuggauggaggacaagacgcccgucaccaccugggagaacgugcccuaccucgggaagcgcgaggaccaguggugcggcagccugaucgggcugaccucccgggccacgugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10225 - RNA, 9873 nt, Artificial Sequence
  derived and/or modified CDS sequence (opt1) from DENV-3__FJ639759__SS-prME
accagccugugccucaugaugauccugcccgccgcccuggcguuccaccucaccucccgggacggggagccccggaugaucguggggaagaacgagcggggcaagagccugcuguucaagaccgccuccgggaucaacaugugcacccucaucgccauggaccugggggagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaccaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagacgugcaccuggccgaagucccacacccucuggagcaacggcgugcuggaguccgacaugaucauccccaagagccuggccgggcccaucucccagcacaacuaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcggggagguggacaacuucaccaugggcguccugugccucgccauccuguucgaggaggugaugcgggggaaguucggcaagaagcacaugaucgcgggggugcuguucaccuucguccuccugcuguccggccagaucaccuggcgcgacauggcccacacgcucaucaugaucggcagcaacgccuccgaccggauggggaugggcgugaccuaccuggcccugaucgccaccuucaagauccagcccuuccucgcgcugggguucuuccugcgcaagcucaccagccgggagaaccugcugcucggcgugggccuggccauggccacgacccugcagcuccccgaggacaucgagcagauggccaacgggaucgcgcugggccugauggcccucaagcugaucacccaguucgagaccuaccagcuguggacggcccucaucagccugaccugcuccaacaccaucuucacccugacggucgccuggcgcaccgccacccucauccuggcgggggugagccugcucccggucugccaguccagcuccaugcggaagaccgacuggauccccaugacgguggccgccaugggcgugccgccccucccgcuguucaucuucagccucaaggacacccugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugacggucgagaaggccgcggacgugaccugggaggaggaggccgagcagaccggcgugagccacaaccugaugaucaccgucgacgacgacgggaccaugcgcaucaaggacgacgagacggagaacauccucaccgugcugcugaagaccgcccuccugaucguguccggcaucuucccguacagcauccccgccacccugcucgucuggcacacguggcagaagcagacccagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacacgauguggcacgugacccggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcacguuccagaccaccaccggggagaucggcgcgaucgcccuggacuucaagcccgggacgagcggcagccccaucaucaaccgcgagggcaagaucguggggcuguacggcaacggggucgugaccaagaacggcggguacguguccggcaucgcccagaccaacgccgagccggacggccccacccccgagcuggaggaggagauguucaagaagcggaaccucacgaucauggaccugcaccccgggagcggcaagacccgcaaguaccugccggccaucguccgggaggcgaucaagcgccggcuccgcacccugauccuggcccccacccgggugguggccgccgagauggaggaggcccucaaggggcugcccauccgcuaccagacguccgcgaccaagagcgagcacaccggccgggagaucgucgaccugaugugccacgccaccuucacgaugcgccuccugucccccgugcgggugccgaacuacaaccugaucaucauggacgaggcccacuucaccgaccccgccagcaucgccgcgcgcggguacaucuccacccgggucggcaugggcgaggccgccgccaucuucaugaccgcgacgccgcccgggaccgccgacgccuucccgcagagcaacgcccccauccaggacgaggagcgcgacauccccgagcgcuccuggaacagcggcaacgaguggaucaccgacuucgccgggaagaccgugugguucgugcccuccaucaaggcgggcaacgacaucgccaacugccuccggaagaacgggaagaaggucauccagcugagccgcaagacguucgacaccgaguaccagaagaccaagcugaacgacugggacuucguggugaccacggacaucuccgagaugggcgccaacuucaaggccgaccgggucaucgacccgcgccggugccucaagcccgugauccugaccgacggccccgagcgcgugauccuggccgggcccaugccggucaccgcggccagcgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagagccggaagaccuucguggagcugaugcgccgcggggaccuccccgucuggcuggcgcacaagguggccuccgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcacguacagcgacccgcuggcccucaaggaguucaaggacuucgccgcgggccgcaaguccaucgcccuggaccuggugaccgagaucgggcgggugcccacccaccucgcccaccgcacccggaacgcccuggacaaccuggucaugcuccacacgagcgagcacggcgggaaggccuaccgccacgcgguggaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggccgagaucccgcugcaguggaucgccagcgcgaucguccuggaguucuucaugauggugcuccugauccccgagcccgagaagcagcggacgccccaggacaaccagcuggccuacguggucaucgggauccucacccuggccgccaucaucgccgcgaacgagaugggccugcucgagaccacgaagcgcgaccugggcauguccaaggagccggggguggugagccccaccuccuaccuggacgucgaccuccaccccgccagcgccuggacccuguacgccguggcgaccacggugaucacccccaugcugcggcacaccaucgagaacuccaccgccaacgucagccucgccgccaucgccaaccaggcgguggugcugaugggccuggacaagggguggccgaucuccaagauggaccucggcgucccccugcuggcccucgggugcuacagccaggugaacccccugacgcugaccgccgccgugcuccugcugaucacccacuacgccaucaucggccccggccuccaggcgaaggccacccgcgaggcccagaagcggacggccgccgggaucaugaagaacccgaccgucgacggcaucaugaccaucgaccuggaccccgugaucuacgacuccaaguucgagaagcagcugggccaggugaugcuccugguccugugcgcggugcagcuccugcugaugcgcaccagcugggcccucugcgaggcccugacgcuggccaccggccccaucaccacccucugggagggcucccccgggaaguucuggaacacgaccaucgcggugagcauggccaacaucuuccggggcuccuaccuggccggggccggccuggccuucagcaucaugaaguccgucgggaccggcaagcgcggcaccgggagccagggcgagacccucggggagaaguggaagaagaagcugaaccagcugagccggaaggaguucgaccucuacaagaaguccggcaucacggagguggaccgcaccgaggcgaaggaggggcugaagcggggcgagaucacccaccacgccgugagccgcggcuccgccaagcugcagugguucgucgagcggaacauggugaucccggaggggcgcgugaucgaccucggcugcgggcggggcggguggagcuacuacugcgccggccugaagaaggucaccgaggugcgcggcuacacgaagggcgggcccgggcacgaggagcccgugcccauguccaccuacggcuggaacaucgucaagcugaugagcgggaaggacguguucuaccucccgcccgagaagugcgacacccugcugugcgacaucggcgaguccagccccucccccaccguggaggagagccggacgauccgcguccugaagaugguggagccguggcucaagaacaaccaguucugcaucaaggugcugaaccccuacaugcccaccgucaucgagcaccuggagcgccuccagcggaagcacggcgggaugcuggugcgcaacccccugucccggaacagcacccacgagauguacuggaucuccaacggcaccgggaacaucguggccagcgucaacauggugucccgccuccugcugaaccgguucacgaugacccaccgccggccgaccaucgagaaggacguggaccucggcgcgggcacccgccacgucaacgccgagcccgagacgcccaacauggacgugaucggggagcggaucaagcgcaucaaggaggagcacaacagcaccuggcacuacgacgacgagaacccguacaagaccugggccuaccacggcuccuacgaggugaaggccaccgggagcgccuccagcaugaucaacggcgucgugaagcugcugacgaagcccugggacgucgugcccauggugacccagauggcgaugaccgacaccacgcccuucgggcagcagcgggucuucaaggagaagguggacacccgcaccccgcggagcaugcccggcacccgccgggugaugggcaucacggccgaguggcucuggcgcacccuggggcggaacaagaagccccgccugugcacccgggaggaguucaccaagaagguccgcacgaacgccgccaugggcgcgguguucaccgaggagaaccagugggacuccgccaaggccgccguggaggacgaggacuucuggaagcucgucgaccgcgagcgggagcugcacaagcuggggaagugcggcagcugcguguacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgccgacgacaccgcggggugggacacccggaucacggaggacgaccugcacaacgaggagaagaucacccagcagauggacccggagcaccgccagcucgccaacgccaucuucaagcugaccuaccagaacaaggucgugaaggugcagcggcccacccccaccggcacggucauggacaucaucagccgcaaggaccagcggggcuccggccaggugggcaccuacgggcugaacaccuucaccaacauggaggcccagcucauccgccagauggagggcgagggggugcugagcaaggccgaccuggagaacccccaccucccggagaagaagaucacgcaguggcuggagaccaagggcgucgagcggcugaagcgcauggcgaucuccggcgacgacugcguggugaagcccaucgacgaccgguucgccaacgcccuccuggcccugaacgacauggggaagguccgcaaggacaucccccaguggcagcccagcaagggcuggcacgacuggcagcaggucccguucugcucccaccacuuccacgagcucaucaugaaggacgggcggaagcuggugguccccugccgcccccaggacgagcugaucggccgggcccgcaucagccagggggcgggcuggucccuccgggagaccgccugccugggcaaggccuacgcccagauguggagccugauguacuuccaccgccgcgaccuccggcuggcguccaacgccaucugcagcgccgugcccgugcacugggucccgaccucccgcacgaccuggagcauccacgcccaccaccaguggaugaccaccgaggacaugcugacgguguggaaccggguguggaucgaggacaaccccuggauggaggacaagacccccgucaccaccugggagaacgugcccuaccucgggaagcgcgaggaccaguggugcggcagccugaucgggcugacgucccgggccaccugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10226 - RNA, 9873 nt, Artificial Sequence
  derived and/or modified CDS sequence (opt1) from DENV-3__FJ639761__SS-prME
accagccugugccucaugaugauccugcccgccgcccuggcguuccaccucaccagccgggacggggagccgcggaugaucguggggaagaacgagcggggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcggagcgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccugcagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaaguccgagcacaccggccgggagaucguggaccugaugugccacgccaccuucacgaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucguccccagcaucaaggcgggcaacgacaucgccaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggugaccgagaucgggcggguccccacccaccucgcccaccgcacccggaacgcccuggacaaccuggugaugcuccacacguccgagcacggcgggaaggccuaccgccacgcgguggaggagcugcccgagaccauggagacccugcuccugcugggccucaugauccugcugaccgggggcgucaugcuguuccugaucagcggcaaggggaucggcaagacgagcaucgggcugaucugcgugaucgccuccagcggcaugcucuggauggccgagaucccgcugcaguggaucgccuccgccaucgugcuggaguucuucaugaugguccuccugauccccgagcccgagaagcagcggacgccccaggacaaccagcuggcguacguggugaucgggauccucacccuggccgccaucaucgccgccaacgagaugggccugcucgagaccacgaagcgcgaccugggcaugagcaaggagccgggggucgugucccccaccagcuaccuggacguggaccuccaccccgcguccgccuggacccuguacgccgucgccaccacggugaucacccccaugcugcggcacaccaucgagaacagcaccgcgaacgugucccucgccgccaucgccaaccaggccgucgugcugaugggccuggacaagggguggccgaucagcaagauggaccucggcgugccccugcuggcgcucgggugcuacucccaggucaacccccugacgcugaccgccgccgugcuccugcugaucacccacuacgccaucaucggccccggccuccaggccaaggcgacccgcgaggcccagaagcggacggccgccgggaucaugaagaacccgaccguggacggcaucaugaccaucgaccuggaccccgucaucuacgacagcaaguucgagaagcagcugggccaggugaugcuccuggugcugugcgccguccagcuccugcugaugcgcaccuccugggcgcucugcgaggcccugacgcuggccaccggccccaucaccacccucugggagggcagccccgggaaguucuggaacacgaccaucgccguguccauggcgaacaucuuccggggcagcuaccuggccggggccggccuggccuucuccaucaugaaguccguggggaccggcaagcgcggcaccgggcuccagggcgagacccugggggagaaguggaagaagaagcugaaccagcucucccggaaggaguucgaccuguacaagaaguccggcaucacggaggucgaccgcaccgaggccaaggaggggcugaagcggggcgagaucacccaccacgcggugagccgcggcuccgccaagcuccagugguucguggagcggaacauggucaucccggaggggcgcgugaucgaccugggcugcgggcggggcggguggagcuacuacugcgccggccugaagaaggugaccgagguccgcggcuacacgaagggcgggcccgggcacgaggagcccgugcccauguccaccuacggcuggaacaucgugaagcucaugagcgggaaggacgucuucuaccugccgcccgagaagugcgacacccugcugugcgacaucggcgaguccagccccucccccaccguggaggagagccggacgauccgcgugcucaagauggucgagccguggcugaagaacaaccaguucugcaucaaggugcugaaccccuacaugcccaccgugaucgagcaccucgagcgccugcagcggaagcacggcgggaugcugguccgcaacccccucucccggaacagcacccacgagauguacuggaucuccaacggcaccgggaacaucguggccagcgugaacauggucucccgccugcugcucaaccgguucacgaugacccaccgccggccgaccaucgagaaggacguggaccugggcgccggcacccgccacgugaacgcggagcccgagacgcccaacauggacgucaucggggagcggaucaagcgcaucaaggaggagcacaacagcaccuggcacuacgacgacgagaacccguacaagaccugggccuaccacggcuccuacgaggugaaggccaccgggagcgccuccagcaugaucaacggcgucgugaagcugcucacgaagcccugggacgugguccccauggugacccagauggccaugaccgacaccacgcccuucgggcagcagcggguguucaaggagaaggucgacacccgcaccccgcgguccaugcccggcacccgccgggugaugggcaucacggcggaguggcuguggcgcacccuggggcggaacaagaagccccgccucugcacccgggaggaguucaccaagaaggugcgcacgaacgccgccaugggcgccgucuucaccgaggagaaccagugggacagcgcgaaggccgccguggaggacgaggacuucuggaagcugguggaccgcgagcgggagcugcacaagcucgggaagugcggcagcugcgucuacaacaugauggggaagcgcgagaagaagcugggcgaguucggcaaggccaaggggucccgggccaucugguacauguggcugggcgcgcgcuaccucgaguucgaggcccugggguuccugaacgaggaccacugguucagccgggagaacuccuacagcggcguggagggggagggccuccacaagcugggcuacauccugcgcgacaucuccaagauccccgggggcgccauguacgccgacgacaccgccgggugggacacccggaucacggaggacgaccuccacaacgaggagaagaucacccagcagauggacccggagcaccgccagcuggcgaacgccaucuucaagcugaccuaccagaacaagguggucaaggugcagcggcccacccccaccggcacggugauggacaucaucagccgcaaggaccagcggggcuccgggcaggucggcaccuacgggcucaacaccuucaccaacauggaggcccagcugauccgccagauggagggcgagggggugcugagcaaggccgaccucgagaacccccaccuccccgagaagaagaucacgcaguggcuggagaccaagggcguggagcggcugaagcgcauggccaucuccggcgacgacugcgucgugaagcccaucgacgaccgguucgcgaacgcccugcuggcccucaacgacauggggaaggugcgcaaggacaucccccaguggcagcccagcaagggcuggcacgacuggcagcaggucccguucugcucccaccacuuccacgagcugaucaugaaggacgggcggaagcugguggugcccugccgcccccaggacgagcucaucggccgggcccgcaucagccagggggccggcuggucccugcgggagaccgcgugccugggcaaggccuacgcccagauguggagccucauguacuuccaccgccgcgaccugcggcuggccuccaacgcgaucugcagcgccguccccgugcacugggugccgaccucccgcacgaccuggagcauccacgcccaccaccaguggaugaccaccgaggacaugcucacggucuggaaccggguguggaucgaggacaaccccuggauggaggacaagacccccgugaccaccugggagaacguccccuaccuggggaagcgcgaggaccaguggugcggcucccugaucgggcucacgagccgggccaccugggcccagaacaucccgaccgcgauccagcagguccgcagccugaucggcaacgaggaguuccuggacuacaugcccuccaugaagcgguuccgcaaggaggaggagagcgagggggccaucugguga

SEQ ID NO: 10227 - RNA, 9873 nt, Artificial Sequence
  derived and/or modified CDS sequence (opt1) from DENV-3__FJ639762__SS-prME
accagccugugccucaugaugauccugcccgccgcccuggcguuccaccucaccagccgggacggggagccccggaugaucguggggaagaacgagcgcggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcggagcguggcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagaucgaguacaagggcgaggacgugccgugcaagauccccuucagcaccgaggacgggcagggcaaggcgcacaacggccgccugaucacggccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacaccgccugggacuucggguccgugggcggggugcucaacagccugggcaagaugguccaccagaucuucggguccgcguacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggccgacauggggugcgucaucaacuggaagggcaaggagcugaagugcggcagcgggaucuucgugacgaacgaggugcacaccuggaccgagcaguacaaguuccaggcggacucccccaagcgccucgccaccgccaucgccggcgccugggagaacggggucugcggcauccgcagcacgacccggauggagaaccugcuguggaagcagaucgcgaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgccucccgggcguggaacgucugggagguggaggacuacggguucggcguguucaccaccaacaucuggcucaagcugcgcgaggucuacacccagcugugcgaccaccggcucaugagcgccgccgugaaggacgagcgcgccgugcacgccgacaugggcuacuggaucgagagccagaagaacggguccuggaagcuggagaaggcgagccugaucgaggucaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccguggucaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcggggagguggacaacuucacgaugggcgugcugugccucgccauccuguucgaggaggucaugcgggggaaguucggcaagaagcacaugaucgcggggaucuucuucaccuucgugcugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgucggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccguggccuggcgcacggccacccugauccucgcgggggugagccugcugccggucugccaguccagcuccaugcggaagaccgacuggcuccccaugaccguggccgccaugggcgugccgccccucccgcuguucaucuucagccucaaggacacgcugaagcgccgcuccuggccccugaacgagggggugauggccgugggccucgucagcauccuggccuccagccugcuccggaacgacgugcccauggcgggcccccugguggccgggggccugcucaucgccugcuacgucaucaccgggaccuccgccgaccugaccguggagaaggccgcggacgugacgugggaggaggaggccgagcagaccggcgucagccacaaccugaugaucaccguggacgacgacgggaccaugcgcaucaaggacgacgagaccgagaacauccucacggugcugcugaagaccgcccuccugaucgucuccggcaucuucccguacagcauccccgccacccugcucguguggcacaccuggcagaagcagacgcagcgguccggcgugcugugggacguccccagcccgcccgagacccagaaggccgagcuggaggaggggguguaccgcaucaagcagcagggcaucuucgggaagacccaggugggcgucggggugcagaaggagggcguguuccacaccauguggcacgucacgcggggcgcggugcucaccuacaacgggaagcgccuggagcccaacugggccuccgugaagaaggaccugaucagcuacggcgggggcuggcggcucuccgcccaguggcagaagggggaggagguccaggugaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagaucgucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaaguccgagcacaccggccgggagaucguggaccugaugugccacgccaccuucacgaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucguccccagcaucaaggcgggcaacgacaucgccaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggugaccgagaucgggcggguccccacccaccucgcccaccgcacccggaacgcccuggacaaccuggugaugcuccacacguccgagcacggcgggaaggccuaccgccacgcgguggaggagcugcccgagaccauggagacccugcuccugcugggccucaugauccugcugaccgggggcgccaugcuguuccugaucagcggcaaggggaucggcaagacgagcaucgggcugaucugcgucaucgccuccagcggcaugcucuggauggccgagaucccgcugcaguggaucgccuccgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccacgaagcgcgaccugggcaugagcaaggagccggggguggucucccccaccagcuaccuggacguggaccuccaccccgccuccgccuggacccuguacgccguggcgaccacggucaucacccccaugcugcggcacaccaucgagaacagcaccgccaacgugucccucgccgccaucgccaaccaggcggugguccugaugggccuggacaagggguggccgaucagcaagauggaccucggcgugccccugcuggcccucgggugcuacucccaggugaacccccugacgcugaccgccgccguccuccugcugaucacccacuacgccaucaucggccccggccuccaggcgaaggccacccgcgaggcccagaagcggacggccgccgggaucaugaagaacccgaccguggacggcaucaugaccaucgaccuggaccccgugaucuacgacagcaaguucgagaagcagcuggggcaggucaugcuccuggugcugugcgcggugcagcuccugcugaugcgcaccuccugggcccucugcgaggcccugacgcuggccaccggccccaucaccacccucugggagggcagccccgggaaguucuggaacacgaccaucgcggucuccauggccaacaucuuccggggcagcuaccuggccggggccggccuggccuucuccaucaugaaguccguggggaccggcaagcgcggcaccgggucccagggcgagacccucggggagaaguggaagaagaagcugaaccagcugagccggaaggaguucgaccucuacaagaaguccggcaucacggagguggaccgcaccgaggcgaaggaggggcugaagcggggcgagaucacccaccacgccgucucccgcggcagcgccaagcugcagugguucguggagcggaacauggugaucccggaggggcgcgucaucgaccucggcugcgggcggggcgggugguccuacuacugcgccggccugaagaaggugaccgaggugcgcggcuacacgaagggcgggcccgggcacgaggagcccguccccaugagcaccuacggcuggaacaucgugaagcugauguccgggaaggacguguucuaccucccgcccgagaagugcgacacccugcugugcgacaucggcgagagcucccccagccccaccgucgaggagucccggacgauccgcgugcugaagaugguggagccguggcucaagaacaaccaguucugcaucaagguccugaaccccuacaugcccaccgugaucgagcaccuggagcgccuccagcggaagcacggcgggaugcuggugcgcaacccccugagccggaacuccacccacgagauguacuggaucagcaacggcaccgggaacaucgucgccuccgugaacauggugagccgccuccugcugaaccgguucacgaugacccaccgccggccgaccaucgagaaggacgucgaccucggcgcgggcacccgccacgugaacgccgagcccgagacgcccaacauggacgugaucggggagcggaucaagcgcaucaaggaggagcacaacuccaccuggcacuacgacgacgagaacccguacaagaccugggccuaccacggcagcuacgaggucaaggccaccggguccgccagcuccaugaucaacggcguggugaagcugcugacgaagcccugggacgucgugcccauggucacccagauggcgaugaccgacaccacgcccuucgggcagcagcggguguucaaggagaagguggacacccgcaccccgcggagcaugcccggcacccgccgggucaugggcaucacggccgaguggcucuggcgcacccuggggcggaacaagaagccccgccugugcacccgggaggaguucaccaagaaggugcgcacgaacgccgccaugggcgcgguguucaccgaggagaaccagugggacagcgccaaggccgccgucgaggacgaggacuucuggaagcucguggaccgcgagcgggagcugcacaagcuggggaagugcggcuccugcguguacaacaugauggggaagcgcgagaagaagcucggcgaguucggcaaggccaaggggagccgggcgaucugguacauguggcugggcgcccgcuaccuggaguucgaggcccucggguuccugaacgaggaccacugguucucccgggagaacagcuacuccggcgucgagggggagggccugcacaagcucggcuacauccugcgcgacaucagcaagauccccgggggcgccauguacgccgacgacaccgcggggugggacacccggaucacggaggacgaccugcacaacgaggagaagaucacccagcagauggacccggagcaccgccagcucgccaacgccaucuucaagcugaccuaccagaacaagguggugaagguccagcggcccacccccaccggcacggugauggacaucaucucccgcaaggaccagcggggcagcggccaggugggcaccuacgggcugaacaccuucaccaacauggaggcccagcucauccgccagauggagggcgaggggguccuguccaaggccgaccuggagaacccccaccucccggagaagaagaucacgcaguggcuggagaccaagggcguggagcggcugaagcgcauggcgaucagcggcgacgacugcguggucaagcccaucgacgaccgguucgccaacgcccuccuggcccugaacgacauggggaaggugcgcaaggacaucccccaguggcagcccuccaagggcuggcacgacuggcagcaggucccguucugcagccaccacuuccacgagcucaucaugaaggacgggcggaagcuggucgugcccugccgcccccaggacgagcugaucggccgggcccgcaucucccagggggcgggcuggagccuccgggagaccgccugccugggcaaggccuacgcccagauguggucccugauguacuuccaccgccgcgaccuccggcuggcgagcaacgccaucugcuccgccgugcccguccacugggugccgaccagccgcacgaccugguccauccacgcccaccaccaguggaugaccaccgaggacaugcugacgguguggaaccgggucuggaucgaggacaaccccuggauggaggacaagacccccgugaccaccugggagaacgugcccuaccucgggaagcgcgaggaccaguggugcggcagccugaucgggcugacgagccgggccaccugggcgcagaacaucccgaccgccauccagcagguccgcucccucaucggcaacgaggaguuccuggacuacaugcccagcaugaagcgguuccgcaaggaggaggaguccgagggggccaucugguga

SEQ ID NO: 10228 - RNA, 9873 nt, Artificial Sequence
  derived and/or modified CDS sequence (opt1) from DENV-3__FJ639763__SS-prME
accagccugugccucaugaugauccugcccgccgcccuggcguuccaccucaccagccgggacggggagccccggaugaucguggggaagaacgagcggggcaagagccugcuguucaagacggccuccgggaucaacaugugcacccucaucgccauggaccugggggagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaaggccgugaucuucauccugcugaugcucgugacgcccagcaugaccaugcggugcgugggggugggcaaccgcgacuucguggagggccuguccggggccaccugggucgacguggugcuggagcacggcgggugcgucaccacgauggccaagaacaagcccacccucgacaucgagcugcagaagaccgaggcgacccagcuggccacgcuccggaagcugugcaucgagggcaagaucaccaacaucaccaccgacagccgcugccccacgcagggcgaggccgugcugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacaccgugaucaucacggugcacaccggggaccagcaccaggucggcaacgagacccagggggugaccgccgagaucacgccccaggcgagcaccaccgaggccauccugcccgaguacggcacccuggggcucgagugcuccccgcgcaccggccuggacuucaacgagaugauccugcucacgaugaagaacaaggccuggaugguccaccggcagugguucuucgaccugccccugcccuggaccagcggcgccaccaccgagacgcccaccuggaaccgcaaggagcuccuggugaccuucaagaacgcccacgcgaagaagcaggagguggucgugcuggggucccaggagggcgccaugcacaccgcccucacgggggccaccgagauccagaacagcggcgggaccuccaucuucgccggccaccugaagugccggcugaagauggacaagcucgagcugaagggcaugagcuacgcgaugugcaccaacacguucgugcugaagaaggaggucuccgagacccagcacgggaccauccucaucaagguggaguacaagggcgaggacgugccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgcgucccgggccuggaacgucugggagguggaggacuacggguucggcguguucaccaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccguggucaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcggggagguggacaacuucacgaugggcgugcugugccucgcgauccuguucgaggaggucaugcgggggaaguucggcaagaagcacaugaucgccgggguguucuucaccuucgugcugcuccuguccggccagaucaccuggcgcgacauggcccacacccugaucaugaucggcagcaacgccuccgaccggauggggaugggcgucacguaccucgcccugaucgcgaccuucaagauccagcccuuccuggcccucggguucuuccugcgcaagcugaccagccgggagaaccuccugcugggcgugggccucgccauggccaccacgcugcagcugcccgaggacaucgagcagauggcgaacgggaucgcccucggccugauggcccugaagcucaucacccaguucgagaccuaccagcuguggaccgcccugaucagccucacgugcuccaacaccaucuucacccugaccguggccuggcgcacggcgacccugauccucgccggggucagccugcugccggugugccaguccagcuccaugcggaagaccgacuggcuccccaugaccgucgccgccaugggcgugccgccccucccgcuguucaucuucagccucaaggacacgcugaagcgccgcuccuggccccugaacgagggggugauggccgucggccucgugagcauccuggcguccagccugcuccggaacgacgugcccauggccggcccccuggucgccgggggccugcucaucgccugcuacgugaucaccgggaccuccgccgaccugaccguggagaaggcggccgacgucacgugggaggaggaggccgagcagaccggcgugagccacaaccugaugaucaccguggacgacgacgggaccaugcgcaucaaggacgacgagaccgagaacauccucacgguccugcugaagaccgcccuccugaucguguccggcaucuucccguacagcauccccgccacccugcucguguggcacaccuggcagaagcagacgcagcgguccggcguccugugggacgugcccagcccgcccgagacccagaaggcggagcuggaggaggggguguaccgcaucaagcagcagggcaucuucgggaagacccaggucggcgugggggugcagaaggagggcgucuuccacaccauguggcacgugacgcggggcgccgugcucaccuacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccaugcccggcaccuuccagacgaccaccggggagaucggcgccaucgcccuggacuucaagcccgggaccagcggcagccccaucaucaaccgcgagggcaaggugguggggcuguacggcaacggggucgugacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggcgaucguccgggaggccaucaagcgccggcuccgcacccugauccuggcccccacccgggugguggccgccgagauggaggaggcgcucaaggggcugcccauccgcuaccagaccacggccaccaaguccgagcacaccggccgggagaucgucgaccugaugugccacgccaccuucacgaugcgccuccugagccccgugcgggugccgaacuacaaccugaucaucauggacgaggcccacuucaccgaccccgccuccaucgcggcccgcggguacaucagcacccgggucggcaugggcgaggccgccgcgaucuucaugaccgccacgccgcccgggaccgccgacgccuucccgcaguccaacgcccccauccaggacgaggagcgcgacauccccgagcgcagcuggaacuccggcaacgaguggaucaccgacuucgcggggaagaccgugugguucgugcccagcaucaaggccggcaacgacaucgccaacugccuccggaagaacgggaagaaggucauccagcugucccgcaagacguucgacaccgaguaccagaagaccaagcugaacgacugggacuucguggugaccacggacaucagcgagaugggcgccaacuucaaggccgaccgggucaucgacccgcgccggugccucaagcccgugauccugaccgacggccccgagcgcgugauccuggcggggcccaugccggucaccgccgccuccgccgcccagcggcgcggccggguggggcgcaacccccagaaggagaacgaccaguacaucuucaccggccagccccucaacaacgacgaggaccacgcgcacuggaccgaggccaagaugcugcuggacaacaucaacacgcccgaggggaucaucccggcccucuucgagcccgagcgggagaaguccgccgcgaucgacggcgaguaccgccugaagggcgagucccggaagaccuucguggagcugaugcgccgcggggaccuccccgucuggcuggcccacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcacguacuccgacccgcuggcccucaaggaguucaaggacuucgcggccggccgcaagagcaucgcccuggaccuggugaccgagaucgggcgggugcccucccaccucgcccaccgcacccggaacgcccuggacaaccuggucaugcuccacaccagcgagcacggcgggaaggcguaccgccacgccguggaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgcgagcgccaucguccuggaguucuucaugauggugcuccugauccccgagcccgagaagcagcggacgccccaggacaaccagcuggccuacguggucaucgggauccucacccuggccgccaucaucgcggccaacgagaugggccugcucgagaccaccaagcgcgaccugggcauguccaaggagccggggguggugagccccacguccuaccuggacgucgaccuccaccccgccagcgccuggacccuguacgcgguggccaccaccgugaucacgcccaugcugcggcacaccaucgagaacuccaccgccaacgucagccucgccgccaucgcgaaccaggccguggugcugaugggccuggacaagggguggccgaucuccaagauggaccucggcgucccccugcuggcccucgggugcuacagccaggugaacccccugacccugacggccgccgugcuccugcugaucacccacuacgcgaucaucggccccggccuccaggccaaggccacccgcgaggcccagaagcggaccgccgcggggaucaugaagaacccgacggucgacggcaucaugaccaucgaccuggaccccgugaucuacgacuccaaguucgagaagcagcugggccaggugaugcuccugguccugugcgccgugcagcuccugcugaugcgcaccagcugggcccucugcgaggcccugacccuggcgacgggccccaucaccacccucugggagggcucccccgggaaguucuggaacaccacgaucgccgugagcauggccaacaucuuccggggcuccuaccuggccggggccggccuggcguucagcaucaugaaguccgucgggaccggcaagcgcggcaccgggagccagggcgagacccucggggagaaguggaagaagaagcugaaccagcugagccggaaggaguucgaccucuacaagaaguccggcaucaccgagguggaccgcacggaggccaaggaggggcugaagcggggcgagaucacccaccacgccgugagccgcggcuccgccaagcugcagugguucgucgagcggaacauggugaucccggaggggcgcgugaucgaccucggcugcgggcggggcggguggagcuacuacugcgccggccugaagaaggucaccgaggugcgcggcuacaccaagggcgggcccgggcacgaggagcccgugcccauguccacguacggcuggaacaucgucaagcugaugagcgggaaggacguguucuaccucccgcccgagaagugcgacacccugcugugcgacaucggcgaguccagccccucccccaccguggaggagagccggaccauccgcguccugaagaugguggagccguggcucaagaacaaccaguucugcaucaaggugcugaaccccuacaugcccacggucaucgagcaccuggagcgccuccagcggaagcacggcgggaugcuggugcgcaacccccugucccggaacagcacccacgagauguacuggaucuccaacggcaccgggaacaucguggcgagcgucaacauggugucccgccuccugcugaaccgguucaccaugacgcaccgccggccgaccaucgagaaggacguggaccucggcgccggcacccgccacgucaacgccgagcccgagacccccaacauggacgugaucggggagcggaucaagcgcaucaaggaggagcacaacagcacguggcacuacgacgacgagaacccguacaagaccugggccuaccacggcuccuacgaggugaaggccaccgggagcgcguccagcaugaucaacggcgucgugaagcugcugaccaagcccugggacgucgugcccauggugacgcagauggccaugaccgacaccacccccuucgggcagcagcgggucuucaaggagaagguggacacgcgcaccccgcggagcaugcccggcacccgccgggugaugggcaucaccgccgaguggcucuggcgcacgcuggggcggaacaagaagccccgccugugcacccgggaggaguucaccaagaagguccgcaccaacgccgcgaugggcgccguguucacggaggagaaccagugggacuccgccaaggccgccguggaggacgaggacuucuggaagcucgucgaccgcgagcgggagcugcacaagcuggggaagugcggcagcugcguguacaacaugauggggaagcgcgagaagaagcucggcgaguucggcaaggcgaaggggucccgggccaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgcggacgacaccgccgggugggacacccggaucaccgaggacgaccugcacaacgaggagaagaucacgcagcagauggacccggagcaccgccagcucgccaacgccaucuucaagcugaccuaccagaacaaggucgugaaggugcagcggcccacccccaccggcaccgucauggacaucaucagccgcaaggaccagcggggcuccggccaggugggcacguacgggcugaacaccuucaccaacauggaggcccagcucauccgccagauggagggcgagggggugcugagcaaggcggaccuggagaacccccaccucccggagaagaagaucacccaguggcuggagacgaacggcgucgagcggcugaagcgcauggccaucuccggcgacgacugcguggugaagcccaucgacgaccgguucgccaacgcccuccuggcccugaacgacauggggaagguccgcaaggacaucccccaguggcagcccagcaagggcuggcacgacuggcagcaggucccguucugcucccaccacuuccacgagcucaucaugaaggacgggcggaagcuggugguccccugccgcccccaggacgagcugaucggccgggcgcgcaucagccagggggccggcuggucccuccgggagaccgccugccugggcaaggccuacgcgcagauguggagccugauguacuuccaccgccgcgaccuccggcuggccuccaacgccaucugcagcgccgugcccgugcacugggucccgaccucccgcaccacguggagcauccacgcccaccaccaguggaugaccaccgaggacaugcugaccguguggaaccggguguggaucgaggacaaccccuggauggaggacaagacgcccgucaccaccugggagaacgugcccuaccucgggaagcgcgaggaccaguggugcggcagccugaucgggcugaccucccgggcgacgugggcccagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10229 - RNA, 9873 nt, Artificial Sequence
  derived and/or modified CDS sequence (opt1) from DENV-3__FJ639765__SS-prME
accagccugugccucaugaugauccugcccgccgcccuggcguuccaccucaccagccgggacggggagccccggaugaucguggggaagaacgagcggggcaagagccugcuguucaagaccgccagcgggaucaacaugugcacccucaucgccauggaccugggggagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcggagcguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaaguccgagcacaccggccgggagaucguggaccugaugugccacgccaccuucacgaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucguccccagcaucaaggcgggcaacgacaucgccaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggugaccgagaucgggcggguccccacccaccucgcccaccgcacccggaacgcccuggacaaccuggugaugcuccacacguccgagcacggcgggaaggccuaccgccacgcgguggaggagcugcccgagaccauggagacccugcuccugcugggccucaugauccugcugaccgggggcgccaugcuguuccugaucagcggcaaggggaucggcaagacgagcaucgggcugaucugcgucaucgccuccagcggcaugcucuggauggccgagaucccgcugcaguggaucgccuccgcgaucauccuggaguucuucaugauggugcuccugauccccgagcccgagaagcagcggacgccccaggacaaccagcuggccuacguggucaucgggauccucacccuggccgccaucaucgccgcgaacgagaugggccugcucgagaccacgaagcgcgaccugggcaugagcaaggagccggggguggugucccccaccagcuaccuggacgucgaccuccaccccgccuccgccuggacccuguacgccguggcgaccacggugaucacccccaugcugcggcacaccaucgagaacagcaccgccaacgucucccucgccgccaucgccaaccaggcgguggugcugaugggccuggacaagggguggccgaucagcaagauggaccucggcgucccccugcuggcccucgggugcuacucccaggugaacccccugacgcugaccgccgccgugcuccugcugaucacccacuacgccaucaucggccccggccuccaggcgaaggccacccgcgaggcccagaagcggacggccgccgggaucaugaagaacccgaccgucgacggcaucaugaccaucgaccuggaccccgugaucuacgacagcaaguucgagaagcagcugggccaggugaugcuccugguccugugcgcggugcagcuccugcugaugcgcaccuccugggcccucugcgaggcccugacgcuggccaccggccccaucaccacccucugggagggcagccccgggaaguucuggaacacgaccaucgcgguguccauggccaacaucuuccggggcagcuaccuggccggggccggccuggccuucuccaucaugaaguccgucgggaccggcaagcgcggcaccgggucccagggcgagacccucggggagaaguggaagaagaagcugaaccagcugagccggaaggaguucgaccucuacaagaaguccggcaucacggagguggaccgcaccgaggcgaaggaggggcugaagcggggcgagaucacccaccacgccgugucccgcggcagcgccaagcugcagugguucgucgagcggaacauggugaucccggaggggcgcgugaucgaccucggcugcgggcggggcgggugguccuacuacugcgccggccugaagaaggucaccgaggugcgcggcuacacgaagggcgggcccgggcacgaggagcccgugcccaugagcaccuacggcuggaacaucgucaagcugauguccgggaaggacguguucuaccucccgcccgagaagugcgacacccugcugugcgacaucggcgagagcucccccagccccaccguggaggagucccggacgauccgcguccugaagaugguggagccguggcucaagaacaaccaguucugcaucaaggugcugaaccccuacaugcccaccgucaucgagcaccuggagcgccuccagcggaagcacggcgggaugcuggugcgcaacccccugagccggaacuccacccacgagauguacuggaucagcaacggcaccgggaacaucguggccuccgucaacauggugagccgccuccugcugaaccgguucacgaugacccaccgccggccgaccaucgagaaggacguggaccucggcgcgggcacccgccacgucaacgccgagcccgagacgcccaacauggacgugaucggggagcggaucaagcgcaucaaggaggagcacaacuccaccuggcacuacgacgacgagaacccguacaagaccugggccuaccacggcagcuacgaggugaaggccaccggguccgccagcuccaugaucaacggcgucgugaagcugcugacgaagcccugggacgucgugcccauggugacccagauggcgaugaccgacaccacgcccuucgggcagcagcgggucuucaaggagaagguggacacccgcaccccgcggagcaugcccggcacccgccgggugaugggcaucacggccgaguggcucuggcgcacccuggggcggaacaagaagccccgccugugcacccgggaggaguucaccaagaagguccgcacgaacgccgccaugggcgcgguguucaccgaggagaaccagugggacagcgccaaggccgccguggaggacgaggacuucuggaagcucgucgaccgcgagcgggagcugcacaagcuggggaagugcggcuccugcguguacaacaugauggggaagcgcgagaagaagcucggcgaguucggcaaggccaaggggagccgggcgaucugguacauguggcugggcgcccgcuaccuggaguucgaggcccucggguuccugaacgaggaccacugguucucccgggagaacagcuacuccggcguggagggggagggccugcacaagcucggcuacauccugcgcgacaucagcaagauccccgggggcgccauguacgccgacgacaccgcggggugggacacccggaucacggaggacgaccugcacaacgaggagaagaucacccagcagauggacccggagcaccgccagcucgccaacgccaucuucaagcugaccuaccagaacaaggucgugaaggugcagcggcccacccccaccggcacggucauggacaucaucucccgcaaggaccagcggggcagcggccaggugggcaccuacgggcugaacaccuucaccaacauggaggcccagcucauccgccagauggagggcgagggggugcuguccaaggccgaccuggagaacccccaccucccggagaagaagaucacgcaguggcuggagaccaagggcgucgagcggcugaagcgcauggcgaucagcggcgacgacugcguggugaagcccaucgacgaccgguucgccaacgcccuccuggcccugaacgacauggggaagguccgcaaggacaucccccaguggcagcccuccaagggcuggcacgacuggcagcaggucccguucugcagccaccacuuccacgagcucaucaugaaggacgggcggaagcuggugguccccugccgcccccaggacgagcugaucggccgggcccgcaucucccagggggcgggcuggagccuccgggagaccgccugccugggcaaggccuacgcccagauguggucccugauguacuuccaccgccgcgaccuccggcuggcgagcaacgccaucugcuccgccgugcccgugcacugggucccgaccagccgcacgaccugguccauccacgcccaccaccaguggaugaccaccgaggacaugcugacgguguggaaccggguguggaucgaggacaaccccuggauggaggacaagacccccgucaccaccugggagaacgugcccuaccucgggaagcgcgaggaccaguggugcggcagccugaucgggcugacgagccgggccaccugggcgcagaacaucccgaccgccauccagcagguccgcucccucaucggcaacgaggaguuccuggacuacaugcccagcaugaagcgguuccgcaaggaggaggaguccgagggggccaucugguga

SEQ ID NO: 10230 - RNA, 9873 nt, Artificial Sequence
  derived and/or modified CDS sequence (opt1) from DENV-3__FJ639766__SS-prME
accagccugugccucaugaugauccugcccgccgcccuggcguuccaccucaccucccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucaaccucaaggacacgcugaagcgccgcagcuggccccugaacgagggggucauggccgugggccucguguccauccuggccagcucccugcuccggaacgacguccccauggcgggcccccugguggccgggggccugcucaucgccugcuacgugaucaccgggaccagcgccgaccugaccgucgagaaggccgcggacgugacgugggaggaggaggccgagcagaccggcgugucccacaaccugaugaucaccgucgacgacgacgggaccaugcgcaucaaggacgacgagaccgagaacauccucacggugcugcugaagaccgcccuccugaucgugagcggcaucuucccguacuccauccccgccacccugcucgucuggcacaccuggcagaagcagacgcagcggagcggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccagcgugaagaaggaccugaucuccuacggcgggggcuggcggcucagcgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccuccggcagccccaucaucaaccgcgagggcaagguggucgggcuguacggcaacgggguggugacgaagaacggcggguacgucagcggcaucgcccagaccaacgccgagccggacggccccacccccgagcuggaggaggagauguucaagaagcggaaccucaccaucauggaccugcaccccggguccggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaagagcgagcacaccggccgggagaucguggaccugaugugccacgccaccuucacgaugcgccuccugucccccgugcgggucccgaacuacaaccugaucaucauggacgaggcccacuucaccgaccccgccagcaucgccgcgcgcggguacaucuccacccgggugggcaugggcgaggccgccgccaucuucaugaccgcgacgccgcccgggaccgccgacgccuucccgcagagcaacgcccccauccaggacgaggagcgcgacauccccgagcgcuccuggaacagcggcaacgaguggaucaccgacuucgccgggaagaccgugugguucguccccuccaucaaggcgggcaacgacaucgccaacugccuccggaagaacgggaagaaggugauccagcugagccgcaagacguucgacaccgaguaccagaagaccaagcugaacgacugggacuucguggucaccacggacaucuccgagaugggcgccaacuucaaggccgaccgggugaucgacccgcgccggugccucaagcccgugauccugaccgacggccccgagcgcgucauccuggccgggcccaugccggugaccgcggccagcgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagagccggaagaccuucgucgagcugaugcgccgcggggaccuccccguguggcuggcgcacaaggucgccuccgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacagcgacccgcuggcccucaaggaguucaaggacuucgccgcgggccgcaaguccaucgcccuggaccuggugaccgagaucgggcggguccccacccaccucgcccaccgcacccggaacgcccuggacaaccuggugaugcuccacacgagcgagcacggcgggaaggccuaccgccacgcgguggaggagcugcccgagaccauggagacccugcuccugcugggccucaugauccugcugaccgggggcgccaugcuguuccugaucuccggcaaggggaucggcaagacgagcaucgggcugaucugcgucaucgccagcuccggcaugcucuggauggccgagaucccgcugcaguggaucgccagcgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccacgaagcgcgaccugggcauguccaaggagccggggguggucagccccaccuccuaccuggacguggaccuccaccccgccagcgccuggacccuguacgccguggcgaccacggucaucacccccaugcugcggcacaccaucgagaacuccaccgccaacgugagccucgccgccaucgccaaccaggcggugguccugaugggccuggacaagggguggccgaucuccaagauggaccucggcgugccccugcuggcccucgggugcuacagccaggugaacccccugacgcugaccgccgccguccuccugcugaucacccacuacgccaucaucggccccggccuccaggcgaaggccacccgcgaggcccagaagcggacggccgccgggaucaugaagaacccgaccguggacggcaucaugaccaucgaccuggaccccgugaucuacgacuccaaguucgagaagcagcuggggcaggucaugcuccuggugcugugcgcggugcagcuccugcugaugcgcaccagcugggcccucugcgaggcccugacgcuggccaccggccccaucaccacccucugggagggcucccccgggaaguucuggaacacgaccaucgcggucagcauggccaacaucuuccggggcuccuaccuggccggggccggccuggccuucagcaucaugaaguccguggggaccggcaagcgcggcaccgggagccagggcgagacccucggggagaaguggaagaagaagcugaaccagcugucccggaaggaguucgaccucuacaagaaguccggcaucacggagguggaccgcaccgaggcgaaggaggggcugaagcggggcgagaucacccaccacgccgucagccgcggcuccgccaagcugcagugguucguggagcggaacauggugaucccggaggggcgcgucaucgaccucggcugcgggcggggcggguggagcuacuacugcgccggccugaagaaggugaccgaggugcgcggcuacacgaagggcgggcccgggcacgaggagcccguccccauguccaccuacggcuggaacaucgugaagcugaugagcgggaaggacguguucuaccucccgcccgagaagugcgacacccugcugugcgacaucggcgaguccagccccucccccaccgucgaggagagccggacgauccgcgugcugaagaugguggagccguggcucaagaacaaccaguucugcaucaagguccugaaccccuacaugcccaccgugaucgagcaccuggagcgccuccagcggaagcacggcgggaugcuggugcgcaacccccugucccggaacagcacccacgagauguacuggaucuccaacggcaccgggaacaucgucgccagcgugaacauggugucccgccuccugcugaaccgguucacgaugacccaccgccggccgaccaucgagaaggacgucgaccucggcgcgggcacccgccacgugaacgccgagcccgagacgcccaacauggacgugaucggggagcggaucaagcgcaucaaggaggagcacaacagcaccuggcacuacgacgacgagaacccguacaagaccugggccuaccacggcuccuacgaggucaaggccaccgggagcgccuccagcaugaucaacggcguggucaagcugcugacgaagcccugggacguggugcccauggucacccagauggcgaugaccgacaccacgcccuucgggcagcagcggguguucaaggagaagguggacacccgcaccccgcgguccaugcccggcacccgccgggucaugggcaucacggccgaguggcucuggcgcacccuggggcggaacaagaagccccgccugugcacccgggaggaguucaccaagaaggugcgcacgaacgccgccaugggcgcgguguucaccgaggagaaccagugggacagcgccaaggccgccgucgaggacgaggacuucuggaagcucguggaccgcgagcgggagcugcacaagcuggggaagugcggcagcugcguguacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcgucgagggggagggccugcacaagcucggcuacauccugcgcgacaucuccaagauccccgggggcgccauguacgccgacgacaccgcggggugggacacccggaucacggaggacgaccugcacaacgaggagaagaucacccagcagauggacccggagcaccgccagcucgccaacgccaucuucaagcugaccuaccagaacaagguggugaagguccagcggcccacccccaccggcacggugauggacaucaucagccgcaaggaccagcggggcuccggccaggugggcaccuacgggcugaacaccuucaccaacauggaggcccagcucauccgccagauggagggcgaggggguccugagcaaggccgaccuggagaacccccaccucccggagaagaagaucacgcaguggcuggagaccaagggcguggagcggcugaagcgcauggcgaucuccggcgacgacugcguggucaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcuggucgugcccugccgcccccaggacgagcugaucggccgggcccgcaucagccagggggcgggcuggucccuccgggagaccgccugccugggcaaggccuacgcccagauguggagccugauguacuuccaccgccgcgaccuccggcuggcguccaacgccaucugcagcgccgugcccguccacugggugccgaccucccgcacgaccuggagcauccacgcccaccaccaguggaugaccaccgaggacaugcugacgguguggaaccgggucuggaucgaggacaaccccuggauggaggacaagacccccgugaccaccugggagaacgugcccuaccucgggaagcgcgaggaccaguggugcggcucccugaucgggcugacgagccgggccaccugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10231 - RNA, 9873 nt, Artificial Sequence
  derived and/or modified CDS sequence (opt1) from DENV-3__FJ639767__SS-prME
accagccugugccucaugaugauccugcccgccgcccuggcguuccaccucaccagccgggacggggagccccggaugaucguggggaagaacgagcggggcaagagccugcuguucaagacggccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaaguccgagcacaccggccgggagaucguggaccugaugugccacgccaccuucacgaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucguccccagcaucaaggcgggcaacgacaucgccaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggugaccgagaucgggcggguccccucccaccucgcccaccgcacccggaacgcccuggacaaccuggugaugcuccacaccagcgagcacggcgggaaggccuaccgccacgcgguggaggagcugcccgagacgauggagacccugcuccugcugggccucaugauccugcugaccgggggcgccaugcuguuccugaucagcggcaaggggaucggcaagaccuccaucgggcugaucugcgucaucgccagcuccggcaugcucuggauggccgagaucccgcugcaguggaucgccagcgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccaccaagcgcgaccugggcauguccaaggagccggggguggucagccccaucuccuaccuggacguggaccuccaccccgccagcgccuggacgcuguacgccguggcgaccaccgucaucacccccaugcugcggcacacgaucgagaacuccaccgccaacgugagccucgccgccaucgccaaccaggcggugguccugaugggccuggacaagggguggccgaucuccaagauggaccucggcgugccccugcuggcccucgggugcuacagccaggugaacccccugacccugaccgccgccguccuccugcugaucacgcacuacgccaucaucggccccggccuccaggcgaaggccacccgcgaggcccagaagcggaccgccgccgggaucaugaagaacccgaccguggacggcaucaugacgaucgaccuggaccccgugaucuacgacuccaaguucgagaagcagcuggggcaggucaugcuccuggugcugugcgcggugcagcuccugcugaugcgcaccagcugggcccucugcgaggcccugacccuggccaccggccccaucacgacccucugggagggcucccccgggaaguucuggaacaccaccaucgcggucagcauggccaacaucuuccggggcuccuaccuggccggggccggccuggccuucagcaucaugaaguccguggggacgggcaagcgcggcaccgggagccagggcgagacccucggggagaaguggaagaagaagcugaaccagcugagccggaaggaguucgaccucuacaagaaguccggcaucaccgagguggaccgcaccgaggcgaaggaggggcugaagcggggcgagaucacgcaccacgccgucagccgcggcuccgccaagcugcagugguucguggagcggaacauggugaucccggaggggcgcgucaucgaccucggcugcgggcggggcggguggagcuacuacugcgccggccugaagaaggugaccgaggugcgcggcuacaccaagggcgggcccgggcacgaggagcccguccccauguccaccuacggcuggaacaucgugaagcugaugagcgggaaggacguguucuaccucccgcccgagaagugcgacacgcugcugugcgacaucggcgaguccagccccucccccaccgucgaggagagccggaccauccgcgugcugaagaugguggagccguggcucaagaacaaccaguucugcaucaagguccugaaccccuacaugcccaccgugaucgagcaccuggagcgccuccagcggaagcacggcgggaugcuggugcgcaacccccugucccggaacagcacgcacgagauguacuggaucuccaacggcaccgggaacaucgucgccagcgugaacauggugucccgccuccugcugaaccgguucaccaugacccaccgccggccgacgaucgagaaggacgucgaccucggcgcgggcacccgccacgugaacgccgagcccgagacccccaacauggacgugaucggggagcggaucaagcgcaucaaggaggagcacaacagcaccuggcacuacgacgacgagaacccguacaagacgugggccuaccacggcuccuacgaggucaaggccaccgggagcgccuccagcaugaucaacggcguggucaagcugcugaccaagcccugggacguggugcccauggucacccagauggcgaugacggacaccacccccuucgggcagcagcggguguucaaggagaagguggacacccgcacgccgcggagcaugcccggcacccgccgggucaugggcaucaccgccgaguggcucuggcgcacccuggggcggaacaagaagccccgccugugcacgcgggaggaguucaccaagaaggugcgcaccaacgccgccaugggcgcgguguucaccgaggagaaccagugggacuccgccaaggccgccgucgaggacgaggacuucuggaagcucguggaccgcgagcgggagcugcacaagcuggggaagugcggcagcugcguguacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcgucgagggggagggccugcacaagcucggcuacauccugcgcgacaucuccaagauccccgggggcgccauguacgccgacgacacggcggggugggacacccggaucaccgaggacgaccugcacaacgaggagaagaucacccagcagauggacccggagcaccgccagcucgccaacgccaucuucaagcugacguaccagaacaagguggugaagguccagcggcccacccccaccggcaccgugauggacaucaucagccgcaaggaccagcggggcuccggccaggugggcaccuacgggcugaacacguucaccaacauggaggcccagcucauccgccagauggagggcgaggggguccugagcaaggccgaccuggagaacccccaccucccggagaagaagaucacccaguggcuggagaccaagggcguggagcggcugaagcgcauggcgaucuccggcgacgacugcguggucaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcuggucgugcccugccgcccccaggacgagcugaucggccgggcccgcaucagccagggggcgggcuggucccuccgggagacggccugccugggcaaggccuacgcccagauguggagccugauguacuuccaccgccgcgaccuccggcuggcguccaacgccaucugcagcgccgugcccguccacugggugccgaccucccgcaccaccuggagcauccacgcccaccaccaguggaugacgaccgaggacaugcugaccguguggaaccgggucuggaucgaggacaaccccuggauggaggacaagacccccgugacgaccugggagaacgugcccuaccucgggaagcgcgaggaccaguggugcggcagccugaucgggcugaccucccgggccaccugggcgcagaacaucccgacggccauccagcagguccgcagccucaucggcaacgaggaguuccuggacuacaugcccuccaugaagcgguuccgcaaggaggaggagagcgagggggccaucugguga

SEQ ID NO: 10232 - RNA, 9873 nt, Artificial Sequence
  derived and/or modified CDS sequence (opt1) from DENV-3__FJ639768__SS-prME
accagccugugccucaugaugauccugcccgccgcccuggcguuccaccucaccagccgggacggggagccgcggaugaucguggggaagaacgagcggggcaagagccugcuguucaagacggccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucaacgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccuccggcagccccaucaucaaccgcgagggcaagguggucgggcuguacggcaacgggguggugacgaagaacggcggguacgucagcggcaucgcccagaccaacgccgagccggacggccccacccccgagcuggaggaggagauguucaagaagcggaaccucaccaucauggaccugcaccccggguccggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaagagcgagcacaccggccgggagaucguggaccugaugugccacgccaccuucacgaugcgccuccugucccccgugcgggucccgaacuacaaccugaucaucauggacgaggcccacuucaccgaccccgccagcaucgccgcgcgcggguacaucuccacccgggugggcaugggcgaggccgccgccaucuucaugaccgcgacgccgcccgggaccgccgacgccuucccgcagagcaacgcccccauccaggacgaggagcgcgacauccccgagcgcuccuggaacagcggcaacgaguggaucaccgacuucgccgggaagaccgugugguucguccccuccaucaaggcgggcaacgacaucgccaacugccuccggaagaacgggaagaaggugauccagcugagccgcaagacguucgacaccgaguaccagaagaccaagcugaacgacugggacuucguggucaccacggacaucuccgagaugggcgccaacuucaaggccgaccgggugaucgacccgcgccggugccucaagcccgugauccugaccgacggccccgagcgcgucauccuggccgggcccaucccggugaccgcggccagcgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagagccggaagaccuucgucgagcugaugcgccgcggggaccuccccguguggcuggcgcacaaggucgccuccgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacagcgacccgcuggcccucaaggaguucaaggacuucgccgcgggccgcaaguccaucgcccuggaccuggugaccgagaucgggcggguccccagccaccucgcccaccgcacccggaacgcccuggacaaccuggugaugcuccacaccuccgagcacggcgggaaggccuaccgccacgcgguggaggagcugcccgagacgauggagacccugcuccugcugggccucaugauccugcugaccgggggcgccaugcuguuccugaucagcggcaaggggaucggcaagaccagcaucgggcugaucugcgucaucgccuccagcggcaugcucuggauggccgagaucccgcugcaguggaucgccuccgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccaccaagcgcgaccugggcaugagcaaggagccggggguggucucccccacgagcuaccuggacguggaccuccaccccgccuccgccuggacccuguacgccguggcgaccaccgucaucacgcccaugcugcggcacaccaucgagaacagcaccgccaacgugucccucgccgccaucgccaaccaggcggugguccugaugggccuggacaagggguggccgaucagcaagauggaccucggcgugccccugcuggcccucgggugcuacucccaggugaacccccugacccugacggccgccguccuccugcugaucacccacuacgccaucaucggccccggccuccaggcgaaggccacccgcgaggcccagaagcggaccgccgccgggaucaugaagaacccgacgguggacggcaucaugaccaucgaccuggaccccgugaucuacgacagcaaguucgagaagcagcuggggcaggucaugcuccuggugcugugcgcggugcagcuccugcugaugcgcaccuccugggcccucugcgaggcccugacccuggccacgggccccaucaccacccucugggagggcagccccgggaaguucuggaacaccacgaucgcggucuccauggccaacaucuuccggggcagcuacaucgccggggccggccuggccuucuccaucaugaaguccguggggaccggcaagcgcggcaccgggucccagggcgagacccugggggagaaguggaagaagaagcucaaccagcugagccggaaggaguucgaccuguacaagaaguccggcaucaccgagguggaccgcacggaggcgaaggaggggcucaagcggggcgagaucacccaccacgccgucucccgcggcagcgccaagcugcagugguucguggagcggaacauggugaucccggaggggcgcgucaucgaccugggcugcgggcggggcgggugguccuacuacugcgccggccucaagaaggugaccgaggugcgcggcuacaccaagggcgggcccgggcacgaggagcccguccccaugagcacguacggcuggaacaucgugaagcugauguccgggaaggacguguucuaccugccgcccgagaagugcgacacccuccugugcgacaucggcgagagcucccccagccccaccgucgaggagucccggaccauccgcgugcugaagaugguggagccguggcugaagaacaaccaguucugcaucaagguccucaaccccuacaugcccacggugaucgagcaccuggagcgccugcagcggaagcacggcgggaugcucgugcgcaacccccugagccggaacuccacccacgagauguacuggaucagcaacggcaccgggaacaucgucgccuccgugaacauggugagccgccugcuccugaaccgguucaccaugacgcaccgccggccgaccaucgagaaggacgucgaccugggcgcgggcacccgccacgugaacgccgagcccgagacccccaacauggacgugaucggggagcggaucaagcgcaucaaggaggagcacaacuccacguggcacuacgacgacgagaacccguacaagaccugggccuaccacggcagcuacgaggucaaggccaccggguccgccagcuccaugaucaacggcguggucaagcuccugaccaagcccugggacguggugcccauggucacgcagauggcgaugaccgacaccacccccuucgggcagcagcggguguucaaggagaagguggacacgcgcaccccgcggagcaugcccggcacccgccgggucaugggcaucaccgccgaguggcuguggcgcacgcucgggcggaacaagaagccccgccugugcacccgggaggaguucaccaagaaggugcgcaccaacgccgccaugggcgcgguguucacggaggagaaccagugggacagcgccaaggccgccgucgaggacgaggacuucuggaagcugguggaccgcgagcgggagcuccacaagcuggggaagugcggcuccugcguguacaacaugauggggaagcgcgagaagaagcugggcgaguucggcaaggccaaggggagccgggcgaucugguacauguggcucggcgcccgcuaccuggaguucgaggcccugggguuccucaacgaggaccacugguucucccgggagaacagcuacuccggcgucgagggggagggccugcacaagcugggcuacauccuccgcgacaucagcaagauccccgggggcgccauguacgccgacgacaccgcggggugggacacccggaucaccgaggacgaccugcacaacgaggagaagaucacgcagcagauggacccggagcaccgccagcuggccaacgccaucuucaagcucaccuaccagaacaagguggugaagguccagcggcccacccccaccggcaccgugauggacaucaucucccgcaaggaccagcggggcagcggccaggugggcacguacgggcugaacaccuucaccaacauggaggcccagcugauccgccagauggagggcgaggggguccucuccaaggccgaccuggagaacccccaccuccccgagaagaagaucacccaguggcuggagacgaagggcguggagcggcugaagcgcauggcgaucagcggcgacgacugcguggucaagcccaucgacgaccgguucgccaacgcccugcucgcccugaacgacauggggaaggugcgcaaggacaucccccaguggcagcccuccaagggcuggcacgacuggcagcaggucccguucugcagccaccacuuccacgagcugaucaugaaggacgggcggaagcucgucgugcccugccgcccccaggacgagcugaucggccgggcccgcaucucccagggggcgggcuggagccugcgggagaccgccugccucggcaaggccuacgcccagauguggucccugauguacuuccaccgccgcgaccugcggcucgcgagcaacgccaucugcuccgccgugcccguccacugggugccgaccagccgcaccacgugguccauccacgcccaccaccaguggaugaccaccgaggacaugcugaccguguggaaccgggucuggaucgaggacaaccccuggauggaggacaagacgcccgugaccaccugggagaacgugcccuaccuggggaagcgcgaggaccaguggugcggcagccucaucgggcugaccagccgggccacgugggcgcagaacaucccgaccgccauccagcagguccgcucccugaucggcaacgaggaguuccucgacuacaugcccagcaugaagcgguuccgcaaggaggaggaguccgagggggccaucugguga

SEQ ID NO: 10233 - RNA, 9873 nt, Artificial Sequence
  derived and/or modified CDS sequence (opt1) from DENV-3__FJ639769__SS-prME
accagccugugccucaugaugauccugcccgccgcccuggcguuccaccucaccagccgggacggcgagccccggaugaucguggggaagaacgagcggggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcggagcgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaaguccgagcacaccggccgggagaucguggaccugaugugccacgccaccuucacgaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucguccccagcaucaaggcgggcaacgacaucgccaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggugaccgagaucgggcggguccccacccaccucgcccaccgcacccggaacgcccuggacaaccuggugaugcuccacacguccgagcacggcgggaaggccuaccgccacgcgguggaggagcugcccgagaccauggagacccugcuccugcugggccucaugauccugcugaccgggggcgccaugcuguuccugaucagcggcaaggggaucggcaagacgagcaucgggcugaucugcgucaucgccuccagcggcaugcucuggauggccgagaucccgcugcaguggaucgccuccgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccacgaagcgcgaccugggcaugagcaaggagccggggguggucucccccaccagcuaccuggacguggaccuccaccccgccuccgccuggacccuguacgccguggcgaccacggucaucacccccaugcugcggcacaccaucgagaacagcaccgccaacgugucccucgccgccaucgccaaccaggcggugguccugaugggccuggacaagggguggccgaucagcaagauggaccucggcgugccccugcuggcccucgggugcuacucccaggugaacccccugacgcugaccgccgccguccuccugcugaucacccacuacgccaucaucggccccggccuccaggcgaaggccacccgcgaggcccagaagcggacggccgccgggaucaugaagaacccgaccguggacggcaucaugaccaucgaccuggaccccgugaucuacgacagcaaguucgagaagcagcuggggcaggucaugcuccuggugcugugcgugguccagcuccugcugaugcgcaccuccugggcgcucugcgaggcccugacgcuggccaccggccccaucaccacccucugggagggcagccccgggaaguucuggaacacgaccaucgccguguccauggcgaacaucuuccggggcagcuaccuggccggggccggccuggccuucuccaucaugaaguccguggggaccggcaagcgcggcaccgggucccagggcgagacccucggggagaaguggaagaagaagcugaaccagcugagccggaaggaguucgaccucuacaagaaguccggcaucacggaggucgaccgcaccgaggccaaggaggggcugaagcggggcgagaucacccaccacgcggugucccgcggcagcgccaagcugcagugguucguggagcggaacauggucaucccggaggggcgcgugaucgaccucggcugcgggcggggcgggugguccuacuacugcgccggccugaagaaggugaccgagguccgcggcuacacgaagggcgggcccgggcacgaggagcccgugcccaugagcaccuacggcuggaacaucgugaagcugauguccgggaaggacgucuucuaccucccgcccgagaagugcgacacccugcugugcgacaucggcgagagcucccccagccccaccguggaggagucccggacgauccgcgugcugaagauggucgagccguggcucaagaacaaccaguucugcaucaaggugcugaaccccuacaugcccaccgugaucgagcaccuggagcgccuccagcggaagcacggcgggaugcugguccgcaacccccugagccggaacuccacccacgagauguacuggaucagcaacggcaccgggaacaucguggccuccgugaacauggucagccgccuccugcugaaccgguucacgaugacccaccgccggccgaccaucgagaaggacguggaccucggcgccggcacccgccacgugaacgcggagcccgagacgcccaacauggacgucaucggggagcggaucaagcgcaucaaggaggagcacaacuccaccuggcacuacgacgacgagaacccguacaagaccugggccuaccacggcagcuacgaggugaaggccaccggguccgccagcuccaugaucaacggcgucgugaagcugcugacgaagcccugggacgugguccccauggugacccagauggccaugaccgacaccacgcccuucgggcagcagcggguguucaaggagaaggucgacacccgcaccccgcggagcaugcccggcacccgccgggugaugggcaucacggcggaguggcucuggcgcacccuggggcggaacaagaagccccgccugugcacccgggaggaguucaccaagaaggugcgcacgaacgccgccaugggcgccgucuucaccgaggagaaccagugggacagcgcgaaggccgccguggaggacgaggacuucuggaagcucguggaccgcgagcgggagcugcacaagcuggggaagugcggcuccugcgucuacaacaugauggggaagcgcgagaagaagcucggcgaguucggcaaggccaaggggagccgggccaucugguacauguggcugggcgcgcgcuaccuggaguucgaggcccucggguuccugaacgaggaccacugguucucccgggagaacagcuacuccggcguggagggggagggccugcacaagcucggcuacauccugcgcgacaucagcaagauccccgggggcgccauguacgccgacgacaccgccgggugggacacccggaucacggaggacgaccugcacaacgaggagaagaucacccagcagauggacccggagcaccgccagcucgcgaacgccaucuucaagcugaccuaccagaacaagguggucaaggugcagcggcccacccccaccggcacggugauggacaucaucucccgcaaggaccagcggggcagcgggcaggucggcaccuacgggcugaacaccuucaccaacauggaggcccagcucauccgccagauggagggcgagggggugcuguccaaggccgaccuggagaacccccaccucccggagaagaagaucacgcaguggcuggagaccaagggcguggagcggcugaagcgcauggccaucagcggcgacgacugcgucgugaagcccaucgacgaccgguucgcgaacgcccuccuggcccugaacgacauggggaaggugcgcaaggacaucccccaguggcagcccuccaagggcuggcacgacuggcagcaggucccguucugcagccaccacuuccacgagcucaucaugaaggacgggcggaagcugguggugcccugccgcccccaggacgagcugaucggccgggcccgcaucucccagggggccggcuggagccuccgggagaccgcgugccugggcaaggccuacgcccagauguggucccugauguacuuccaccgccgcgaccuccggcuggccagcaacgcgaucugcuccgccguccccgugcacugggugccgaccagccgcacgaccugguccauccacgcccaccaccaguggaugaccaccgaggacaugcugacggucuggaaccggguguggaucgaggacaaccccuggauggaggacaagacccccgugaccaccugggagaacguccccuaccucgggaagcgcgaggaccaguggugcggcagccugaucgggcugacgagccgggccaccugggcccagaacaucccgaccgcgauccagcagguccgcucccucaucggcaacgaggaguuccuggacuacaugcccagcaugaagcgguuccgcaaggaggaggaguccgagggggccaucugguga

SEQ ID NO: 10234 - RNA, 9873 nt, Artificial Sequence
  derived and/or modified CDS sequence (opt1) from DENV-3__FJ882577__SS-prME
accagccugugccucaugaugauccugcccgccgcccuggcguuccaccucaccagccgggacggggagccccggaugaucguggggaagaacgagcggggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcggagcguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggaucuucuucaccuucgugcugcuccuguccggccagaucaccuggcgcgacauggcccacacccugaucaugaucggcagcaacgccuccgaccggauggggaugggcgucacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccguggccuggcgcacggccacccugauccucgcgggggucagccugcugccggugugccaguccagcuccaugcggaagaccgacuggcuccccaugaccgucgccgccaugggcgugccgccccucccgcuguucaucuucagccucaaggacacgcugaagcgccgcuccuggccccugaacgagggggugauggccgucggccucgugagcauccuggccuccagccugcuccggaacgacgugcccauggcgggcccccuggucgccgggggccugcucaucgccugcuacgugaucaccgggaccuccgccgaccugaccguggagaaggccgcggacgucacgugggaggaggaggccgagcagaccggcgugagccacaaccugaugaucaccguggacgacgacgggaccaugcgcaucaaggacgacgagaccgagaacauccucacgguccugcugaagaccgcccuccugaucguguccggcaucuucccguacagcauccccgccacccugcucguguggcacaccuggcagaagcagacgcagcgguccggcguccugugggacgugcccagcccgcccgagacccagaaggccgagcuggaggaggggguguaccgcaucaagcagcagggcaucuucgggaagacccaggucggcgugggggugcagaaggagggcgucuuccacaccauguggcacgugacgcggggcgcggugcucaccuacaacgggaagcgccuggagcccaacugggccuccgucaagaaggaccugaucagcuacggcgggggcuggcggcucuccgcccaguggcagaagggggaggagguccaggugaucgccgucgagcccggcaagaaccccaagaacuuccagaccaugcccggcaccuuccagacgaccaccggggagaucggcgcgaucgcccuggacuucaagcccgggaccagcggcagccccaucaucaaccgcgagggcaagaucguggggcuguacggcaacgggguggucacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccgggucguggccgccgagauggaggaggcccucaaggggcugcccauccgcuaccagaccacggcgaccaaguccgagcacaccggccgggagaucguggaccugaugugccacgccaccuucacgaugcgccuccugagccccguccgggugccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgucugguucgugcccagcaucaaggcgggcaacgacaucgccaacugccuccggaagaacgggaagaaggugauccagcugucccgcaagacguucgacaccgaguaccagaagaccaagcugaacgacugggacuucgucgugaccacggacaucagcgagaugggcgccaacuucaaggccgaccgggugaucgacccgcgccggugccucaagcccgucauccugaccgacggccccgagcgcgugauccuggccgggcccaugccggugaccgcggccuccgccgcccagcggcgcggccgggucgggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucguggagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggucaccgagaucgggcgggugcccacccaccucgcccaccgcacccggaacgcccuggacaaccuggugaugcuccacacguccgagcacggcgggaaggccuaccgccacgcggucgaggagcugcccgagaccauggagacccugcuccugcugggccucaugauccugcugaccgggggcgccaugcuguuccugaucagcggcaaggggaucggcaagacgagcaucgggcugaucugcgugaucgccuccagcggcaugcucuggauggccgagaucccgcugcaguggaucgccuccgcgaucgugcuggaguucuucaugaugguccuccugauccccgagcccgagaagcagcggacgccccaggacaaccagcuggccuacguggugaucgggauccucacccuggccgccaucaucgccgcgaacgagaugggccugcucgagaccacgaagcgcgaccugggcaugagcaaggagccgggggucgugucccccaccagcuaccuggacguggaccuccaccccgccuccgccuggacccuguacgccgucgcgaccacggugaucacccccaugcugcggcacaccaucgagaacagcaccgccaacgugucccucgccgccaucgccaaccaggcggucgugcugaugggccuggacaagggguggccgaucagcaagauggaccucggcgugccccugcuggcccucgggugcuacucccaggucaacccccugacgcugaccgccgccgugcuccugcugaucacccacuacgccaucaucggccccggccuccaggcgaaggccacccgcgaggcccagaagcggacggccgccgggaucaugaagaacccgaccguggacggcaucaugaccaucgaccuggaccccgucaucuacgacagcaaguucgagaagcagcugggccaggugaugcuccuggugcugugcgcgguccagcuccugcugaugcgcaccuccugggcccucugcgaggcccugacgcuggccaccggccccaucaccacccucugggagggcagccccgggaaguucuggaacacgaccaucgcgguguccauggccaacaucuuccggggcagcuaccuggccggggccggccuggccuucuccaucaugaaguccguggggaccggcaagcgcggcaccgggucccagggcgagacccucggggagaaguggaagaagaagcugaaccagcugagccggaaggaguucgaccucuacaagaaguccggcaucacggaggucgaccgcaccgaggcgaaggaggggcugaagcggggcgagaucacccaccacgccgugucccgcggcagcgccaagcugcagugguucguggagcggaacauggucaucccggaggggcgcgugaucgaccucggcugcgggcggggcgggugguccuacuacugcgccggccugaagaaggugaccgagguccgcggcuacacgaagggcgggcccgggcacgaggagcccgugcccaugagcaccuacggcuggaacaucgugaagcugauguccgggaaggacgucuucuaccucccgcccgagaagugcgacacccugcugugcgacaucggcgagagcucccccagccccaccguggaggagucccggacgauccgcgugcugaagauggucgagccguggcucaagaacaaccaguucugcaucaaggugcugaaccccuacaugcccaccgugaucgagcaccuggagcgccuccagcggaagcacggcgggaugcugguccgcaacccccugagccggaacuccacccacgagauguacuggaucagcaacggcaccgggaacaucguggccuccgugaacauggucagccgccuccugcugaaccgguucacgaugacccaccgccggccgaccaucgagaaggacguggaccucggcgcgggcacccgccacgugaacgccgagcccgagacgcccaacauggacgucaucggggagcggaucaagcgcaucaaggaggagcacaacuccaccuggcacuacgacgacgagaacccguacaagaccugggccuaccacggcagcuacgaggugaaggccaccggguccgccagcuccaugaucaacggcguggucaagcugcugacgaagcccugggacgugguccccauggugacccagauggcgaugaccgacaccacgcccuucgggcagcagcggguguucaaggagaaggucgacacccgcaccccgcggagcaugcccggcacccgccgggugaugggcaucacggccgaguggcucuggcgcacccuggggcggaacaagaagccccgccugugcacccgggaggaguucaccaagaaggugcgcacgaacgccgccaugggcgcggucuucaccgaggagaaccagugggacagcgccaaggccgccguggaggacgaggacuucuggaagcucguggaccgcgagcgggagcugcacaagcuggggaagugcggcuccugcgucuacaacaugauggggaagcgcgagaagaagcucggcgaguucggcaaggccaaggggagccgggcgaucugguacauguggcugggcgcccgcuaccuggaguucgaggcccucggguuccugaacgaggaccacugguucucccgggagaacagcuacuccggcguggagggggagggccugcacaagcucggcuacauccugcgcgacaucagcaagauccccgggggcgccauguacgccgacgacaccgcggggugggacacccggaucacggaggacgaccugcacaacgaggagaagaucacccagcagauggacccggagcaccgccagcucgccaacgccaucuucaagcugaccuaccagaacaagguggucaaggugcagcggcccacccccaccggcacggugauggacaucaucucccgcaaggaccagcggggcagcgggcaggucggcaccuacgggcugaacaccuucaccaacauggaggcccagcucauccgccagauggagggcgagggggugcuguccaaggccgaccuggagaacccccaccucccggagaagaagaucacgcaguggcuggagaccaagggcguggagcggcugaagcgcauggcgaucagcggcgacgacugcgucgugaagcccaucgacgaccgguucgccaacgcccuccuggcccugaacgacauggggaaggugcgcaaggacaucccccaguggcagcccuccaagggcuggcacgacuggcagcaggucccguucugcagccaccacuuccacgagcucaucaugaaggacgggcggaagcugguggugcccugccgcccccaggacgagcugaucggccgggcccgcaucucccagggggcgggcuggagccuccgggagaccgccugccugggcaaggccuacgcccagauguggucccugauguacuuccaccgccgcgaccuccggcuggcgagcaacgccaucugcuccgccguccccgugcacugggugccgaccagccgcacgaccugguccauccacgcccaccaccaguggaugaccaccgaggacaugcugacggucuggaaccggguguggaucgaggacaaccccuggauggaggacaagacccccgugaccaccugggagaacguccccuaccucgggaagcgcgaggaccaguggugcggcagccugaucgggcugacgagccgggccaccugggcgcagaacaucccgaccgccauccagcagguccgcucccucaucggcaacgaggaguuccuggacuacaugcccagcaugaagcgguuccgcaaggaggaggaguccgagggggccaucugguga

SEQ ID NO: 10235 - RNA, 9873 nt, Artificial Sequence
  derived and/or modified CDS sequence (opt1) from DENV-3__FJ850096__SS-prME
accagccugugccucaugaugauccugcccgccgcccuggcguuccaccucaccagccgggacggggagccgcggaugaucguggggaagaacgagcggggcaagagccugcuguucaagaccgccagcgggaucaacaugugcacccucaucgccauggaccugggggagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgugacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucgggcuccugcugaccuggaucggccucaacagcaagaacaccuccaugagcuucuccugcaucgccaucgggaucaucacccuguaccugggcgccguggugcaggccgacauggggugcgucaucaacuggaagggcaaggagcucaagugcggcagcgggaucuucgugacgaacgaggugcacaccuggaccgagcaguacaaguuccaggcggacucccccaagcgccuggccaccgccaucgccggcgccugggagaacggggucugcggcauccgcagcacgacccggauggagaaccugcucuggaagcagaucgcgaacgagcugaacuacauccugugggagaacaacaucaagcucaccgugguggucggggacaucaucggcgugcuggagcagggcaagcgcacccugacgccccagccgauggagcucaaguacuccuggaagaccugggggaaggccaagaucgugaccgccgagacccagaacagcuccuucaucaucgacggccccaacacgcccgagugccccagcgccucccgggcguggaacgucugggagguggaggacuacggguucggcguguucaccaccaacaucuggcugaagcugcgcgaggucuacacccagcucugcgaccaccggcugaugagcgccgccgugaaggacgagcgcgccgugcacgccgacaugggcuacuggaucgagagccagaagaacggguccuggaagcuggagaaggcgagccucaucgaggucaagaccugcacguggccgaagucccacacccuguggagcaacggcgugcuggaguccgacaugaucauccccaagagccucgccgggcccaucucccagcacaacuaccggccgggcuaccacacccagaccgccgggcccuggcaccugggcaagcuggagcucgacuucaacuacugcgagggcacgaccguggucaucaccgagaacugcgggacccgcggccccagccugcggacgaccaccguguccgggaagcugauccacgaguggugcugccgcagcugcacccugccgccccugcgguacaugggcgaggacgggugcugguacggcauggagauccgccccaucuccgagaaggaggagaacauggucaagagccuggucuccgccggcagcggggagguggacaacuucacgaugggcgugcucugccuggccauccuguucgaggaggucaugcgggggaaguucggcaagaagcacaugaucgcggggguguucuucaccuucgugcuccugcuguccggccagaucaccuggcgcgacauggcccacacccucaucaugaucggcagcaacgccuccgaccggauggggaugggcgucacguaccuggcccugaucgccaccuucaagauccagcccuuccucgcgcugggguucuuccugcgcaagcucaccagccgggagaaccugcugcucggcgugggccuggccauggccaccacgcugcagcuccccgaggacaucgagcagauggccaacgggaucgcgcugggccugauggcccucaagcugaucacccaguucgagaccuaccagcuguggaccgcccucaucagccugacgugcuccaacaccaucuucacccugaccguggccuggcgcacggccacccucauccuggcgggggucagccugcuccccgugugccaguccagcuccaugcggaagaccgacuggcugcccaugaccgucgccgccaugggcgugccgccccucccccuguucaucuucagccugaaggacacgcugaagcgccgcuccuggccccucaacgagggggugauggccgucggccuggugagcauccuggccuccagccuccugcggaacgacgugcccauggcgggcccccuggucgccgggggccuccugaucgccugcuacgugaucaccgggaccuccgccgaccugaccguggagaaggccgcggacgucacgugggaggaggaggccgagcagaccggcgugagccacaaccucaugaucaccguggacgacgacgggaccaugcgcaucaaggacgacgagaccgagaacauccugacgguccugcucaagaccgcccugcugaucguguccggcaucuucccguacagcauccccgccacccuccugguguggcacaccuggcagaagcagacgcagcgguccggcguccugugggacgugcccuccccgcccgagacccagaaggccgagcucgaggaggggguguaccgcaucaagcagcagggcaucuucgggaagacccaggucggcgugggggugcagaaggagggcgucuuccacaccauguggcacgugacgcggggcgcggugcugaccuacaacgggaagcgccuggagcccaacugggccuccgucaagaaggaccucaucagcuacggcgggggcuggcggcuguccgcccaguggcagaagggggaggagguccaggugaucgccgucgagcccggcaagaaccccaagaacuuccagaccaugccgggcaccuuccagacgaccaccggggagaucggcgcgaucgcccuggacuucaagcccgggaccagcggcagccccaucaucaaccgcgagggcaaggugguggggcuguacggcaacggggucgugacgaagaacggcggguacguguccggcaucgcccagaccaacgccgagccggacggccccacccccgagcucgaggaggagauguucaagaagcggaaccugaccaucauggaccugcaccccgggagcggcaagacgcgcaaguaccucccggccaucguccgggaggcgaucaagcgccggcugcgcacccugauccucgcccccacccgggugguggccgccgagauggaggaggcccugaaggggcugcccauccgcuaccagaccacggcgaccaaguccgagcacaccggccgggagaucgucgaccucaugugccacgccaccuucacgaugcgccugcugagccccgugcgggugccgaacuacaaccucaucaucauggacgaggcccacuucaccgaccccgccuccaucgccgcgcgcggguacaucagcacccgggucggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucaccgggaagacggugugguucgugcccagcaucaaggccggcaacgacaucgcgaacugccugcggaagaacgggaagaaggucauccagcugucccgcaagaccuucgacaccgaguaccagaagaccaagcucaacgacugggacuucguggugacgaccgacaucagcgagaugggcgccaacuucaaggccgaccgggucaucgacccgcgccggugccugaagcccgugauccugaccgacggccccgagcgcgugauccucgccgggcccaugccggucaccgccgcguccgccgcccagcggcgcggccggguggggcgcaacccccagaaggagaacgaccaguacaucuucaccggccagccccugaacaacgacgaggaccacgcccacuggacggaggccaagaugcugcucgacaacaucaacacccccgaggggaucaucccggcgcuguucgagcccgagcgggagaaguccgccgccaucgacggcgaguaccgccugaagggcgagucccggaagaccuucguggagcucaugcgccgcggggaccugcccgucuggcuggcccacaagguggcgagcgagggcaucaaguacaccgaccgcaaguggugcuucgacgggcagcggaacaaccagauccucgaggagaacauggacgucgagaucuggacgaaggagggcgagaagaagaagcugcgcccccgguggcuggacgcccgcaccuacuccgacccgcucgcccugaaggaguucaaggacuucgccgccggccgcaagagcaucgcgcuggaccucgugaccgagaucgggcgggugcccucccaccuggcccaccgcacccggaacgcccuggacaaccucgucaugcugcacacgagcgagcacggcgggaaggccuaccgccacgccguggaggagcugcccgagaccauggagacccuccugcugcucggccugaugauccugcucaccgggggcgcgaugcuguuccugaucagcggcaaggggaucggcaagacguccaucgggcucaucugcgugaucgccagcuccggcaugcuguggauggccgagaucccgcugcaguggaucgccagcgccaucguccucgaguucuucaugauggugcugcugauccccgagcccgagaagcagcggacgccccaggacaaccagcucgcguacguggucaucgggauccugacccuggccgccaucaucgccgccaacgagaugggccuccuggagaccacgaagcgcgaccugggcauguccaaggagccggggguggugagccccaccuccuaccucgacgucgaccugcaccccgcgagcgccuggacccuguacgccguggccaccacggugaucacccccaugcuccggcacaccaucgagaacuccaccgcgaacgucagccuggccgccaucgccaaccaggccguggugcugaugggccucgacaagggguggccgaucuccaagauggaccugggcgucccccugcucgcgcuggggugcuacagccaggugaacccccugacgcucaccgccgccgugcugcugcucaucacccacuacgccaucaucggccccggccugcaggccaaggcgacccgcgaggcccagaagcggacggccgccgggaucaugaagaacccgaccgucgacggcaucaugaccaucgaccuggaccccgugaucuacgacuccaaguucgagaagcagcucggccaggugaugcugcugguccucugcgccgugcagcugcugcucaugcgcaccagcugggcgcugugcgaggcccugacgcucgccaccggccccaucaccacccugugggagggcucccccgggaaguucuggaacacgaccaucgccgugagcauggcgaacaucuuccggggcuccuaccuggccggggccggccucgccuucagcaucaugaaguccgucgggaccggcaagcgcggcaccgggagccagggcgagacccugggggagaaguggaagaagaagcugaaccagcucagccggaaggaguucgaccuguacaagaaguccggcaucacggagguggaccgcaccgaggccaaggaggggcugaagcggggcgagaucacccaccacgcggugagccgcggcuccgccaagcuccagugguucgucgagcggaacauggugaucccggaggggcgcgugaucgaccugggcugcgggcggggcggguggagcuacuacugcgccggccugaagaaggucaccgaggugcgcggcuacacgaagggcgggcccgggcacgaggagcccgugcccauguccaccuacggcuggaacaucgucaagcucaugagcgggaaggacguguucuaccugccgcccgagaagugcgacacccugcugugcgacaucggcgaguccagccccucccccaccguggaggagagccggacgauccgcguccucaagaugguggagccguggcugaagaacaaccaguucugcaucaaggugcugaaccccuacaugcccaccgucaucgagcaccucgagcgccugcagcggaagcacggcgggaugcuggugcgcaacccccucucccggaacagcacccacgagauguacuggaucuccaacggcaccgggaacaucguggccagcgucaacauggugucccgccugcugcucaaccgguucacgaugacccaccgccggccgaccaucgagaaggacguggaccugggcgccggcacccgccacgucaacgcggagcccgagacgcccaacauggacgugaucggggagcggaucaagcgcaucaaggaggagcacaacagcaccuggcacuacgacgacgagaacccguacaagaccugggccuaccacggcuccuacgaggugaaggccaccgggagcgccuccagcaugaucaacggcgucgugaagcugcucacgaagcccugggacgucgugcccauggugacccagauggccaugaccgacaccacgcccuucgggcagcagcgggucuucaaggagaagguggacacccgcaccccgcggagcaugcccggcacccgccgggugaugggcaucacggcggaguggcuguggcgcacccuggggcggaacaagaagccccgccucugcacccgggaggaguucaccaagaagguccgcacgaacgccgccaugggcgccguguucaccgaggagaaccagugggacuccgcgaaggccgccguggaggacgaggacuucuggaagcuggucgaccgcgagcgggagcugcacaagcucgggaagugcggcagcugcguguacaacaugauggggaagcgcgagaagaagcugggcgaguucggcaaggccaaggggucccgggccaucugguacauguggcugggcgcgcgcuaccucgaguucgaggcccugggguuccugaacgaggaccacugguucagccgggagaacuccuacagcggcguggagggggagggccuccacaagcugggcuacauccugcgcgacaucuccaagauccccgggggcgccauguacgccgacgacaccgccgggugggacacccggaucacggaggacgaccuccacaacgaggagaagaucacccagcagauggacccggagcaccgccagcuggcgaacgccaucuucaagcugaccuaccagaacaaggucgugaaggugcagcggcccacccccaccggcacggucauggacaucaucagccgcaaggaccagcggggcuccggccaggugggcaccuacgggcucaacaccuucaccaacauggaggcccagcugauccgccagauggagggcgagggggugcugagcaaggccgaccucgagaacccccaccucccggagaagaagaucacgcaguggcuggagaccaagggcgucgagcggcucaagcgcauggccaucuccggcgacgacugcguggugaagcccaucgacgaccgguucgcgaacgcccugcuggcccucaacgacauggggaagguccgcaaggacaucccccaguggcagcccagcaagggcuggcacgacuggcagcaggucccguucugcucccaccacuuccacgagcugaucaugaaggacgggcggaagcuggugguccccugccgcccccaggacgagcucaucggccgggcccgcaucagccagggggccggcuggucccugcgggagaccgcgugccugggcaaggccuacgcccagauguggagccucauguacuuccaccgccgcgaccugcggcuggccuccaacgcgaucugcagcgccgugcccgugcacugggucccgaccucccgcacgaccuggagcauccacgcccaccaccaguggaugaccaccgaggacaugcucacgguguggaaccggguguggaucgaggacaaccccuggauggaggacaagacccccgucaccaccugggagaacgugcccuaccuggggaagcgcgaggaccaguggugcggcagccugaucgggcucacgucccgggccaccugggcccagaacaucccgaccgcgauccagcagguccgcagccugaucggcaacgaggaguuccuggacuacaugcccuccaugaagcgguuccgcaaggaggaggagagcgagggggccaucugguga

SEQ ID NO: 10236 - RNA, 9873 nt, Artificial Sequence
  derived and/or modified CDS sequence (opt1) from DENV-3__FJ882578__SS-prME
accagccugugccucaugaugauccugcccgccgcccuggcguuccaccucaccagccgggacggggagccccggaugaucguggggaagaacgagcggggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcggagcgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaccaucggcgugcucgagcagggcaagcgcauccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaaguccgagcacaccggccgggagaucguggaccugaugugccacgccaccuucacgaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucguccccagcaucaaggcgggcaacgacaucgccaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggugaccgagaucgggcggguccccacccaccucgcccaccgcacccggaacgcccuggacaaccuggugaugcuccacacguccgagcacggcgggaaggccuaccgccacgcgguggaggagcugcccgagaccauggagacccugcuccugcugggccucaugauccugcugaccgggggcgccaugcuguuccugaucagcggcaaggggaucggcaagacgagcaucgggcugaucugcgucaucgccuccagcggcaugcucuggauggccgagaucccgcugcaguggaucgccuccgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccacgaagcgcgaccugggcaugagcaaggagccggggguggucucccccaccagcuaccuggacguggaccuccaccccgccuccgccuggacccuguacgccguggcgaccacggucaucacccccaugcugcggcacaccaucgagaacagcaccgccaacgugucccucgccgccaucgccaaccaggcggugguccugaugggccuggacaagggguggccgaucagcaagauggaccucggcgugccccugcuggcccucgggugcuacucccaggugaacccccugacgcugaccgccgccguccuccugcugaucacccacuacgccaucaucggccccggccuccaggcgaaggccacccgcgaggcccagaagcggacggccgccgggaucaugaagaacccgaccguggacggcaucaugaccaucgaccuggaccccgugaucuacgacagcaaguucgagaagcagcuggggcaggucaugcuccuggugcugugcgcggugcagcuccugcugaugcgcaccuccugggcccucugcgaggcccugacgcuggccaccggccccaucaccacccucugggagggcagccccgggaaguucuggaacacgaccaucgcggucuccauggccaacaucuuccggggcagcuaccuggccggggccggccuggccuucuccaucaugaaguccguggggaccggcaagcgcggcaccgggucccagggcgagacccucggggagaaguggaagaagaagcugaaccagcugagccggaaggaguucgaccucuacaagaaguccggcaucacggagguggaccgcaccgaggcgaaggaggggcugaagcggggcgagaucacccaccacgccgucucccgcggcagcgccaagcugcagugguucguggagcggaacauggugaucccggaggggcgcgucaucgaccucggcugcgggcggggcgggugguccuacuacugcgccggccugaagaaggugaccgaggugcgcggcuacacgaagggcgggcccgggcacgaggagcccguccccaugagcaccuacggcuggaacaucgugaagcugauguccgggaaggacguguucuaccucccgcccgagaagugcgacacccugcugugcgacaucggcgagagcucccccagccccaccgucgaggagucccggacgauccgcgugcugaagaugguggagccguggcucaagaacaaccaguucugcaucaagguccugaaccccuacaugcccaccgugaucgagcaccuggagcgccuccagcggaagcacggcgggaugcuggugcgcaacccccugagccggaacuccacccacgagauguacuggaucagcaacggcaccgggaacaucgucgccuccgugaacauggugagccgccuccugcugaaccgguucacgaugacccaccgccggccgaccaucgagaaggacgucgaccucggcgcgggcacccgccacgugaacgccgagcccgagacgcccaacauggacgugaucggggagcggaucaagcgcaucaaggaggagcacaacuccaccuggcacuacgacgacgagaacccguacaagaccugggccuaccacggcagcuacgaggucaaggccaccggguccgccagcuccaugaucaacggcguggucaagcugcugacgaagcccugggacguggugcccauggucacccagauggcgaugaccgacaccacgcccuucgggcagcagcggguguucaaggagaagguggacacccgcaccccgcggagcaugcccggcacccgccgggucaugggcaucacggccgaguggcucuggcgcacccuggggcggaacaagaagccccgccugugcacccgggaggaguucaccaagaaggugcgcacgaacgccgccaugggcgcgguguucaccgaggagaaccagugggacagcgccaaggccgccgucgaggacgaggacuucuggaagcucguggaccgcgagcgggagcugcacaagcuggggaagugcggcuccugcguguacaacaugauggggaagcgcgagaagaagcucggcgaguucggcaaggccaaggggagccgggcgaucugguacauguggcugggcgcccgcuaccuggaguucgaggcccucggguuccugaacgaggaccacugguucucccgggagaacagcuacuccggcgucgagggggagggccugcacaagcucggcuacauccugcgcgacaucagcaagauccccgggggcgccauguacgccgacgacaccgcggggugggacacccggaucacggaggacgaccugcacaacgaggagaagaucacccagcagauggacccggagcaccgccagcucgccaacgccaucuucaagcugaccuaccagaacaagguggugaagguccagcggcccacccccaccggcacggugauggacaucaucucccgcaaggaccagcggggcagcggccaggugggcaccuacgggcugaacaccuucaccaacauggaggcccagcucauccgccagauggagggcgaggggguccuguccaaggccgaccuggagaacccccaccucccggagaagaagaucacgcaguggcuggagaccaagggcguggagcggcugaagcgcauggcgaucagcggcgacgacugcguggucaagcccaucgacgaccgguucgccaacgcccuccuggcccugaacgacauggggaaggugcgcaaggacaucccccaguggcagcccuccaagggcuggcacgacuggcagcaggucccguucugcagccaccacuuccacgagcucaucaugaaggacgggcggaagcuggucgugcccugccgcccccaggacgagcugaucggccgggcccgcaucucccagggggcgggcuggagccuccgggagaccgccugccugggcaaggccuacgcccagauguggucccugauguacuuccaccgccgcgaccuccggcuggcgagcaacgccaucugcuccgccgugcccguccacugggugccgaccagccgcacgaccugguccauccacgcccaccaccaguggaugaccaccgaggacaugcugacgguguggaaccgggucuggaucgaggacaaccccuggauggaggacaagacccccgugaccaccugggagaacgugcccuaccucgggaagcgcgaggaccaguggugcggcagccugaucgggcugacgagccgggccaccugggcgcagaacaucccgaccgccauccagcagguccgcucccucaucggcaacgaggaguuccuggacuacaugcccagcaugaagcgguuccgcaaggaggaggaguccgagggggccaucugguga

SEQ ID NO: 10237 - RNA, 9873 nt, Artificial Sequence
  derived and/or modified CDS sequence (opt1) from DENV-3__FJ639770__SS-prME
accagccugugccucaugaugauccugcccgccgcccuggcguuccaccucaccagccgggacggggagccccggaugaucguggggaagaacgagcgcggcaagagccugcuguucaagacggccagcgggaucaacaugugcacccucaucgccauggaccugggggagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaagguggagacgugggcccugcgccaccccggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugcccgaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacgugaucggcguccucgagcagggcaagcgcacccugacgcugcagcccauggagcucaaguacuccuggaagaccugggggaaggccaagaucgugaccgccgagacccagaacagcuccuucaucaucgacggcccgaacacgcccgagugccccagcgccucccgggcguggaacgugugggaggucgaggacuacggguucggcguguucaccaccaacaucuggcugaagcugcgcgagguguacacccagcucugcgaccaccggcugaugagcgccgccgucaaggacgagcgcgccgugcacgccgacaugggcuacuggaucgagagccagaagaacggguccuggaagcuggagaaggcgagccucaucgaggugaagaccugcacguggcccaagucccacacccuguggagcaacggcguccuggaguccgacaugaucauccccaagagccucgccgggcccaucucccagcacaacuaccggcccggcuaccacacccagaccgccgggccguggcaccugggcaagcuggagcucgacuucaacuacugcgagggcacgaccguggugaucaccgagaacugcgggacccgcggccccagccugcggacgaccaccgucuccgggaagcugauccacgaguggugcugccgcagcugcacccugccgccccuccgguacaugggcgaggacgggugcugguacggcauggagauccgcccgaucuccgagaaggaggagaacauggucaagagccugguguccgccggcagcggggaggucgacaacuucacgaugggcgugcucugccuggccauccuguucgaggaggugaugcgggggaaguucggcaagaagcacaugaucgcgggggucuucuucaccuucgugcuccugcuguccggccagaucaccuggcgcgacauggcccacacccucaucaugaucggcagcaacgccuccgaccggauggggaugggcgugacguaccuggcccugaucgccaccuucaagauccagcccuuccucgcgcugggguucuuccugcgcaagcucaccagccgggagaaccugcugcucggcgucggccuggccauggccaccacgcugcagcuccccgaggacaucgagcagauggccaacgggaucgcgcugggccugauggcccucaagcugaucacccaguucgagaccuaccagcuguggaccgcccucaucagccugacgugcuccaacaccaucuucacccugaccguggccuggcgcacggccacccucauccuggcgggggucagccugcuccccgugugccaguccagcuccaugcggaagaccgacuggcugccgaugaccguggccgccaugggcgugccgccccugccccucuucaucuucagccugaaggacacgcugaagcgccgcuccuggccgcucaacgagggggugauggccgugggccuggucagcauccuggccuccagccuccugcggaacgacgugcccauggcgggcccccugguggccgggggccuccugaucgccugcuacgucaucaccgggaccuccgccgaccugaccguggagaaggccgcggacgugacgugggaggaggaggccgagcagaccggcgucagccacaaccucaugaucaccguggacgacgacgggaccaugcgcaucaaggacgacgagaccgagaacauccugacggugcugcucaagaccgcccugcugaucgucuccggcaucuuccccuacagcaucccggccacccuccugguguggcacaccuggcagaagcagacgcagcgguccggcgugcugugggacguccccuccccgcccgagacccagaaggccgagcucgaggaggggguguaccgcaucaagcagcagggcaucuucgggaagacccaggugggcgucggggugcagaaggagggcguguuccacaccauguggcacgucacgcggggcgcggugcugaccuacaacgggaagcgccuggagccgaacugggccuccgugaagaaggaccucaucagcuacggcgggggcuggcggcuguccgcccaguggcagaagggggaggagguccaggugaucgccguggagcccggcaagaaccccaagaacuuccagaccaugcccggcaccuuccagacgaccaccggggagaucggcgcgaucgcccuggacuucaagccggggaccagcggcagccccaucaucaaccgcgagggcaaggucguggggcuguacggcaacgggguggucacgaagaacggcggguacguguccggcaucgcccagaccaacgccgagcccgacggcccgacccccgagcucgaggaggagauguucaagaagcggaaccugaccaucauggaccugcaccccgggagcggcaagacgcgcaaguaccuccccgccaucgugcgggaggcgaucaagcgccggcugcgcacccugauccucgccccgacccgggucguggccgccgagauggaggaggcccugaaggggcugcccauccgcuaccagaccacggcgaccaaguccgagcacaccggccgggagaucguggaccucaugugccacgccaccuucacgaugcgccugcugagccccguccgggugcccaacuacaaccucaucaucauggacgaggcccacuucaccgacccggccuccaucgccgcgcgcggguacaucagcacccgggugggcaugggcgaggccgccgccaucuucaugaccgcgacgccgcccgggaccgccgacgccuucccccaguccaacgccccgauccaggacgaggagcgcgacauccccgagcgcagcuggaacuccggcaacgaguggaucaccgacuucgccgggaagaccgucugguucgugcccagcaucaaggcgggcaacgacaucgccaacugccugcggaagaacgggaagaaggugauccagcugucccgcaagacguucgacaccgaguaccagaagaccaagcucaacgacugggacuucgucgugaccacggacaucagcgagaugggcgccaacuucaaggccgaccgggugaucgacccccgccggugccugaagccggucauccugaccgacggccccgagcgcgugauccucgccgggcccaugcccgugaccgcggccuccgccgcccagcggcgcggccgggucgggcgcaacccgcagaaggagaacgaccaguacaucuucaccggccagccccugaacaacgacgaggaccacgcccacuggaccgaggcgaagaugcugcucgacaacaucaacacgcccgaggggaucauccccgcccuguucgagccggagcgggagaaguccgccgccaucgacggcgaguaccgccugaagggcgagucccggaagaccuucguggagcucaugcgccgcggggaccugcccgucuggcuggcgcacaagguggccagcgagggcaucaaguacaccgaccgcaaguggugcuucgacgggcagcggaacaaccagauccucgaggagaacauggacguggagaucuggaccaaggagggcgagaagaagaagcugcgcccccgguggcuggacgcccgcacguacuccgacccccucgcccugaaggaguucaaggacuucgccgcgggccgcaagagcaucgcccuggaccucgucaccgagaucgggcgggugccgucccaccuggcccaccgcacccggaacgcccuggacaaccucgugaugcugcacaccagcgagcacggcgggaaggccuaccgccacgcggucgaggagcugcccgagacgauggagacccuccugcugcucggccugaugauccugcucaccgggggcgccaugcuguuccugaucagcggcaaggggaucggcaagaccuccaucgggcucaucugcgugaucgccagcuccggcaugcuguggauggccgagaucccccugcaguggaucgccagcgcgaucgugcucgaguucuucaugaugguccugcugaucccggagcccgagaagcagcggacgccccaggacaaccagcucgccuacguggugaucgggauccugacccuggccgccaucaucgccgcgaacgagaugggccuccuggagaccaccaagcgcgaccugggcauguccaaggagcccggggucgugagcccgacguccuaccucgacguggaccugcaccccgccagcgccuggacccuguacgccgucgcgaccaccgugaucacgcccaugcuccggcacaccaucgagaacuccaccgccaacgugagccuggccgccaucgccaaccaggcggucgugcugaugggccucgacaagggguggcccaucuccaagauggaccugggcgugccgcugcucgcccuggggugcuacagccaggucaacccccugacccucacggccgccgugcugcugcucaucacccacuacgccaucaucggccccggccugcaggcgaaggccacccgcgaggcccagaagcggaccgccgccgggaucaugaagaaccccacgguggacggcaucaugaccaucgaccuggacccggucaucuacgacuccaaguucgagaagcagcucggccaggugaugcugcuggugcucugcgcgguccagcugcugcucaugcgcaccagcugggcccugugcgaggcccugacccucgccacgggccccaucaccacccugugggagggcucccccgggaaguucuggaacaccacgaucgcggugagcauggccaacaucuuccggggcuccuaccuggccggggccggccucgccuucagcaucaugaaguccguggggaccggcaagcgcggcaccgggagccagggcgagacccugggggagaaguggaagaagaagcugaaccagcucagccggaaggaguucgaccuguacaagaaguccggcaucaccgaggucgaccgcacggaggcgaaggaggggcugaagcggggcgagaucacccaccacgccgugagccgcggcuccgccaagcuccagugguucguggagcggaacauggucauccccgaggggcgcgugaucgaccugggcugcgggcggggcggguggagcuacuacugcgccggccugaagaaggugaccgagguccgcggcuacaccaagggcgggccggggcacgaggagcccgugcccauguccacguacggcuggaacaucgugaagcucaugagcgggaaggacgucuucuaccugcccccggagaagugcgacacccugcugugcgacaucggcgaguccagccccucccccaccguggaggagagccggaccauccgcgugcucaagauggucgagcccuggcugaagaacaaccaguucugcaucaaggugcugaacccguacaugcccacgguggucgagcaccucgagcgccugcagcggaagcacggcgggaugcuggugcgcaacccccucucccggaacagcacccacgagauguacuggaucuccaacggcaccgggaacaucguggccagcgucaacauggugucccgccugcugcucaaccgguucaccaugacgcaccgccggcccaccaucgagaaggacguggaccugggcgcgggcacccgccacgucaacgccgagccggagacccccaacauggacgugaucggggagcggaucaagcgcaucaaggaggagcacaacagcacguggcacuacgacgacgagaaccccuacaagaccugggccuaccacggcuccuacgaggucaaggccaccgggagcgccuccagcaugaucaacggcguggugaagcugcucaccaagccgugggacgucgugcccauggugacgcagauggcgaugaccgacaccacccccuucgggcagcagcgggucuucaaggagaagguggacacgcgcacgccccggagcaugccgggcacccgccgggugaugggcaucaccgccgaguggcuguggcgcacccuggggcggaacaagaagccccgccucugcacccgggaggaguucaccaagaagguccgcaccaacgccgccaugggcgcgguguucacggaggagaaccagugggacuccgccaaggccgccguggaggacgaggacuucuggaagcuggucgaccgcgagcgggagcugcacaagcucgggaagugcggcagcugcguguacaacaugauggggaagcgcgagaagaagcugggcgaguucggcaaggccaaggggucccgggcgaucugguacauguggcugggcgcccgcuaccucgaguucgaggcccugggguuccugaacgaggaccacugguucagccgggagaacuccuacagcggcguggagggggagggccuccacaagcugggcuacauccugcgcgacaucuccaagauccccgggggcgccauguacgccgacgacaccgcggggugggacacccggaucaccgaggacgaccuccacaacgaggagaagaucacgcagcagauggaccccgagcaccgccagcuggccaacgccaucuucaagcugaccuaccagaacaaggucgugaaggugcagcggccgacccccaccggcaccgucauggacaucaucagccgcaaggaccagcggggcuccggccaggugggcacguacgggcucaacaccuucaccaacauggaggcccagcugauccgccagauggagggcgagggggugcugagcaaggccgaccucgagaacccccggcugcccgagaagaagaucacccaguggcuggagacgaagggcgucgagcgccucaagcggauggcgaucuccggcgacgacugcguggugaagccgaucgacgaccgcuucgccaacgcccugcuggcccucaacgacauggggaagguccggaaggacaucccccaguggcagcccagcaagggcuggcacgacuggcagcagguccccuucugcucccaccacuuccacgagcugaucaugaaggacgggcgcaagcugguggucccgugccggccccaggacgagcucaucggccgcgcccggaucagccagggggcgggcuggucccugcgcgagaccgccugccugggcaaggccuacgcccagauguggagccucauguacuuccaccgccgggaccugcgccuggcguccaacgccaucugcagcgccgugcccgugcacuggguccccaccucccggaccacguggagcauccacgcccaccaccaguggaugaccaccgaggacaugcucaccguguggaaccgcguguggaucgaggacaacccguggauggaggacaagacgcccgucaccaccugggagaacgugcccuaccuggggaagcgggaggaccaguggugcggcagccugaucgggcucaccucccgcgccacgugggcgcagaacauccccaccgccauccagcagguccggagccugaucggcaacgaggaguuccuggacuacaugccguccaugaagcgcuuccggaaggaggaggagagcgagggggccaucugguga

SEQ ID NO: 10238 - RNA, 9873 nt, Artificial Sequence
  derived and/or modified CDS sequence (opt1) from DENV-3__FJ639771__SS-prME
accagccugugccucaugaugauccugcccgccgcccuggcguuccaccucaccagccgggacggggagccccggaugaucguggggaagaacgagcgcggcaagagccugcuguucaagacggccuccgggaucaacaugugcacccucaucgccauggaccugggggagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugcgcgagaacaacaucaagcugaccguggucgugggggacgugaucggcguccucgagcagggcaagcggacccugacgccccagccgauggagcugaaguacuccuggaagaccugggggaaggccaagaucgugaccgccgagacccagaacagcuccuucaucaucgacggccccaacacgcccgagugccccagcgccucccgcgcguggaacgugugggaggucgaggacuacggguucggcguguucaccaccaacaucuggcucaagcugcgggagguguacacccagcugugcgaccaccgccucaugagcgccgccgucaaggacgagcgggccgugcacgccgacaugggcuacuggaucgagagccagaagaacggguccuggaagcuggagaaggcgagccugaucgaggugaagaccugcacguggccgaagucccacacccucuggagcaacggcguccuggaguccgacaugaucauccccaagagccuggccgggcccaucucccagcacaacuaccgcccgggcuaccacacccagaccgccgggcccuggcaccucggcaagcuggagcuggacuucaacuacugcgagggcacgaccguggugaucaccgagaacugcgggacccggggccccagccuccgcacgaccaccgucuccgggaagcugauccacgaguggugcugccggagcugcacccugcccccgcuccgcuacaugggcgaggacgggugcugguacggcauggagauccggcccaucuccgagaaggaggagaacauggucaagagccugguguccgccggcagcggggaggucgacaacuucacgaugggcgugcugugccucgccauccuguucgaggaggugaugcgcgggaaguucggcaagaagcacaugaucgcgggggucuucuucaccuucgugcugcuccuguccggccagaucaccuggcgggacauggcccacacccugaucaugaucggcagcaacgccuccgaccgcauggggaugggcgugacguaccucgcccugaucgccaccuucaagauccagcccuuccuggcgcucggguucuuccugcggaagcugaccagccgcgagaaccuccugcugggcgucggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccguggccuggcggacggccacccugauccucgcgggggucagccugcugccggugugccaguccagcuccaugcgcaagaccgacuggcuccccaugaccguggccgccaugggcgugccgccccucccgcuguucaucuucagccucaaggacacgcugaagcgccgguccuggccccugaacgagggggugauggccgugggccucgucagcauccuggccuccagccugcuccgcaacgacgugcccauggcgggcccccugguggccgggggccugcucaucgccugcuacgucaucaccgggaccuccgccgaccugaccguggagaaggccgcggacgugacgugggaggaggaggccgagcagaccggcgucagccacaaccugaugaucaccguggacgacgacgggaccaugcggaucaaggacgacgagaccgagaacauccucacggugcugcugaagaccgcccuccugaucgucuccggcaucuucccguacagcauccccgccacccugcucguguggcacaccuggcagaagcagacgcagcgcuccggcgugcugugggacguccccagcccgcccgagacccagaaggccgagcuggaggaggggguguaccggaucaagcagcagggcaucuucgggaagacccaggugggcgucggggugcagaaggagggcguguuccacaccauguggcacgucacgcgcggcgcggugcucaccuacaacgggaagcggcuggagcccaacugggccuccgugaagaaggaccugaucagcuacggcgggggcuggcgccucuccgcccaguggcagaagggggaggagguccaggugaucgccguggagcccggcaagaaccccaagaacuuccagaccaugcccggcaccuuccagacgaccaccggggagaucggcgcgaucgcccuggacuucaagcccgggaccagcggcagccccaucaucaaccgggagggcaaggucguggggcuguacggcaacgggguggucacgaagaacggcggguacguguccggcaucgcccagaccaacgccgagccggacggccccacccccgagcuggaggaggagauguucaagaagcgcaaccucaccaucauggaccugcaccccgggagcggcaagacgcggaaguaccugccggccaucgugcgcgaggcgaucaagcggcgccuccggacccugauccuggcccccacccgcgucguggccgccgagauggaggaggcccucaaggggcugcccauccgguaccagaccacggcgaccaaguccgagcacaccggccgcgagaucguggaccugaugugccacgccaccuucacgaugcggcuccugagccccguccgcgugccgaacuacaaccugaucaucauggacgaggcccacuucaccgaccccgccuccaucgccgcgcggggguacaucagcacccgcgugggcaugggcgaggccgccgccaucuucaugaccgcgacgccgcccgggaccgccgacgccuucccgcaguccaacgcccccauccaggacgaggagcgcgacauccccgagcggagcuggaacuccggcaacgaguggaucaccgacuucgccgggaagaccgucugguucgugcccagcaucaaggcgggcaacgacaucgccaacugccuccgcaagaacgggaagaaggugauccagcugucccggaagacguucgacaccgaguaccagaagaccaagcugaacgacugggacuucgucgugaccacggacaucagcgagaugggcgccaacuucaaggccgaccgcgugaucgacccgcggcgcugccucaagcccgucauccugaccgacggccccgagcgggugauccuggccgggcccaugccggugaccgcggccuccgccgcccagcgccggggccgcgucgggcggaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgcgagaaguccgccgccaucgacggcgaguaccggcugaagggcgagucccgcaagaccuucguggagcugaugcggcgcggggaccuccccgucuggcuggcgcacaagguggccagcgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcccgcacguacuccgacccgcuggcccucaaggaguucaaggacuucgccgcgggccgcaagagcaucgcccuggaccuggucaccgagaucgggcgcgugcccucccaccucgcccaccggacccgcaacgcccuggacaaccuggugaugcuccacaccagcgagcacggcgggaaggccuaccggcacgcggucgaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggccuccuguggauggccgagaucccgcugcaguggaucgccagcgcgaucgugcucgaguucuucaugaugguccugcugauccccgagcccgagaagcagcgcacgccccaggacaaccagcucgccuacguggugaucgggauccugacccuggccgccaucaucgccgcgaacgagaugggccuccuggagaccaccaagcgggaccugggcauguccaaggagccgggggucgugagccccacguccuaccucgacguggaccugcaccccgccagcgccuggacccuguacgccgucgcgaccaccgugaucacgcccaugcuccgccacaccaucgagaacuccaccgccaacgugagccuggccgccaucgccaaccaggcggucgugcugaugggccucgacaagggguggccgaucuccaagauggaccugggcgugccccugcucgcccuggggugcuacagccaggucaacccccugacccucacggccgccgugcugcugcucaucacccacuacgccaucaucggccccggccugcaggcgaaggccacccgggaggcccagaagcgcaccgccgccgggaucaugaagaacccgacgguggacggcaucaugaccaucgaccuggaccccgucaucuacgacuccaaguucgagaagcagcucggccaggugaugcugcuggugcucugcgcgguccagcugcugcucaugcggaccagcugggcccugugcgaggcccugacccucgccacgggccccaucaccacccugugggagggcucccccgggaaguucuggaacaccacgaucgcggugagcauggccaacaucuuccgcggcuccuaccuggccggggccggccucgccuucagcaucaugaaguccguggggaccggcaagcggggcaccgggagccagggcgagacccugggggagaaguggaagaagaagcugaaccagcucagccgcaaggaguucgaccuguacaagaaguccggcaucaccgaggucgaccggacggaggcgaaggaggggcugaagcgcggcgagaucacccaccacgccgugagccggggcuccgccaagcuccagugguucguggagcgcaacauggucaucccggaggggcgggugaucgaccugggcugcgggcgcggcggguggagcuacuacugcgccggccugaagaaggugaccgagguccggggcuacaccaagggcgggcccgggcacgaggagcccgugcccauguccacguacggcuggaacaucgugaagcucaugagcgggaaggacgucuucuaccugccgcccgagaagugcgacacccugcugugcgacaucggcgaguccagccccucccccaccguggaggagagccgcaccauccgcgugcucaagauggucgagccguggcugaagaacaaccaguucugcaucaaggugcugaaccccuacaugcccacgguggucgagcaccucgagcggcugcagcgcaagcacggcgggaugcuggugcggaacccccucucccgcaacagcacccacgagauguacuggaucuccaacggcaccgggaacaucguggccagcgucaacauggugucccggcugcugcucaaccgcuucaccaugacgcaccggcgcccgaccaucgagaaggacguggaccugggcgcgggcacccggcacgucaacgccgagcccgagacccccaacauggacgugaucggggagcgcaucaagcggaucaaggaggagcacaacagcacguggcacuacgacgacgagaacccguacaagaccugggccuaccacggcuccuacgaggucaaggccaccgggagcgccuccagcaugaucaacggcguggugaagcugcucaccaagcccugggacgucgugcccauggugacgcagauggcgaugaccgacaccacccccuucgggcagcagcgcgucuucaaggagaagguggacacgcggaccccgcgcagcaugcccggcacccggcgcgugaugggcaucaccgccgaguggcuguggcggacgcuggggcgcaacaagaagccccggcucugcacccgcgaggaguucaccaagaagguccgcaccaacgccgccaugggcgcgguguucacggaggagaaccagugggacuccgccaaggccgccguggaggacgaggacuucuggaagcuggucgaccgggagcgcgagcugcacaagcucgggaagugcggcagcugcguguacaacaugauggggaagcgggagaagaagcugggcgaguucggcaaggccaaggggucccgcgcgaucugguacauguggcugggcgcccgguaccucgaguucgaggcccugggguuccugaacgaggaccacugguucagccgcgagaacuccuacagcggcguggagggggagggccuccacaagcugggcuacauccugcgggacaucuccaagauccccgggggcgccauguacgccgacgacaccgcggggugggacacccgcaucaccgaggacgaccuccacaacgaggagaagaucacgcagcagauggacccggagcaccggcagcuggccaacgccaucuucaagcugaccuaccagaacaaggucgugaaggugcagcgccccacccccaccggcaccgucauggacaucaucagccggaaggaccagcgcggcuccggccaggugggcacguacgggcucaacaccuucaccaacauggaggcccagcugauccggcagauggagggcgagggggugcugagcaaggccgaccucgagaacccccgccugccggagaagaagaucacccaguggcuggagacgaagggcgucgagcggcucaagcgcauggcgaucuccggcgacgacugcguggugaagcccaucgacgaccgguucgccaacgcccugcuggcccucaacgacauggggaagguccgcaaggacaucccccaguggcagcccagcaagggcuggcacgacuggcagcaggucccguucugcucccaccacuuccacgagcugaucaugaaggacgggcggaagcuggugguccccugccgcccccaggacgagcucaucggccgggcccgcaucagccagggggcgggcuggucccugcgcgagaccgccugccugggcaaggccuacgcccagauguggagccucauguacuuccaccggcgcgaccugcggcuggcguccaacgccaucugcagcgccgugcccgugcacugggucccgaccucccgcaccacguggagcauccacgcccaccaccaguggaugaccaccgaggacaugcucaccguguggaaccggguguggaucgaggacaaccccuggauggaggacaagacgcccgucaccaccugggagaacgugcccuaccuggggaagcgcgaggaccaguggugcggcagccugaucgggcucaccucccgggccacgugggcgcagaacaucccgaccgccauccagcagguccgcagccugaucggcaacgaggaguuccuggacuacaugcccuccaugaagcgguuccgcaaggaggaggagagcgagggggccaucugguga

SEQ ID NO: 10239 - RNA, 9873 nt, Artificial Sequence
  derived and/or modified CDS sequence (opt1) from DENV-3__FJ639772__SS-prME
accagccugugccucaugaugauccugcccgccgcccuggcguuccaccucaccucccgggacggggagccgcggaugaucguggggaagaacgagcggggcaagagccugcuguucaagaccgccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgcgucccgggccuggaacgucugggagguggaggacuacggguucggcguguucaccaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccguggucaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcggggagguggacaacuucacgaugggcgugcugugccucgcgauccuguucgaggaggucaugcgggggaaguucggcaagaagcacaugaucgccgggguguucuucaccuucgugcugcuccuguccggccagaucaccuggcgcgacauggcccacacccugaucaugaucggcagcaacgccuccgaccggauggggaugggcgucacguaccucgcccugaucgcgaccuucaagauccagcccuuccuggcccucggguucuuccugcgcaagcugaccagccgggagaaccuccugcugggcgugggccucgccauggccaccacgcugcagcugcccgaggacaucgagcagauggcgaacgggaucgcccucggccugauggcccugaagcucaucacccaguucgagaccuaccagcuguggaccgcccugaucagccucacgugcuccaacaccaucuucacccugaccguggccuggcgcacggcgacccugauccucgccggggucagccugcugccggugugccaguccagcuccaugcggaagaccgacuggauccccaugaccgucgccgccaugggcgugccgccccucccgcuguucaucuucagccugaaggacacgcucaagcgccgcuccuggccccugaacgagggggugauggccgucggccuggugagcauccucgcguccagccugcugcggaacgacgugcccauggccggcccccucgucgccgggggccugcugaucgccugcuacgugaucaccgggaccuccgccgaccucaccguggagaaggcggccgacgucacgugggaggaggaggccgagcagaccggcgugagccacaaccugaugaucaccguggacgacgacgggaccaugcgcaucaaggacgacgagaccgagaacauccugacgguccuccugaagaccgcccugcucaucguguccggcaucuucccguacagcauccccgccacccugcugguguggcacaccuggcagaagcagacgcagcgguccggcguccucugggacgugcccagcccgcccgagacccagaaggcggagcuggaggaggggguguaccgcaucaagcagcagggcaucuucgggaagacccaggucggcgugggggugcagaaggagggcgucuuccacaccauguggcacgugacgcggggcgccgugcugaccuacaacgggaagcgccucgagcccaacugggccuccgucaagaaggaccugaucagcuacggcgggggcuggcggcuguccgcccaguggcagaagggggaggagguccaggugaucgcggucgagcccggcaagaaccccaagaacuuccagaccaugcccggcaccuuccagacgaccaccggggagaucggcgccaucgcccucgacuucaagcccgggaccagcggcagccccaucaucaaccgcgagggcaagaucguggggcuguacggcaacgggguggucacgaagaacggcggguacguguccggcaucgcccagaccaacgccgagccggacggccccacccccgagcuggaggaggagauguucaagaagcggaaccugaccaucauggaccuccaccccgggagcggcaagacgcgcaaguaccugccggcgaucgugcgggaggccaucaagcgccggcugcgcacccucauccuggcccccacccgggucguggccgccgagauggaggaggcgcugaaggggcuccccauccgcuaccagaccuccgccaccaagagcgagcacacgggccgggagaucguggaccugaugugccacgccaccuucaccaugcgccugcucucccccguccgggugccgaacuacaaccugaucaucauggacgaggcccacuucacggaccccgccagcaucgcggcccgcggguacaucuccacccgggugggcaugggcgaggccgccgcgaucuucaugaccgccacgccgcccgggacggccgacgccuucccgcagagcaacgcccccauccaggacgaggagcgcgacauccccgagcgcuccuggaacagcggcaacgaguggaucaccgacuucgcggggaagaccgucugguucgugcccuccaucaaggccggcaacgacaucgccaacugccugcggaagaacgggaagaaggugauccagcucagccgcaagaccuucgacacggaguaccagaagaccaagcugaacgacugggacuucgucgugaccaccgacaucuccgagaugggcgccaacuucaaggccgaccgggugaucgacccgcgccggugccugaagcccgucauccucacggacggccccgagcgcgugauccuggcggggcccaugccggugaccgccgccagcgccgcccagcggcgcggccgggucgggcgcaacccccagaaggagaacgaccaguacaucuucaccggccagccccugaacaacgacgaggaccacgcgcacuggaccgaggccaagaugcuccuggacaacaucaacacccccgaggggaucaucccggcccuguucgagcccgagcgggagaaguccgccgcgaucgacggcgaguaccgccucaagggcgagagccggaagacguucguggagcugaugcgccgcggggaccugcccguguggcucgcccacaaggucgccuccgagggcaucaaguacaccgaccgcaaguggugcuucgacgggcagcggaacaaccagauccuggaggagaacauggacguggagaucuggaccaaggagggcgagaagaagaagcugcgcccccgguggcucgacgcccgcaccuacagcgacccgcuggcccugaaggaguucaaggacuucgcggccggccgcaaguccaucgcccucgaccuggucacggagaucgggcgggugcccacccaccuggcccaccgcacccggaacgcccucgacaaccuggugaugcugcacaccagcgagcacggcgggaaggcguaccgccacgccgucgaggagcuccccgagacgauggagacccugcugcuccugggccugaugauccuccugaccgggggcgccaugcuguuccucaucagcggcaaggggaucggcaagaccuccaucgggcugaucugcgugaucgccagcuccggcaugcuguggauggccgagaucccgcuccaguggaucgcgagcgccaucgugcuggaguucuucaugaugguccugcucauccccgagcccgagaagcagcggacgccccaggacaaccagcuggccuacguggugaucgggauccugacccucgccgccaucaucgcggccaacgagaugggccugcuggagaccaccaagcgcgaccucggcauguccaaggagccgggggucgugagccccacguccuaccuggacguggaccugcaccccgccagcgccuggacccucuacgcggucgccaccaccgugaucacgcccaugcugcggcacaccaucgagaacuccaccgccaacgugagccuggccgccaucgcgaaccaggccgucgugcucaugggccuggacaagggguggccgaucuccaagauggaccugggcgugccccuccuggcccuggggugcuacagccaggucaacccccucacccugacggccgccgugcugcuccugaucacccacuacgcgaucaucggccccggccugcaggccaaggccacccgcgaggcccagaagcggaccgccgcggggaucaugaagaacccgacgguggacggcaucaugaccaucgaccucgaccccgucaucuacgacuccaaguucgagaagcagcugggccaggugaugcugcucgugcugugcgccguccagcugcuccugaugcgcaccagcugggcccugugcgaggcccucacccuggcgacgggccccaucaccacccugugggagggcucccccgggaaguucuggaacaccacgaucgccgugagcauggccaacaucuuccggggcuccuaccucgccggggccggccuggcguucagcaucaugaaguccguggggaccggcaagcgcggcaccgggagccagggcgagacccugggggagaaguggaagaagaagcucaaccagcugagccggaaggaguucgaccuguacaagaaguccggcaucaccgaggucgaccgcacggaggccaaggaggggcucaagcggggcgagaucacccaccacgccgugagccgcggcuccgccaagcugcagugguucguggagcggaacauggucaucccggaggggcgcgugaucgaccugggcugcgggcggggcggguggagcuacuacugcgccggccucaagaaggugaccgagguccgcggcuacaccaagggcgggcccgggcacgaggagcccgugcccauguccacguacggcuggaacaucgugaagcugaugagcgggaaggacgucuucuaccugccgcccgagaagugcgacacccuccugugcgacaucggcgaguccagccccucccccaccguggaggagagccggaccauccgcgugcugaagauggucgagccguggcugaagaacaaccaguucugcaucaaggugcucaaccccuacaugcccacggugaucgagcaccuggagcgccugcagcggaagcacggcgggaugcucguccgcaacccccugucccggaacagcacccacgagauguacuggaucuccaacggcaccgggaacaucguggcgagcgugaacauggucucccgccugcuccugaaccgguucaccaugacgcaccgccggccgaccaucgagaaggacguggaccugggcgccggcacccgccacgugaacgccgagcccgagacccccaacauggacgucaucggggagcggaucaagcgcaucaaggaggagcacaacagcacguggcacuacgacgacgagaacccguacaagaccugggccuaccacggcuccuacgaggugaaggccaccgggagcgcguccagcaugaucaacggcguggucaagcuccugaccaagcccugggacgugguccccauggugacgcagauggccaugaccgacaccacccccuucgggcagcagcggguguucaaggagaaggucgacacgcgcaccccgcggagcaugcccggcacccgccgggugaugggcaucaccgccgaguggcuguggcgcacgcucgggcggaacaagaagccccgccugugcacccgggaggaguucaccaagaaggugcgcaccaacgccgcgaugggcgccgucuucacggaggagaaccagugggacuccgccaaggccgccguggaggacgaggacuucuggaagcugguggaccgcgagcgggagcuccacaagcuggggaagugcggcagcugcgucuacaacaugauggggaagcgcgagaagaagcugggcgaguucggcaaggcgaaggggucccgggccaucugguacauguggcucggcgcccgcuaccuggaguucgaggcccugggguuccucaacgaggaccacugguucagccgggagaacuccuacagcggcguggagggggagggccugcacaagcugggcuacauccuccgcgacaucuccaagauccccgggggcgccauguacgcggacgacaccgccgggugggacacccggaucaccgaggacgaccugcacaacgaggagaagaucacgcagcagauggacccggagcaccgccagcuggccaacgccaucuucaagcucaccuaccagaacaagguggucaaggugcagcggcccacccccaccggcaccgugauggacaucaucagccgcaaggaccagcggggcuccgggcaggucggcacguacgggcugaacaccuucaccaacauggaggcccagcugauccgccagauggagggcgagggggugcucagcaaggcggaccuggagaacccccaccuccccgagaagaagaucacccaguggcuggagacgaagggcguggagcggcugaagcgcauggccaucuccggcgacgacugcgucgugaagcccaucgacgaccgguucgccaacgcccugcucgcccugaacgacauggggaaggugcgcaaggacaucccccaguggcagcccagcaagggcuggcacgacuggcagcaggucccguucugcucccaccacuuccacgagcugaucaugaaggacgggcggaagcucguggugcccugccgcccccaggacgagcugaucggccgggcgcgcaucagccagggggccggcuggucccugcgggagaccgccugccucggcaaggccuacgcgcagauguggagccugauguacuuccaccgccgcgaccugcggcucgccuccaacgccaucugcagcgccguccccgugcacugggugccgaccucccgcaccacguggagcauccacgcccaccaccaguggaugaccaccgaggacaugcugaccgucuggaaccggguguggaucgaggacaaccccuggauggaggacaagacgcccgugaccaccugggagaacguccccuaccuggggaagcgcgaggaccaguggugcggcagccucaucgggcugaccucccgggcgacgugggcccagaacaucccgaccgccauccagcagguccgcagccugaucggcaacgaggaguuccucgacuacaugcccuccaugaagcgguuccgcaaggaggaggagagcgagggggccaucugguga

SEQ ID NO: 10240 - RNA, 9873 nt, Artificial Sequence
  derived and/or modified CDS sequence (opt1) from DENV-3__FJ639774__SS-prME
accagccucugccucaugaugauccugcccgcggcgcuggcguuccaccucaccagccgggacggcgagccgcggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcaccaccacggagacccccaccuggaaccgcaaggagcuccuggugaccuucaagaacgcccacgccaagaagcaggaggucguggugcuggggucccaggagggcgccaugcacacggcgcucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgucccgugcaagauccccuucagcacggaggacgggcagggcaaggcccacaacggccgccugaucaccgcgaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggccaccgcgcggggcgcccgccggauggccauccugggcgacacggccugggacuucggguccgugggcgggguccucaacagccugggcaagauggugcaccagaucuucggguccgccuacaccgcgcuguucagcggcguguccugggucaugaagaucggcaucggggugcuccugaccuggaucggccugaacagcaagaacaccuccaugagcuucuccugcaucgccaucgggaucaucacgcucuaccugggcgccgugguccaggccgacauggggugcgugaucaacuggaagggcaaggagcugaagugcggcagcgggaucuucgugaccaacgagguccacaccuggaccgagcaguacaaguuccaggccgacucccccaagcgccucgcgacggccaucgccggcgccugggagaacggggugugcggcauccgcagcaccacccggauggagaaccugcuguggaagcagaucgccaacgagcucaacuacauccugugggagaacaacaucaagcugaccguggucgugggggacaucaucggcgugcucgagcagggcaagcgcacgcugacgccccagccgauggagcugaaguacuccuggaagaccugggggaaggcgaagaucgucaccgccgagacgcagaacagcuccuucaucaucgacggccccaacacccccgagugccccaacgccagccgggccuggaacgugugggagguggaggacuacggguucggcgucuucaccaccaacaucuggcucaagcugcgcgagguguacacccagcugugcgaccaccggcucauguccgcggccgugaaggacgagcgcgccguccacgccgacaugggcuacuggaucgagagccagaagaacgggagcuggaagcuggagaaggccucccugaucgaggugaagacgugcaccuggcccaagucccacacccucugguccaacggcgugcuggagagcgacaugaucauccccaagucccuggcggggcccaucagccagcacaacuaccggccgggcuaccacacccagacggccgggcccuggcaccucggcaagcuggagcuggacuucaacuacugcgagggcaccaccgucgugaucaccgagaacugcgggacgcgcggccccucccuccggaccaccaccgugagcgggaagcugauccacgaguggugcugccgcuccugcacgcugcccccgcuccgguacaugggcgaggacgggugcugguacggcauggagauccgccccaucagcgagaaggaggagaacauggucaagucccuggugagcgccggcuccggggagguggacaacuucaccaugggcguccugugccucgccauccuguucgaggaggugaugcgggggaaguucggcaagaagcacaugaucgccgggguguucuucaccuucguccugcuccugagcggccagaucaccuggcgcgacauggcgcacacgcugaucaugaucggcuccaacgccagcgaccggauggggaugggcgugaccuaccucgcccugaucgccaccuucaagauccagcccuuccuggcccucggguucuuccugcgcaagcugaccucccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcagcaacaccaucuucacccugacggucgccuggcgcaccgccacccugauccucgccggggugucccugcugccggucugccagagcuccagcaugcggaagaccgacuggcuccccaugacgguggcggccaugggcgugccgccccucccgcuguucaucuucucccucaaggacacccugaagcgccgcagcuggccccugaacgagggggucauggccgugggccucguguccauccuggccagcucccugcuccggaacgacguccccauggccggcccccugguggccggcgggcugcucaucgccugcuacgugaucaccgggaccagcgccgaccugacggucgagaaggccgccgacgugaccugggaggaggaggcggagcagaccggggugucccacaaccugaugaucaccgucgacgacgacgggaccaugcgcaucaaggacgacgagacggagaacauccucaccgugcugcugaagaccgcccuccugaucgugagcggcaucuucccguacuccauccccgccacccugcucgucuggcacacguggcagaagcagacccagcggagcggcgugcugugggacgugcccagcccgcccgagacccagaaggccgagcuggaggagggggucuaccgcaucaagcagcagggcaucuucgggaagacccaggugggcguggggguccagaaggagggcguguuccacacgauguggcacgugacccggggcgccguccucaccuacaacgggaagcgccuggagcccaacugggcgagcgugaagaaggaccugaucuccuacggcgggggcuggcggcucagcgcccaguggcagaagggggaggaggugcaggucaucgccguggagcccggcaagaaccccaagaacuuccagaccaugcccggcacguuccagaccaccaccggggagaucggcgccaucgcgcuggacuucaagcccgggacguccggcagccccaucaucaaccgcgagggcaagguggucgggcuguacggcaacgggguggugaccaagaacggcggguacgucagcggcaucgcccagaccaacgccgagccggacggccccacccccgagcuggaggaggagauguucaagaagcggaaccucacgaucauggaccugcaccccggguccggcaagacccgcaaguaccugccggccaucgugcgggaggccaucaagcgccggcuccgcacccugauccuggcgcccacccggguggucgccgccgagauggaggaggcccucaaggggcugcccauccgcuaccagacgaccgccaccaagagcgagcacaccggccgggagaucguggaccugaugugccacgcgacguucaccaugcgccuccugucccccgugcgggucccgaacuacaaccugaucaucauggacgaggcccacuucaccgaccccgccagcaucgccgcccgcggguacaucuccacccgggugggcaugggcgaggcggccgccaucuucaugacggccacgccgcccgggaccgcggacgccuucccgcagagcaacgcccccauccaggacgaggagcgcgacauccccgagcgcuccuggaacagcggcaacgaguggaucaccgacuucgccgggaagacggugugguucguccccuccaucaaggccggcaacgacaucgcgaacugccuccggaagaacgggaagaaggugauccagcugagccgcaagaccuucgacaccgaguaccagaagaccaagcugaacgacugggacuucguggucacgaccgacaucuccgagaugggcgccaacuucaaggccgaccgggugaucgacccgcgccggugccucaagcccgugauccugaccgacggccccgagcgcgucauccuggccgggcccaugccggugaccgccgcgagcgccgcccagcggcgcggccggguggggcgcaacccccagaaggagaacgaccaguacaucuucaccggccagccccucaacaacgacgaggaccacgcccacuggacggaggccaagaugcugcuggacaacaucaacacccccgaggggaucaucccggcccucuucgagcccgagcgggagaaguccgccgccaucgacggcgaguaccgccugaagggcgagagccggaagaccuucgucgagcugaugcgccgcggggaccuccccguguggcuggcccacaaggucgcguccgagggcaucaaguacaccgaccgcaaguggugcuucgacgggcagcggaacaaccagauccuggaggagaacauggacguggagaucuggacgaaggagggcgagcgcaagaagcuccggccccgcuggcuggacgcccgcaccuacagcgacccgcuggcccucaaggaguucaaggacuucgccgccggccggaaguccaucgcgcuggaccuggugaccgagaucgggcgcguccccacccaccucgcccaccggacgcgcaacgcccuggacaaccuggugaugcuccacaccagcgagcacggcgggaaggccuaccggcacgccguggaggagcugcccgagaccauggagacccugcuccugcugggccucaugauccugcugaccggcggggcgaugcuguuccugaucuccgggaaggggaucggcaagaccagcaucgggcugaucugcgucaucgccagcuccggcaugcucuggauggccgagaucccgcugcaguggaucgccagcgccaucgugcuggaguucuucaugauggugcuccugauccccgagcccgagaagcagcgcacgccccaggacaaccagcuggcguacgucgugaucgggauccucacccuggccgccaucaucgccgccaacgagaugggccugcucgagacgaccaagcgggaccugggcauguccaaggagccggggguggucagccccaccuccuaccuggacguggaccuccaccccgcgagcgccuggacccuguacgccguggccacgaccgucaucacccccaugcugcgccacaccaucgagaacuccacggcgaacgugagccucgccgccaucgccaaccaggccgugguccugaugggccuggacaagggguggccgaucuccaagauggaccucggcgugccccugcuggcgcucgggugcuacagccaggugaacccccugacccugaccgccgccguccuccugcugaucacccacuacgccaucaucggccccggccuccaggccaaggcgacgcgggaggcccagaagcgcaccgccgccgggaucaugaagaacccgaccguggacggcaucaugaccaucgaccuggaccccgugaucuacgacuccaaguucgagaagcagcuggggcaggucaugcuccuggugcugugcgccgugcagcuccugcugaugcggacgagcugggcgcucugcgaggcccugacccuggccaccggccccaucaccacgcucugggagggcucccccgggaaguucuggaacaccaccaucgccgucagcauggcgaacaucuuccgcggcuccuaccuggccggggccggccuggccuucagcaucaugaaguccguggggaccggcaagcggggcaccgggagccagggcgagacgcucggggagaaguggaagaagaagcugaaccagcugucccgcaaggaguucgaccucuacaagaaguccggcaucaccgagguggaccggaccgaggccaaggaggggcugaagcgcggcgagaucacccaccacgcggucagccggggcuccgccaagcugcagugguucguggagcgcaacauggugaucccggaggggcgggucaucgaccucggcugcgggcgcggcggguggagcuacuacugcgccggccugaagaaggugacggaggugcggggcuacaccaagggcggccccgggcacgaggagcccguccccauguccaccuacggcuggaacaucgugaagcugaugagcgggaaggacguguucuaccucccgcccgagaagugcgacacccugcugugcgacaucggcgaguccagccccucccccacggucgaggagagccgcaccauccgcgugcugaagaugguggagccguggcucaagaacaaccaguucugcaucaagguccugaaccccuacaugcccgccgugaucgagcaccuggagcggcuccagcgcaagcacggcgggaugcuggugcggaacccccugucccgcaacagcacccacgagauguacuggaucuccaacggcaccgggaacaucgucgccagcgugaacauggugucccggcuccugcugaaccgcuucacgaugacccaccggcgcccgaccaucgagaaggacgucgaccucggcgcgggcacccggcacgugaacgccgagcccgagacgcccaacauggacgugaucggggagcgcaucaagcggaucaaggaggagcacaacagcaccuggcacuacgacgacgagaacccguacaagaccugggccuaccacggcuccuacgaggucaaggccaccgggagcgccuccagcaugaucaacggcguggucaagcugcugacgaagcccugggacguggugcccauggucacccagauggcgaugaccgacaccacgcccuucgggcagcagcgcguguucaaggagaagguggacacccggaccccgcgcuccaugcccggcacccggcgcgucaugggcaucacggccgaguggcucuggcggacccuggggcgcaacaagaagccccggcugugcacccgcgaggaguucaccaagaaggugcgcacgaacgccgccaugggcgcgguguucaccgaggagaaccagugggacagcgccaaggccgccgucgaggacgaggacuucuggaagcucguggaccgggagcgcgagcugcacaagcuggggaagugcggcagcugcguguacaacaugauggggaagcgggagaagaagcucggcgaguucggcaaggccaaggggucccgcgcgaucugguacauguggcugggcgcccgguaccuggaguucgaggcccucggguuccugaacgaggaccacugguucagccgcgagaacuccuacagcggcgucgagggggagggccugcacaagcucggcuacauccugcgggacaucuccaagauccccgggggcgccauguacgccgacgacaccgcggggugggacacccgcaucacggaggacgaccugcacaacgaggagaagaucacccagcagauggacccggagcaccggcagcucgccaacgccaucuucaagcugaccuaccagaacaagguggugaagguccagcgccccacccccaccggcacggugauggacaucaucagccggaaggaccagcgcggcuccggccaggugggcaccuacgggcugaacaccuucaccaacauggaggcccagcucauccggcagauggagggcgaggggguccugagcaaggccgaccuggagaacccccaccucccggagaagaagaucacgcaguggcuggagaccaagggcguggagcgccugaagcggauggcgaucuccggcgacgacugcguggucaagcccaucgacgaccgcuucgccaacgcccuccuggcccugaacgacauggggaaggugcggaaggacaucccccaguggcagcccagcaagggcuggcacgacuggcagcaggucccguucugcucccaccacuuccacgagcucaucaugaaggacgggcgcaagcuggucgugcccugccggccccaggacgagcugaucggccgcgcccggaucagccagggggcgggcuggucccuccgcgagaccgccugccugggcaaggccuacgcccagauguggagccugauguacuuccaccgccgggaccuccgccuggcguccaacgccaucugcagcgccgugcccguccacugggugccgaccucccggacgaccuggagcauccacgcccaccaccaguggaugaccaccgaggacaugcugacgguguggaaccgcgucuggaucgaggacaaccccuggauggaggacaagacccccgugaccaccugggagaacgugcccuaccucgggaagcgggaggaccaguggugcggcucccugaucgggcugacgagccgcgccaccugggcgcagaacaucccgaccgccauccagcagguccggagccucaucggcaacgaggaguuccuggacuacaugcccuccaugaagcgcuuccggaaggaggaggagagcgagggggccaucugguga

SEQ ID NO: 10241 - RNA, 9873 nt, Artificial Sequence
  derived and/or modified CDS sequence (opt1) from DENV-3__FJ639775__SS-prME
accagccugugccucaugaugauccugcccgccgcccuggcguuccaccucaccagccgggacggggagccccggaugaucguggggaagaacgagcggggcaagagccugcuguucaagacggccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaaguccgagcacaccggccgggagaucguggaccugaugugccacgccaccuucacgaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucguccccagcaucaaggcgggcaacgacaucgccaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggugaccgagaucgggcggguccccucccaccucgcccaccgcacccggaacgcccuggacaaccuggugaugcuccacaccagcgagcacggcgggaaggccuaccgccacgcgguggaggagcugcccgagacgauggagacccugcuccugcugggccucaugauccugcugaccgggggcgccaugcuguuccugaucagcggcaaggggaucggcaagaccuccaucgggcugaucugcgucaucgccagcuccggcaugcucuggauggccgagaucccgcugcaguggaucgccagcgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccaccaagcgcgaccugggcauguccaaggagccggggguggucagccccacguccuaccuggacguggaccuccaccccgccagcgccuggacccuguacgccguggcgaccaccgucaucacgcccaugcugcggcacaccaucgagaacuccaccgccaacgugagccucgccgccaucgccaaccaggcggugguccugaugggccuggacaagggguggccgaucuccaagauggaccucggcgugccccugcuggcccucgggugcuacagccaggugaacccccugacccugacggccgccguccuccugcugaucacccacuacgccaucaucggccccggccuccaggcgaaggccacccgcgaggcccagaagcggaccgccgccgggaucaugaagaacccgacgguggacggcaucaugaccaucgaccuggaccccgugaucuacgacuccaaguucgagaagcagcuggggcaggucaugcuccuggugcugugcgcggugcagcuccugcugaugcgcaccagcugggcccucugcgaggcccugacccuggccacgggccccaucaccacccucugggagggcucccccgggaaguucuggaacaccacgaucgcggucagcauggccaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggaguucgaccucuacaagaaguccggcaucaccgagguggaccgcacggaggcgaaggaggggcugaagcggggcgagaucacccaccacgccgucagccgcggcuccgccaagcugcagugguucguggagcggaacauggugaucccggaggggcgcgucaucgaccucggcugcgggcggggcggguggagcuacuacugcgccggccugaagaaggugaccgaggugcgcggcuacaccaagggcgggcccgggcacgaggagcccguccccauguccacguacggcuggaacaucgugaagcugaugagcgggaaggacguguucuaccucccgcccgagaagugcgacacccugcugugcgacaucggcgaguccagccccucccccaccgucgaggagagccggaccauccgcgugcugaagaugguggagccguggcucaagaacaaccaguucugcaucaagguccugaaccccuacaugcccacggugaucgagcaccuggagcgccuccagcggaagcacggcgggaugcuggugcgcaacccccugucccggaacagcacccacgagauguacuggaucuccaacggcaccgggaacaucgucgccagcgugaacauggugucccgccuccugcugaaccgguucaccaugacgcaccgccggccgaccaucgagaaggacgucgaccucggcgcgggcacccgccacgugaacgccgagcccgagacccccaacauggacgugaucggggagcggaucaagcgcaucaaggaggagcacaacagcacguggcacuacgacgacgagaacccguacaagaccugggccuaccacggcuccuacgaggucaaggccaccgggagcgccuccagcaugaucaacggcguggucaagcugcugaccaagcccugggacguggugcccauggucacgcagauggcgaugaccgacaccacccccuucgggcagcagcggguguucaaggagaagguggacacgcgcaccccgcggagcaugcccggcacccgccgggccaugggcaucaccgccgaguggcucuggcgcacgcuggggcggaacaagaagccccgccugugcacccgggaggaguucaccaagaagguccgcaccaacgccgcgaugggcgccguguucacggaggagaaccagugggacuccgccaaggccgccguggaggacgaggacuucuggaagcucgucgaccgcgagcgggagcugcacaagcuggggaagugcggcagcugcguguacaacaugauggggaagcgcgagaagaagcucggcgaguucggcaaggcgaaggggucccgggccaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgcggacgacaccgccgggugggacacccggaucaccgaggacgaccugcacaacgaggagaagaucacgcagcagauggacccggagcaccgccagcucgccaacgccaucuucaagcugaccuaccagaacaaggucgugaaggugcagcggcccacccccaccggcaccgucauggacaucaucagccgcaaggaccagcggggcuccggccaggugggcacguacgggcugaacaccuucaccaacauggaggcccagcucauccgccagauggagggcgagggggugcugagcaaggcggaccuggagaacccccaccucccggagaagaagaucacccaguggcuggagacgaagggcgucgagcggcugaagcgcauggccaucuccggcgacgacugcguggugaagcccaucgacgaccgguucgccaacgcccuccuggcccugaacgacauggggaagguccgcaaggacaucccccaguggcagcccagcaagggcuggcacgacuggcagcaggucccguucugcucccaccacuuccacgagcucaucaugaaggacgggcggaagcuggugguccccugccgcccccaggacgagcugaucggccgggcgcgcaucagccagggggccggcuggucccuccgggagaccgccugccugggcaaggccuacgcgcagauguggagccugauguacuuccaccgccgcgaccuccggcuggccuccaacgccaucugcagcgccgugcccgugcacugggucccgaccucccgcaccacguggagcauccacgcccaccaccaguggaugaccaccgaggacaugcugaccguguggaaccggguguggaucgaggacaaccccuggauggaggacaagacgcccgucaccaccugggagaacgugcccuaccucgggaagcgcgaggaccaguggugcggcagccugaucgggcugaccucccgggcgacgugggcccagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10242 - RNA, 9873 nt, Artificial Sequence
  derived and/or modified CDS sequence (opt1) from DENV-3__FJ639777__SS-prME
accagccugugccucaugaugacccugcccgccgcccuggcguuccaccucaccagccgggacggggagccgcggaugaucguggggaagaacgagcggggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugacguacgggaccugcaaccaggccggcgagcaccggcgcgacaagcgguccgucgcccucgcgccccacgugggcauggggcuggacacccgcacccagacguggaugagcgccgagggcgccuggcgccagguggagaaggucgagaccugggcccugcgccacccgggguucaccauccucgcgcuguuccuggcccacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggcgacccuccggaagcugugcaucgagggcaagaucaccaacaucaccacggacagccgcugccccacccagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacacggugaucaucaccguccacaccggggaccagcaccaggugggcaacgagacccagggggucacggccgagaucacgccccaggccagcaccaccgaggcgauccugcccgaguacggcacccuggggcucgagugcuccccgcgcacgggccuggacuucaacgagaugauccugcucaccaugaagaacaaggccuggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgucccgugcaagauccccuucagcacggaggacgggcagggcaaggcgcacaacggccgccugaucaccgccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacacggccugggacuucggguccgugggcgggguccucaacagccugggcaagauggugcaccagaucuucggguccgcguacaccgcccuguucagcggcguguccugggucaugaagaucggcaucggggugcuccugaccuggaucggccugaacagcaagaacaccuccaugagcuucuccugcaucgccaucgggaucaucacgcucuaccugggcgccgugguccaggccgacauggggugcgugaucaacuggaagggcaaggagcugaagugcggcagcgggaucuucgugaccaacgagguccacaccuggaccgagcaguacaaguuccaggcggacucccccaagcgccucgccacggccaucgccggcgccugggagaacggggugugcggcauccgcagcaccacccggauggagaaccugcuguggaagcagaucgcgaacgagcucaacuacauccugugggagaacaacaucaagcugaccguggucgugggggacaucaucggcgugcucgagcagggcaagcgcacgcugacgccccagccgauggagcugaaguacuccuggaagaccugggggaaggccaagaucgucgccgccgagacccagaacagcuccuucaucaucgacggccccaacacgcccgagugccccagcgcgucccgggccuggaacgugugggagguggaggacuacggguucggcgucuucaccaccaacaucuggcucaagcugcgcgagguguacacccagcugugcgaccaccggcucaugagcgccgccgugaaggacgagcgcgccguccacgcggacaugggcuacuggaucgagagccagaagaacggguccuggaagcuggagaaggccagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgcgauccuguucgaggaggugaugcgggggaagcugggcaagaagcacaugaucgccgggguguucuucaccuucguccuccugcuguccggccagaucaccuggcgcgacauggcccacacccucaucaugaucggcagcaacgccuccgaccggauggggaugggcgugacguaccuggcccugaucgcgaccuucaagauccagcccuuccucgcccugggguucuuccugcgcaagcucaccagccgggagaaccugcugcucggcgugggccuggccauggccaccacgcugcagcuccccgaggacaucgagcagauggcgaacgggaucgcccugggccugauggcccucaagcugaucacccaguucgagaccuaccagcuguggaccgcccucaucagccugacgugcuccaacaccaucuucacccugaccgucgccuggcgcacggcgacccucauccuggccggggugagccugcucccggucugccaguccagcuccaugcggaagaccgacuggcugcccaugaccguggccgccaugggcgugccgccccugccccucuucaucuucagccugaaggacacgcugaagcgccgcuccuggccccucaacgagggggucauggccgugggccuggugagcauccuggcguccagccuccugcggaacgacguccccauggccggcccccugguggccgggggccuccugaucgccugcuacgugaucaccgggaccuccgccgaccugaccgucgagaaggcggccgacgugacgugggaggaggaggccgagcagaccggcgugagccacaaccucaugaucaccgucgacgacgacgggaccaugcgcaucaaggacgacgagaccgagaacauccugacggugcugcucaagaccgcccugcugaucguguccggcaucuucccguacagcauccccgccacccuccuggucuggcacaccuggcagaagcagacgcagcgguccggcgugcugugggacgugcccagcccgcccgagacccagaaggcggagcucgaggagggggucuaccgcaucaagcagcagggcaucuucgggaagacccaggugggcguggggguccagaaggagggcguguuccacaccauguggcacgugacgcggggcgccguccugaccuacaacgggaagcgccuggagcccaacugggccuccgugaagaaggaccucaucagcuacggcgggggcuggcggcugaacgcccaguggcagaagggggaggaggugcaggucaucgcgguggagcccggcaagaaccccaagaacuuccagaccaugcccggcaccuuccagacgaccaccggggagaucggcgccaucgcccuggacuucaagcccgggaccuccggcagccccaucaucaaccgcgagggcaagguggucgggcuguacggcaacgggguggugacgaagaacggcggguacgucagcggcaucgcccagaccaacgccgagccggacggccccacccccgagcucgaggaggagauguucaagaagcggaaccugaccaucauggaccugcaccccggguccggcaagacgcgcaaguaccucccggcgaucgugcgggaggccaucaagcgccggcugcgcacccugauccucgcccccacccggguggucgccgccgagauggaggaggcgcugaaggggcugcccauccgcuaccagaccacggccaccaagagcgagcacaccggccgggagaucguggaccucaugugccacgccaccuucacgaugcgccugcugucccccgugcgggucccgaacuacaaccucaucaucauggacgaggcccacuucaccgaccccgccagcaucgcggcccgcggguacaucuccacccgggugggcaugggcgaggccgccgcgaucuucaugaccgccacgccgcccgggaccgccgacgccuucccgcagagcaacgcccccauccaggacgaggagcgcgacauccccgagcgcuccuggaacagcggcaacgaguggaucaccgacuucgcggggaagaccgugugguucguccccuccaucaaggccggcaacgacaucgccaacugccugcggaagaacgggaagaaggugauccagcugagccgcaagacguucgacaccgaguaccagaagaccaagcucaacgacugggacuucguggucaccacggacaucuccgagaugggcgccaacuucaaggccgaccgggugaucgacccgcgccggugccugaagcccgugauccugaccgacggccccgagcgcgucauccucgcggggcccaucccggugaccgccgccagcgccgcccagcggcgcggccggguggggcgcaacccccagaaggagaacgaccaguacaucuucaccggccagccccugaacaacgacgaggaccacgcgcacuggaccgaggccaagaugcugcucgacaacaucaacacgcccgaggggaucaucccggcccuguucgagcccgagcgggagaaguccgccgcgaucgacggcgaguaccgccugaagggcgagagccggaagaccuucgucgagcucaugcgccgcggggaccugcccguguggcuggcccacaaggucgccuccgagggcaucaaguacaccgaccgcaaguggugcuucgacgggcagcggaacaaccagauccucgaggagaacauggacguggagaucuggaccaaggagggcgagaagaagaagcugcgcccccgguggcuggacgcccgcacguacagcgacccgcucgcccugaaggaguucaaggacuucgcggccggccgcaaguccaucgcccuggaccucgugaccgagaucgggcggguccccagccaccuggcccaccgcacccggaacgcccuggacaaccucgugaugcugcacaccuccgagcacggcgggaaggcguaccgccacgccguggaggagcugcccgagacgauggagacccuccugcugcucggccugaugauccugcucaccgggggcgccaugcuguuccugaucagcggcaaggggaucggcaagaccagcaucgggcucaucugcgucaucgccuccagcggcaugcuguggauggccgagaucccgcugcaguggaucgcguccgccaucgugcucgaguucuucaugauggugcugcugauccccgagcccgagaagcagcggacgccccaggacaaccagcucgccuacgucgugaucgggauccugacccuggccgccaucaucgcggccaacgagaugggccuccuggagaccaccaagcgcgaccugggcaugagcaaggagccggggguggucucccccacgagcuaccucgacguggaccugcaccccgccuccgccuggacccuguacgcgguggccaccaccgucaucacgcccaugcuccggcacaccaucgagaacagcaccgccaacgugucccuggccgccaucgcgaaccaggccgugguccugaugggccucgacaagggguggccgaucagcaagauggaccugggcgugccccugcucgcccuggggugcuacucccaggugaacccccugacccucacggccgccguccugcugcucaucacccacuacgcgaucaucggccccggccugcaggccaaggccacccgcgaggcccagaagcggaccgccgcggggaucaugaagaacccgacgguggacggcaucaugaccaucgaccuggaccccgugaucuacgacagcaaguucgagaagcagcucgggcaggucaugcugcuggugcucugcgccgugcagcugcugcucaugcgcaccuccugggcccugugcgaggcccugacccucgcgacgggccccaucaccacccugugggagggcagccccgggaaguucuggaacaccacgaucgccgucuccauggccaacaucuuccggggcagcuacaucgccggggccggccuggcguucuccaucaugaaguccguggggaccggcaagcgcggcaccgggucccagggcgagacccucggggagaaguggaagaagaagcugaaccagcugagccggaaggaguucgaccucuacaagaaguccggcaucaccgagguggaccgcacggaggccaaggaggggcugaagcggggcgagaucacccaccacgccgucucccgcggcagcgccaagcugcagugguucguggagcggaacauggugaccccggaggggcgcgucaucgaccucggcugcgggcggggcgggugguccuacuacugcgccggccugaagaaggugaccgaggugcgcggcuacacgaagggcgggcccgggcacgaggagcccguccccaugagcaccuacggcuggaacaucgugaagcugauguccgggaaggacguguucuaccucccgcccgagaagugcgacacccugcugugcgacaucggcgagagcucccccagccccaccgucgaggagucccggacgauccgcgugcugaagaugguggagccguggcucaagaacaaccaguucugcaucaagguccugaaccccuacaugcccaccgugaucgagcaccuggagcgccuccagcggaagcacggcgggaugcuggugcgcagcccccugucccggaacagcacccacgagauguacuggaucuccaacggcaccgggaacaucgucgcgagcgugaacauggugucccgccuccugcugaaccgguucacgaugacccaccgccggccgaccaucgagaaggacgucgaccucggcgccggcacccgccacgugaacgccgagcccgagacgcccaacauggacgugaucggggagcggaucaagcgcaucaaggaggagcacaacagcaccuggcacuacgacgacgagaacccguacaagaccugggccuaccacggcuccuacgaggucaaggccaccgggagcgcguccagcaugaucaacggcguggucaagcugcugacgaagcccugggacguggugcccauggucacccagauggccaugaccgacaccacgcccuucgggcagcagcggguguucaaggagaagguggacacccgcaccccgcggagcaugcccggcacccgccgggucaugggcaucacggccgaguggcucuggcgcacccuggggcggaacaagaagccccgccugugcacccgggaggaguucaccaagaaggugcgcacgaacgccgcgaugggcgccguguucaccgaggagaaccagugggacuccgccaaggccgccgucgaggacgaggacuucuggaagcucguggaccgcgagcgggagcugcaccgccuggggaagugcggcagcugcguguacaacaugauggggaagcgggagaagaagcucggcgaguucggcaaggcgaaggggucccgcgccaucugguacauguggcugggcgcccgguaccuggaguucgaggcccucggguuccugaacgaggaccacugguucagccgcgagaacuccuacagcggcgucgagggggagggccugcacaagcucggcuacauccugcgggacaucuccaagauccccgggggcgccauguacgcggacgacaccgccgggugggacacccgcaucacggaggacgaccugcacaacgaggagaagaucacccagcagauggacccggagcaccggcagcucgccaacgccaucuucaagcugaccuaccagaacaagguggugaagguccagcgccccacccccaccggcacggugauggacaucaucagccggaaggaccagcgcggcuccggccaggugggcaccuacgggcugaacaccuucaccaacauggaggcccagcucauccggcagauggagggcgaggggguccugagcaaggcggaccuggagaacccccaccucccggagaagaagaucacgcaguggcuggagaccaagggcguggagcgccugaagcggauggccaucuccggcgacgacugcguggucaagcccaucgacgaccgcuucgccaacgcccuccuggcccugaacgacauggggaaggugcggaaggacaucccccaguggcagcccagcaagggcuggcacgacuggcagcaggucccguucugcucccaccacuuccacgagcucaucaugaaggacgggcgcaagcuggucgugcccugccggccccaggacgagcugaucggccgcgcgcggaucagccagggggccggcuggucccuccgcgagaccgccugccugggcaaggccuacgcgcagauguggagccugauguacuuccaccgccgggaccuccgccuggccuccaacgccaucugcagcgccgugcccguccacugggugccgaccucccggacgaccuggagcauccacgcccaccaccaguggaugaccaccgaggacaugcugacgguguggaaccgcgucuggaucgaggacaaccccuggauggaggacaagacccccgugaccaccugggagaacgugcccuaccucgggaagcgggaggaccaguggugcggcagccugaucgggcugacgucccgcgcgaccugggcccagaacaucccgaccgccauccagcagguccggagccucaucggcaacgaggaguuccuggacuacaugcccuccaugaagcgcuuccggaaggaggaggagagcgagggggccaucugguga

SEQ ID NO: 10243 - RNA, 9873 nt, Artificial Sequence
  derived and/or modified CDS sequence (opt1) from DENV-3__FJ639778__SS-prME
accagccugugccucaugaugauccugcccgccgcccuggcguuccaccucaccagccgggacggggagccccggaugaucguggggaagaacgagcggggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcggagcgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggccgcaucaccaacaucaccaccgacagccggugccccacgcagggcgaggccgugcugccggaggagcaggaccagaacuacgucugcaagcacaccuacguggaccgcggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcggaccggccuggacuucaacgagaugauccugcucacgaugaagaacaaggccuggauggugcaccgccagugguucuucgaccugccccugcccuggaccagcggcgccaccaccgagacgcccaccuggaaccggaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccgccugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccggcugaucacggccaaccccguggugaccaagaaggaggagcccgucaacaucgaggccgagccgcccuucggggagagcaacauggugaucggcaucggggacaacgcccugaagaucaacugguacaagaagggcuccagcaucgggaagauguucgaggcgaccgcccgcggcgcccggcgcauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccggagcacgacccgcauggagaaccugcuguggaagcagaucgcgaacgagcucaacuacauccugugggagaacaacaucaagcugaccguggucgugggggacaucaucggcgugcucgagcagggcaagcggacccugacgccccagccgauggagcugaaguacuccuggaagaccugggggaaggccaagaucgucaccgccgagacccagaacagcuccuucaucaucgacggccccaacacgcccgagugccccagcgccucccgcgcguggaacgugugggagguggaggacuacggguucggcgucuucaccaccaacaucuggcucaagcugcgggagguguacacccagcugugcgaccaccgccucaugagcgccgccgugaaggacgagcgggccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccgcccgggcuaccacacccagaccgccgggcccuggcaccucggcaagcuggagcuggacuucaacuacugcgagggcacgaccgucgugaucaccgagaacugcgggacccggggccccagccuccgcacgaccaccguguccgggaagcugauccacgaguggugcugccggagcugcacccugcccccgcuccgcuacaugggcgaggacgggugcugguacggcauggagauccggcccaucuccgagaaggaggagaacauggucaagagccugguguccgccggcagcggggagguggacaacuucacgaugggcguccugugccucgccauccuguucgaggaggugaugcgcgggaaguucggcaagaagcacaugaucgcggggguguucuucaccuucguccugcuccuguccggccagaucaccuggcgggacauggcccacacccugaucaugaucggcagcaacgccuccgaccgcauggggaugggcgugacguaccucgcccugaucgccaccuucaagauccagcccuuccuggcgcucggguucuuccugcggaagcugaccagccgcgagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcggacggccacccugauccucgcgggggugagccugcugccggucugccaguccagcuccaugcgcaagaccgacuggcuccccaugaccguggccgccaugggcgugccgccccucccgcuguucaucuucagccucaaggacacgcugaagcgccgguccuggccccugaacgagggggucauggccgugggccucgugagcauccuggccuccagccugcucaagaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaaguccgagcacaccggccgggagaucguggaccugaugugccacgccaccuucacgaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucguccccagcaucaaggcgggcaacgacaucgccaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggugaccgagaucgggcggguccccacccaccucgcccaccgcacccggaacgcccuggacaaccuggugaugcuccacacguccgagcacggcgggaaggccuaccgccacgcgguggaggagcugcccgagaccauggagacccugcuccugcugggccucaugauccugcugaccgggggcgccaugcuguuccugaucagcggcaaggggaucggcaagacgagcaucgggcugaucugcgucaucgccuccagcggcaugcucuggauggccgagaucccgcugcaguggaucgccuccgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccacgaagcgcgaccugggcaugagcaaggagccggggguggucucccccaccagcuaccuggacguggaccuccaccccgccuccgccuggacccuguacgccguggcgaccacggucaucacccccaugcugcggcacaccaucgagaacagcaccgccaacgugucccucgccgccaucgccaaccaggcggugguccugaugggccuggacaagggguggccgaucagcaagauggaccucggcgugccccugcuggcccucgggugcuacucccaggugaacccccugacgcugaccgccgccguccuccugcugaucacccacuacgccaucaucggccccggccuccaggcgaaggccacccgcgaggcccagaagcggacggccgccgggaucaugaagaacccgaccguggacggcaucaugaccaucgaccuggaccccgugaucuacgacagcaaguucgagaagcagcuggggcaggucaugcuccuggugcugugcgcggugcagcuccugcugaugcgcaccuccugggcccucugcgaggcccugacgcuggccaccggccccaucaccacccucugggagggcagccccgggaaguucuggaacacgaccaucgcggucuccauggccaacaucuuccggggcagcuaccuggccggggccggccuggccuucuccaucaugaaguccguggggaccggcaagcgcggcaccgggucccagggcgagacccucggggagaaguggaagaagaagcugaaccagcugagccggaaggaguucgaccucuacaagaaguccggcaucacggagguggaccgcaccgaggcgaaggaggggcugcggcgcggcgagaucacccaccacgccgucucccggggcagcgccaagcugcagugguucguggagcgcaacauggugaucccggaggggcgggucaucgaccucggcugcgggcgcggcgggugguccuacuacugcgccggccugaagaaggugaccgaggugcggggcuacacgaagggcgggcccgggcacgaggagcccguccccaugagcaccuacggcuggaacaucgugaagcugauguccgggaaggacguguucuaccucccgcccgagaagugcgacacccugcugugcgacaucggcgagagcucccccagccccaccgucgaggagucccgcacgauccgcgugcugaagaugguggagccguggcucaagaacaaccaguucugcaucaagguccugaaccccuacaugcccaccgugaucgagcaccuggagcggcuccagcgcaagcacggcgggaugcuggugcggaacccccugagccgcaacuccacccacgagauguacuggaucagcaacggcaccgggaacaucgucgccuccgugaacauggugagccggcuccugcugaaccgcuucacgaugacccaccggcgcccgaccaucgagaaggacgucgaccucggcgcgggcacccggcacgugaacgccgagcccgagacgcccaacauggacgugaucggggagcgcaucaagcggaucaaggaggagcacaacuccaccuggcacuacgacgacgagaacccguacaagaccugggccuaccacggcagcuacgaggucaaggccaccggguccgccagcuccaugaucaacggcguggucaagcugcugacgaagcccugggacguggugcccauggucacccagauggcgaugaccgacaccacgcccuucgggcagcagcgcguguucaaggagaagguggacacccggaccccgcgcagcaugcccggcacccggcgcgucaugggcaucacggccgaguggcucuggcggacccuggggcgcaacaagaagccccggcugugcacccgcgaggaguucaccaagaaggugcgcacgaacgccgccaugggcgcgguguucaccgaggagaaccagugggacagcgccaaggccgccgucgaggacgaggacuucuggaagcucguggaccgggagcgcgagcugcacaagcuggggaagugcggcuccugcguguacaacaugauggggaagcgggagaagaagcucggcgaguucggcaaggccaaggggagccgcgcgaucugguacauguggcugggcgcccgguaccuggaguucgaggcccucggguuccugaacgaggaccacugguucucccgcgagaacagcuacuccggcgucgagggggagggccugcacaagcucggcuacauccugcgggacaucagcaagauccccgggggcgccauguacgccgacgacaccgcggggugggacacccgcaucacggaggacgaccugcacaacgaggagaagaucacccagcagauggacccggagcaccggcagcucgccaacgccaucuucaagcugaccuaccagaacaagguggugaagguccagcgccccacccccaccggcacggugauggacaucaucucccggaaggaccagcgcggcagcggccaggugggcaccuacgggcugaacaccuucaccaacauggaggcccagcucauccggcagauggagggcgaggggguccuguccaaggccgaccuggagaacccccaccucccggagaagaagaucacgcaguggcuggagaccaagggcguggagcgccugaagcggauggcgaucagcggcgacgacugcguggucaagcccaucgacgaccgcuucgccaacgcccuccuggcccugaacgacauggggaaggugcggaaggacaucccccaguggcagcccuccaagggcuggcacgacuggcagcaggucccguucugcagccaccacuuccacgagcucaucaugaaggacgggcgcaagcuggucgugcccugccggccccaggacgagcugaucggccgcgcccggaucucccagggggcgggcuggagccuccgcgagaccgccugccugggcaaggccuacgcccagauguggucccugauguacuuccaccgccgggaccuccgccuggcgagcaacgccaucugcuccgccgugcccguccacugggugccgaccagccggacgaccugguccauccacgcccaccaccaguggaugaccaccgaggacaugcugacgguguggaaccgcgucuggaucgaggacaaccccuggauggaggacaagacccccgugaccaccugggagaacgugcccuaccucgggaagcgggaggaccaguggugcggcagccugaucgggcugacgagccgcgccaccugggcgcagaacaucccgaccgccauccagcagguccggucccucaucggcaacgaggaguuccuggacuacaugcccagcaugaagcgcuuccggaaggaggaggaguccgagggggccaucugguga

SEQ ID NO: 10244 - RNA, 9873 nt, Artificial Sequence
  derived and/or modified CDS sequence (opt1) from DENV-3__FJ639779__SS-prME
accagccugugccucaugaugauccugcccgccgcccuggcguuccaccucaccagccgggacggcgagccccggaugaucguggggaagaacgagcggggcaagagccugcuguucaagacggccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcggagcguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagcgcaaggcgcacaacggccggcugaucacggccaaccccguggugaccaagaaggaggagcccgucaacaucgaggccgagccgcccuucggcgagagcaacaucgugaucgggaucggcgacaacgcccugaagaucaacugguacaagaagggguccagcaucggcaagauguucgaggcgaccgcccgcggggcccggcgcauggccauccugggcgacaccgccugggacuucggcuccgucgggggcguccucaacagccuggggaagauggugcaccagaucuucggcuccgcguacacggcccuguucagcgggguguccugggucaugaagaucggcaucggcgugcuccugaccuggaucgggcugaacagcaagaacaccuccaugagcuucuccugcaucgccaucggcaucaucacccucuaccugggggccgugguccaggccgacaugggcugcgugaucaacuggaaggggaaggagcugaagugcggcagcggcaucuucgugacgaacgagguccacaccuggaccgagcaguacaaguuccaggcggacucccccaagcgccucgccaccgccaucgccggggccugggagaacggcgugugcgggauccggagcacgacccgcauggagaaccugcuguggaagcagaucgcgaacgagcucaacuacauccugugggagaacaacaucaagcugaccguggucgugggcgacaucaucggggugcucgagcagggcaagcggacccugacgccccagccgauggagcugaaguacuccuggaagaccuggggcaaggccaagaucgucaccgccgagacccagaacagcuccuucaucaucgacgggcccaacacgcccgagugccccagcgccucccgcgcguggaacgugugggagguggaggacuacggcuucggggucuucaccaccaacaucuggcucaagcugcgggagguguacacccagcugugcgaccaccgccucaugagcgccgccgugaaggacgagcgggccguccacgccgacaugggcuacuggaucgagagccagaagaacggcuccuggaagcuggagaaggcgagccugaucgaggugaagaccugcacguggccgaagucccacacccucuggagcaacggggugcuggaguccgacaugaucauccccaagagccuggccggccccaucucccagcacaacuaccgcccgggguaccacacccagaccgccggccccuggcaccucgggaagcuggagcuggacuucaacuacugcgagggcacgaccgucgugaucaccgagaacugcggcacccgggggcccagccuccgcacgaccaccguguccggcaagcugauccacgaguggugcugccggagcugcacccugcccccgcuccgcuacaugggggaggacggcugcugguacgggauggagauccggcccaucuccgagaaggaggagaacauggucaagagccugguguccgccggcagcggcgagguggacaacuucacgauggggguccugugccucgccauccuguucgaggaggugaugcgcggcaaguucgggaagaagcacaugaucgcgggcguguucuucaccuucguccugcuccuguccgggcagaucaccuggcgggacauggcccacacccugaucaugaucggcagcaacgccuccgaccgcaugggcaugggggugacguaccucgcccugaucgccaccuucaagauccagcccuuccuggcgcucggcuucuuccugcggaagcugaccagccgcgagaaccuccugcugggggugggccucgccauggccaccacgcugcagcugcccgaggacuucgagcagauggccaacggcaucgcgcucgggcugauggcccugaagcucaucacccaguucgagaccuaccagcuguggaccgcccugaucagccucacgugcuccaacaccaucuucacccugaccgucgccuggcggacggccacccugauccucgcgggcgugagccugcugccggucugccaguccagcuccaugcgcaagaccgacuggcuccccaugaccguggccgccaugggggugccgccccucccgcuguucaucuucagccucaaggacacgcugaagcgccgguccuggccccugaacgagggcgucauggccguggggcucgugagcauccuggccuccagccugcuccgcaacgacguccccauggcgggcccccugguggccggcgggcugcucaucgccugcuacgugaucaccggcaccuccgccgaccugaccgucgagaaggccgcggacgugacgugggaggaggaggccgagcagaccggggugagccacaaccugaugaucaccgucgacgacgacggcaccaugcggaucaaggacgacgagaccgagaacauccucacggugcugcugaagaccgcccuccugaucguguccgggaucuucccguacagcauccccgccacccugcucgucuggcacaccuggcagaagcagacgcagcgcuccggcgugcugugggacgugcccagcccgcccgagacccagaaggccgagcuggaggagggcgucuaccggaucaagcagcaggggaucuucggcaagacccaggugggggugggcguccagaaggaggggguguuccacaccauguggcacgugacgcgcggcgcgguccucaccuacaacggcaagcggcuggagcccaacugggccuccgugaagaaggaccugaucagcuacgggggcggguggcgccucuccgcccaguggcagaagggcgaggaggugcaggucaucgccguggagcccgggaagaaccccaagaacuuccagaccaugcccggcaccuuccagacgaccaccggcgagaucggggcgaucgcccuggacuucaagcccggcaccagcgggagccccaucaucaaccgggagggcaagguggucggccuguacgggaacggcguggugacgaagaacgggggcuacgucuccgggaucgcccagaccaacgccgagccggacggccccgcccccgagcuggaggaggagauguucaagaagcgcaaccucaccaucauggaccugcaccccggcagcgggaagacccggaaguaccugccggcgaucgugcgcgaggccaucaagcggcgccuccggacgcugauccuggcccccacccgcguggucgccgccgagauggaggaggcgcucaagggccugcccauccgguaccagaccaccgccacgaaguccgagcacaccgggcgcgagaucguggaccugaugugccacgccaccuucaccaugcggcuccugagccccgugcgcgucccgaacuacaaccugaucaucauggacgaggcccacuucacggaccccgccuccaucgcggcccggggcuacaucagcacccgcguggggaugggcgaggccgccgcgaucuucaugaccgccacgccgcccggcacggccgacgccuucccgcaguccaacgcccccauccaggacgaggagcgcgacauccccgagcggagcuggaacuccgggaacgaguggaucaccgacuucgcgggcaagaccgugugguucguccccagcaucaaggccgggaacgacaucgccaacugccuccgcaagaacggcaagaaggugauccagcugucccggaagaccuucgacacggaguaccagaagaccaagcugaacgacugggacuucguggucaccaccgacaucagcgagaugggggccaacuucaaggccgaccgcgugaucgacccgcggcgcugccucaagcccgugauccugacggacggccccgagcgggucauccuggcgggccccaugccggugaccgccgccuccgccgcccagcgccgggggcgcgugggccggaacccccagaaggagaacgaccaguacaucuucaccgggcagccccucaacaacgacgaggaccacgcgcacuggaccgaggccaagaugcugcuggacaacaucaacacccccgagggcaucaucccggcccucuucgagcccgagcgcgagaaguccgccgcgaucgacggggaguaccggcugaagggcgagucccgcaagacguucgucgagcugaugcggcgcggcgaccuccccguguggcuggcccacaaggucgccagcgaggggaucaaguacaccgaccggaaguggugcuucgacggccagcgcaacaaccagauccuggaggagaacauggacguggagaucuggaccaaggagggggagaagaagaagcuccggccccgcuggcuggacgcccgcaccuacuccgacccgcuggcccucaaggaguucaaggacuucgcggccggccgcaagagcaucgcccuggaccuggugacggagaucggccgcguccccacccaccucgcccaccggacccgcaacgcccuggacaaccuggugaugcuccacaccuccgagcacgggggcaaggcguaccggcacgccguggaggagcugcccgagacgauggagacccugcuccugcuggggcucaugauccugcugaccggcggggccaugcuguuccugaucagcggcaagggcaucgggaagaccagcaucggccugaucugcgucaucgccuccagcgggaugcucuggauggccgagaucccgcugcaguggaucgcguccgccaucgugcuggaguucuucaugauggugcuccugauccccgagcccgagaagcagcgcacgccccaggacaaccagcuggccuacgucgugaucggcauccucacccuggccgccaucaucgcggccaacgagauggggcugcucgagaccaccaagcgggaccugggcaugagcaaggagccgggcguggucucccccacgagcuaccuggacguggaccuccaccccgccuccgccuggacccuguacgcgguggccaccaccgucaucacgcccaugcugcgccacaccaucgagaacagcaccgccaacgugucccucgccgccaucgcgaaccaggccgugguccugauggggcuggacaagggcuggccgaucagcaagauggaccucggggugccccugcuggcccucggcugcuacucccaggugaacccccugacccugacggccgccguccuccugcugaucacccacuacgcgaucaucgggcccggccuccaggccaaggccacccgggaggcccagaagcgcaccgccgcgggcaucaugaagaacccgacgguggacgggaucaugaccaucgaccuggaccccgugaucuacgacagcaaguucgagaagcagcugggccaggucaugcuccuggugcugugcgccgugcagcuccugcugaugcggaccuccugggcccucugcgaggcccugacccuggcgacggggcccaucaccacccucugggagggcagccccggcaaguucuggaacaccacgaucgccgucuccauggccaacaucuuccgcgggagcuaccuggccggcgccgggcuggcguucuccaucaugaaguccgugggcaccgggaagcggggcaccggcucccagggggagacccucggcgagaaguggaagaagaagcugaaccagcugagccgcaaggaguucgaccucuacaagaaguccgggaucaccgagguggaccggacggaggccaaggagggccugaagcgcggggagaucacccaccacgccgucucccggggcagcgccaagcugcagugguucguggagcgcaacauggugaucccggagggccgggucaucgaccucgggugcggccgcgggggcugguccuacuacugcgccgggcugaagaaggugaccgaggugcggggcuacaccaagggcgggcccggccacgaggagcccguccccaugagcacguacggguggaacaucgugaagcugauguccggcaaggacguguucuaccucccgcccgagaagugcgacacccugcugugcgacaucggggagagcucccccagccccaccgucgaggagucccgcaccauccgcgugcugaagaugguggagccguggcucaagaacaaccaguucugcaucaagguccugaaccccuacaugcccacggugaucgagcaccuggagcggcuccagcgcaagcacggcggcaugcuggugcggaacccccugagccgcaacuccacccacgagauguacuggaucagcaacgggaccggcaacaucgucgcguccgugaacauggugagccggcuccugcugaaccgcuucaccaugacgcaccggcgcccgaccaucgagaaggacgucgaccucggggccggcacccggcacgugaacgccgagcccgagacccccaacauggacgugaucggcgagcgcaucaagcggaucaaggaggagcacaacuccacguggcacuacgacgacgagaacccguacaagaccugggccuaccacgggagcuacgaggucaaggccaccggcuccgcgagcuccaugaucaacgggguggucaagcugcugaccaagcccugggacguggugcccauggucacgcagauggccaugaccgacaccacccccuucggccagcagcgcguguucaaggagaagguggacacgcggaccccgcgcagcaugcccgggacccggcgcgucaugggcaucaccgccgaguggcucuggcggacgcugggccgcaacaagaagccccggcugugcacccgcgaggaguucaccaagaaggugcgcaccaacgccgcgaugggggccguguucacggaggagaaccagugggacagcgccaaggccgccgucgaggacgaggacuucuggaagcucguggaccgggagcgcgagcugcacaagcugggcaagugcggguccugcguguacaacaugaugggcaagcgggagaagaagcucggggaguucggcaaggcgaagggcagccgcgccaucugguacauguggcugggggcccgguaccuggaguucgaggcccucggcuuccugaacgaggaccacugguucucccgcgagaacagcuacuccggggucgagggcgaggggcugcacaagcucggcuacauccugcgggacaucagcaagauccccggcggggccauguacgcggacgacaccgccggcugggacacccgcaucaccgaggacgaccugcacaacgaggagaagaucacgcagcagauggacccggagcaccggcagcucgccaacgccaucuucaagcugaccuaccagaacaagguggugaagguccagcgccccacccccaccgggaccgugauggacaucaucucccggaaggaccagcgcggcagcggccagguggggacguacggccugaacaccuucaccaacauggaggcccagcucauccggcagauggagggggagggcguccuguccaaggcggaccuggagaacccccaccucccggagaagaagaucacccaguggcuggagacgaaggggguggagcgccugaagcggauggccaucagcggcgacgacugcguggucaagcccaucgacgaccgcuucgccaacgcccuccuggcccugaacgacaugggcaaggugcggaaggacaucccccaguggcagcccuccaagggguggcacgacuggcagcaggucccguucugcagccaccacuuccacgagcucaucaugaaggacggccgcaagcuggucgugcccugccggccccaggacgagcugaucgggcgcgcgcggaucucccagggcgccggguggagccuccgcgagaccgccugccugggcaaggccuacgcgcagauguggucccugauguacuuccaccgccgggaccuccgccuggccagcaacgccaucugcuccgccgugcccguccacugggugccgaccagccggaccacgugguccauccacgcccaccaccaguggaugaccaccgaggacaugcugaccguguggaaccgcgucuggaucgaggacaaccccuggauggaggacaagacgcccgugaccaccugggagaacgugcccuaccucggcaagcgggaggaccaguggugcgggagccugaucggccugaccagccgcgcgacgugggcccagaacaucccgaccgccauccagcagguccggucccucaucgggaacgaggaguuccuggacuacaugcccgccaugaagcgcuuccggaaggaggaggagagcgagggcgccaucugguga

SEQ ID NO: 10245 - RNA, 9873 nt, Artificial Sequence
  derived and/or modified CDS sequence (opt1) from DENV-3__FJ639780__SS-prME
accagccucugccucaugaugauccugcccgcggcgcuggcguuccaccucaccagccgggacggcgagccgcggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcaccaccacggagacccccaccuggaaccgcaaggagcuccuggugaccuucaagaacgcccacgccaagaagcaggaggucguggugcuggggucccaggagggcgccaugcacacggcgcucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgucccgugcaagauccccuucagcacggaggacgggcagggcaaggcccacaacggccgccugaucaccgcgaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggccaccgcgcggggcgcccgccggauggccauccugggcgacacggccugggacuucggguccgugggcgggguccucaacagccugggcaagauggugcaccagaucuucggguccgccuacaccgcgcuguucagcggcguguccugggucaugaagaucggcaucggggugcuccugaccuggaucggccugaacagcaagaacaccuccaugagcuucuccugcaucgccaucgggaucaucacgcucuaccugggcgccgugguccaggccgacauggggugcgugaucaacuggaagggcaaggagcugaagugcggcagcgggaucuucgugaccaacgagguccacaccuggaccgagcaguacaaguuccaggccgacucccccaagcgccucgcgacggccaucgccggcgccugggagaacggggugugcggcauccgcagcaccacccggauggagaaccugcuguggaagcagaucgccaacgagcucaacuacauccugugggagaacaacaucaagcugaccguggucgugggggacaucaucggcgugcucgagcagggcaagcgcacgcugacgccccagccgauggagcugaaguacuccuggaagaccugggggaaggcgaagaucgucaccgccgagacgcagaacagcuccuucaucaucgacggccccaacacccccgagugccccaacgccagccgggccuggaacgugugggagguggaggacuacggguucggcgucuucaccaccaacaucuggcucaagcugcgcgagguguacacccagcugugcgaccaccggcucauguccgcggccgugaaggacgagcgcgccguccacgccgacaugggcuacuggaucgagagccagaagaacgggagcuggaagcuggagaaggccucccugaucgaggugaagacgugcaccuggcccaagucccacacccucugguccaacggcgugcuggagagcgacaugaucauccccaagucccuggcggggcccaucagccagcacaacuaccggccgggcuaccacacccagacggccgggcccuggcaccucggcaagcuggagcuggacuucaacuacugcgagggcaccaccgucgugaucaccgagaacugcgggacgcgcggccccucccuccggaccaccaccgugagcgggaagcugauccacgaguggugcugccgcuccugcacgcugcccccgcuccgguacaugggcgaggacgggugcugguacggcauggagauccgccccaucagcgagaaggaggagaacauggucaagucccuggugagcgccggcuccggggagguggacaacuucaccaugggcguccugugccucgccauccuguucgaggaggugaugcgggggaaguucggcaagaagcacaugaucgccgggguguucuucaccuucguccugcuccugagcggccagaucaccuggcgcgacauggcgcacacgcugaucaugaucggcuccaacgccagcgaccggauggggaugggcgugaccuaccucgcccugaucgccaccuucaagauccagcccuuccuggcccucggguucuuccugcgcaagcugaccucccgggagaaccuccugcugggcgugggccucgcgauggccacgacccugcagcugcccgaggacaucgagcagauggccaacgggaucgcccucggccugauggcgcugaagcucaucacccaguucgagaccuaccagcuguggacggcccugaucagccugaccugcagcaacaccaucuucacccugacggucgccuggcgcaccgccacccugauccucgccggggugucccugcugccggucugccagagcuccagcaugcggaagaccgacuggcuccccaugacgguggcggccaugggcaucccgccccucccgcuguucaucuucucccucaaggacacccugaagcgccgcagcuggccccugaacgagggggugauggccgucggccucguguccauccuggccagcucccugcuccggaacgacgugcccauggccggcccccuggucgccggcgggcugcucaucgccugcuacgugaucaccgggaccagcgccgaccugacgguggagaaggccgccgacgucaccugggaggaggaggcggagcagaccggggugucccacaaccugaugaucaccguggacgacgacgggaccaugcgcaucaaggacgacgagacggagaacauccucaccguccugcugaagaccgcccuccugaucgugagcggcaucuucccguacuccauccccgccacccugcucguguggcacacguggcagaagcagacccagcggagcggcguccugugggacgugcccagcccgcccgagacccagaaggccgagcuggaggaggggguguaccgcaucaagcagcagggcaucuucgggaagacccaggucggcgugggggugcagaaggagggcgucuuccacacgauguggcacgugacccggggcgccgugcucaccuacaacgggaagcgccuggagcccaacugggcgagcgucaagaaggaccugaucuccuacggcgggggcuggcggcucagcgcccaguggcagaagggggaggagguccaggugaucgccgucgagcccggcaagaaccccaagaacuuccagaccaugcccggcacguuccagaccaccaccggggagaucggcgccaucgcgcuggacuucaagcccgggacguccggcagccccaucaucaaccgcgagggcaaggugguggggcuguacggcaacggggucgugaccaagaacggcggguacgugagcggcaucgcccagaccaacgccgagccggacggccccacccccgagcuggaggaggagauguucaagaagcggaaccucacgaucauggaccugcaccccggguccggcaagacccgcaaguaccugccggccaucguccgggaggccaucaagcgccggcuccgcacccugauccuggcgcccacccgggugguggccgccgagauggaggaggcccucaaggggcugcccauccgcuaccagacgaccgccaccaagagcgagcacaccggccgggagaucgucgaccugaugugccacgcgacguucaccaugcgccuccugucccccgugcgggugccgaacuacaaccugaucaucauggacgaggcccacuucaccgaccccgccagcaucgccgcccgcggguacaucuccacccgggucggcaugggcgaggcggccgccaucuucaugacggccacgccgcccgggaccgcggacgccuucccgcagagcaacgcccccauccaggacgaggagcgcgacauccccgagcgcuccuggaacagcggcaacgaguggaucaccgacuucgccgggaagacggugugguucgugcccuccaucaaggccggcaacgacaucgcgaacugccuccggaagaacgggaagaaggucauccagcugagccgcaagaccuucgacaccgaguaccagaagaccaagcugaacgacugggacuucguggugacgaccgacaucuccgagaugggcgccaacuucaaggccgaccgggucaucgacccgcgccggugccucaagcccgugauccugaccgacggccccgagcgcgugauccuggccgggcccaugccggucaccgccgcgagcgccgcccagcggcgcggccggguggggcgcaacccccagaaggagaacgaccaguacaucuucaccggccagccccucaacaacgacgaggaccacgcccacuggacggaggccaagaugcugcuggacaacaucaacacccccgaggggaucaucccggcccucuucgagcccgagcgggagaaguccgccgccaucgacggcgaguaccgccugaagggcgagagccggaagaccuucguggagcugaugcgccgcggggaccuccccgucuggcuggcccacaagguggcguccgagggcaucaaguacaccgaccgcaaguggugcuucgacgggcagcggaacaaccagauccuggaggagaacauggacgucgagaucuggacgaaggagggcgagcgcaagaagcuccggccccgcuggcuggacgcccgcaccuacagcgacccgcuggcccucaaggaguucaaggacuucgccgccggccggaaguccaucgcgcuggaccuggugaccgagaucgggcgcgugcccacccaccucgcccaccggacgcgcaacgcccuggacaaccuggucaugcuccacaccagcgagcacggcgggaaggccuaccggcacgccguggaggagcugcccgagaccauggagacccugcuccugcugggccucaugauccugcugaccggcggggcgaugcuguuccugaucuccgggaaggggaucggcaagaccagcaucgggcugaucugcgugaucgccagcuccggcaugcucuggauggccgagaucccgcugcaguggaucgccagcgccaucguccuggaguucuucaugauggugcuccugauccccgagcccgagaagcagcgcacgccccaggacaaccagcuggcguacguggucaucgggauccucacccuggccgccaucaucgccgccaacgagaugggccugcucgagacgaccaagcgggaccugggcauguccaaggagccggggguggugagccccaccuccuaccuggacgucgaccuccaccccgcgagcgccuggacccuguacgccguggccacgaccgugaucacccccaugcugcgccacaccaucgagaacuccacggcgaacgucagccucgccgccaucgccaaccaggccguggugcugaugggccuggacaagggguggccgaucuccaagauggaccucggcgucccccugcuggcgcucgggugcuacagccaggugaacccccugacccugaccgccgccgugcuccugcugaucacccacuacgccaucaucggccccggccuccaggccaaggcgacgcgggaggcccagaagcgcaccgccgccgggaucaugaagaacccgaccgucgacggcaucaugaccaucgaccuggaccccgugaucuacgacuccaaguucgagaagcagcugggccaggugaugcuccugguccugugcgccgugcagcuccugcugaugcggacgagcugggcgcucugcgaggcccugacccuggccaccggccccaucaccacgcucugggagggcucccccgggaaguucuggaacaccaccaucgccgugagcauggcgaacaucuuccgcggcuccuaccuggccggggccggccuggccuucagcaucaugaaguccgucgggaccggcaagcggggcaccgggagccagggcgagacgcucggggagaaguggaagaagaagcugaaccagcugucccgcaaggaguucgaccucuacaagaaguccggcaucaccgagguggaccggaccgaggccaaggaggggcugaagcgcggcgagaucacccaccacgcggugagccggggcuccgccaagcugcagugguucgucgagcgcaacauggugaucccggaggggcgggugaucgaccucggcugcgggcgcggcggguggagcuacuacugcgccggccugaagaaggucacggaggugcggggcuacaccaagggcgggcccgggcacgaggagcccgugcccauguccaccuacggcuggaacaucgucaagcugaugagcgggaaggacguguucuaccucccgcccgagaagugcgacacccugcugugcgacaucggcgaguccagccccucccccacgguggaggagagccgcaccauccgcguccugaagaugguggagccguggcucaagaacaaccaguucugcaucaaggugcugaaccccuacaugcccgccgucaucgagcaccuggagcggcuccagcgcaagcacggcgggaugcuggugcggaacccccugucccgcaacagcacccacgagauguacuggaucuccaacggcaccgggaacaucguggccagcgucaacauggugucccggcuccugcugaaccgcuucacgaugacccaccggcgcccgaccaucgagaaggacguggaccucggcgcgggcacccggcacgucaacgccgagcccgagacgcccaacauggacgugaucggggagcgcaucaagcggaucaaggaggagcacaacagcaccuggcacuacgacgacgagaacccguacaagaccugggccuaccacggcuccuacgaggugaaggccaccgggagcgccuccagcaugaucaacggcgucgugaagcugcugacgaagcccugggacgucgugcccauggugacccagauggcgaugaccgacaccacgcccuucgggcagcagcgcgucuucaaggagaagguggacacccggaccccgcgcuccaugcccggcacccggcgcgugaugggcaucacggccgaguggcucuggcggacccuggggcgcaacaagaagccccggcugugcacccgcgaggaguucaccaagaagguccgcacgaacgccgccaugggcgcgguguucaccgaggagaaccagugggacagcgccaaggccgccguggaggacgaggacuucuggaagcucgucgaccgggagcgcgagcugcacaagcuggggaagugcggcagcugcguguacaacaugauggggaagcgggagaagaagcucggcgaguucggcaaggccaaggggucccgcgcgaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgccgacgacaccgcggggugggacacccgcaucacggaggacgaccugcacaacgaggagaagaucacccagcagauggacccggagcaccggcagcucgccaacgccaucuucaagcugaccuaccagaacaaggucgugaaggugcagcgccccacccccaccggcacggucauggacaucaucagccggaaggaccagcgcggcuccggccaggugggcaccuacgggcugaacaccuucaccaacauggaggcccagcucauccggcagauggagggcgagggggugcugagcaaggccgaccuggagaacccccaccucccggagaagaagaucacgcaguggcuggagaccaagggcgucgagcgccugaagcggauggcgaucuccggcgacgacugcguggugaagcccaucgacgaccgcuucgccaacgcccuccuggcccugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcccggaucagccagggggcgggcuggucccuccgcgagaccgccugccugggcaaggccuacgcccagauguggagccugauguacuuccaccgccgggaccuccgccuggcguccaacgccaucugcagcgccgugcccgugcacugggucccgaccucccggacgaccuggagcauccacgcccaccaccaguggaugaccaccgaggacaugcugacgguguggaaccgcguguggaucgaggacaaccccuggauggaggacaagacccccgucaccaccugggagaacgugcccuaccucgggaagcgggaggaccaguggugcggcucccugaucgggcugacgagccgcgccaccugggcgcagaacaucccgaccgccauccagcagguccggagccucaucggcaacgaggaguuccuggacuacaugcccuccaugaagcgcuuccggaaggaggaggagagcgagggggccaucugguga

SEQ ID NO: 10246 - RNA, 9873 nt, Artificial Sequence
  derived and/or modified CDS sequence (opt1) from DENV-3__FJ639781__SS-prME
accagccugugccucaugaugauccugcccgccgcccuggcguuccaccucaccagccgggacggggagccccggaugaucguggggaagaacgagcggggcaagagccugcuguucaagaccgccagcgggaucaacaugugcacccucaucgccauggaccugggggagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcggagcguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccaguacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaucuccaugagcuucuccugcaucgccaucgggaucaucacccucuaccugggcgccgugguccaggccgacauggggugcgugaucaacuggaagggcaaggagcugaagugcggcagcgggaucuucgugaccaacgagguccacacguggaccgagcaguacaaguuccaggcggacucccccaagcgccucgccaccgccaucgccggcgccugggagaacggggugugcggcauccgcagcaccacgcggauggagaaccugcuguggaagcagaucgcgaacgagcucaacuacauccugugggagaacaacaucaagcugaccguggucgugggggacaccaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguucuucaccuucgcccugcuccuguccggccagaucaccuggcgcgacauggcccacacccugaucaugaucggcagcaacgccuccgaccggauggggaugggcgucacguaccucgcccugaucgcgaccuucaagauccagcccuuccuggcccucggguucuuccugcgcaagcugaccagccgggagaaccuccugcugggcgugggccucgccauggccaccacgcugcagcugcccgaggacaucgagcagauggcgaacgggaucgcccucggccugauggcccugaagcucaucacccaguucgagaccuaccagcuguggaccgcccugaucagccucacgugcuccaacaccaucuucacccugaccguggccuggcgcacggcgacccugauccucgccggggucagccugcugccggugugccaguccagcuccaugcggaagaccgacuggcuccccaugaccgucgccgccaugggcgugccgccccucccgcuguucaucuucagccucaaggacacgcugaagcgccgcuccuggccccugaacgagggggugauggccgucggccucgugagcauccuggcguccagccugcuccggaacgacgugcccauggccggcccccuggucgccgggggccugcucaucgccugcuacgugaucaccgggaccuccgccgaccugaccguggagaaggcggccgacgucacgugggaggaggaggccgagcagaccggcgugagccacaaccugaugaucaccguggacgacgacgggaccaugcgcaucaaggacgacgagaccgagaacauccucacgguccugcugaagaccgcccuccugaucguguccggcaucuucccguacagcauccccgccacccugcucguguggcacaccuggcagaagcagacgcagcgguccggcguccugugggacgugcccagcccgcccgagacccagaaggcggagcuggaggaggggguguaccgcaucaagcagcagggcaucuucgggaagacccaggucggcgugggggugcagaaggagggcgucuuccacaccauguggcacgugacgcggggcgccgugcucaccuacaacgggaagcgccuggagcccaacugggccuccgucaagaaggaccugaucagcuacggcgggggcuggcggcucuccgcccaguggcagaagggggaggagguccaggugaucgcggucgagcccggcaagaaccccaagaacuuccagaccaugcccggcaccuuccagacgaccaccggggagaucggcgccaucgcccuggacuucaagcccgggaccagcggcagccccaucaucaaccgcgagggcaaggugguggggcuguacggcaacggggucgugacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggcgaucguccgggaggccaucaagcgccggcuccgcacccugauccuggcccccacccgggugguggccgccgagauggaggaggcgcucaaggggcugcccauccgcuaccagaccacggccaccaaguccgagcacaccggccgggagaucgucgaccugaugugccacgccaccuucacgaugcgccuccugagccccgugcgggugccgaacuacaaccugaucaucauggacgaggcccacuucaccgaccccgccuccaucgcggcccgcggguacaucagcacccgggucggcaugggcgaggccgccgcgaucuucaugaccgccacgccgcccgggaccgccgacgccuucccgcaguccaacgcccccauccaggacgaggagcgcgacauccccgagcgcagcuggaacuccggcaacgaguggaucaccgacuucgcggggaagaccgugugguucgugcccagcaucaaggccggcaacgacaucgccaacugccuccggaagaacgggaagaaggucauccagcugucccgcaagacguucgacaccgaguaccagaagaccaagcugaacgacugggacuucguggugaccacggacaucagcgagaugggcgccaacuucaaggccgaccgggucaucgacccgcgccggugccucaagcccgugauccugaccgacggccccgagcgcgugauccuggcggggcccaugccggucaccgccgccuccgccgcccagcggcgcggccggguggggcgcaacccccagaaggagaacgaccaguacaucuucaccggccagccccucaacaacgacgaggaccacgcgcacuggaccgaggccaagaugcugcuggacaacaucaacacgcccgaggggaucaucccggcccucuucgagcccgagcgggagaaguccgccgcgaucgacggcgaguaccgccugaagggcgagucccggaagaccuucguggagcugaugcgccgcggggaccuccccgucuggcuggcccacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcacguacuccgacccgcuggcccucaaggaguucaaggacuucgcggccggccgcaagagcaucgcccuggaccuggugaccgagaucgggcgggugcccacccaccucgcccaccgcacccggaacgcccuggacaaccuggucaugcuccacacguccgagcacggcgggaaggcguaccgccacgccguggaggagcugcccgagaccauggagacccugcuccugcugggccucaugauccugcugaccgggggcgccaugcuguuccugaucagcggcaaggggaucggcaagacgagcaucgggcugaucugcgugaucgccuccagcggcaugcucuggauggccgagaucccgcugcaguggaucgcguccgccaucguccuggaguucuucaugauggugcuccugauccccgagcccgagaagcagcggacgccccaggacaaccagcuggccuacguggucaucgggauccucacccuggccgccaccaucgcggccaacgagaugggccugcucgagacgaccaagcgcgaccugggcaugagcaaggagccggggguggugucccccaccagcuaccuggacgucgaccuccaccccgccuccgccuggacccuguacgcgguggccacgaccgugaucacccccaugcugcggcacaccaucgagaacagcacggccaacgucucccucgccgccaucgcgaaccaggccguggugcugaugggccuggacaagggguggccgaucagcaagauggaccucggcgucccccugcuggcccucgggugcuacucccaggugaacccccugacccugaccgccgccgugcuccugcugaucacccacuacgcgaucaucggccccggccuccaggccaaggccacgcgcgaggcccagaagcggaccgccgcggggaucaugaagaacccgaccgucgacggcaucaugaccaucgaccuggaccccgugaucuacgacagcaaguucgagaagcagcugggccaggugaugcuccugguccugugcgccgugcagcuccugcugaugcgcacguccugggcccucugcgaggcccugacccuggcgaccggccccaucaccacgcucugggagggcagccccgggaaguucuggaacaccaccaucgccguguccauggccaacaucuuccggggcagcuaccuggccggggccggccuggcguucuccaucaugaaguccgucgggaccggcaagcgcggcaccgggucccagggcgagacgcucggggagaaguggaagaagaagcugaaccagcugagccggaaggaguucgaccucuacaagaaguccggcaucaccgagguggaccgcaccgaggccaaggaggggcugaagcggggcgagaucacccaccacgccgugucccgcggcagcgccaagcugcagugguucgucgagcggaacauggugaucccggaggggcgcgugaucgaccucggcugcgggcggggcgggugguccuacuacugcgccggccugaagaaggucacggaggugcgcggcuacaccaagggcgggcccgggcacgaggagcccgugcccaugagcaccuacggcuggaacaucgucaagcugauguccgggaaggacguguucuaccucccgcccgagaagugcgacacccugcugugcgacaucggcgagagcucccccagccccacgguggaggagucccggaccauccgcguccugaagaugguggagccguggcucaagaacaaccaguucugcaucaaggugcugaaccccuacaugcccaccgucaucgagcaccuggagcgccuccagcggaagcacggcgggaugcuggugcgcaacccccugagccggaacuccacccacgagauguacuggaucagcaacggcacggggaacaucguggcguccgucaacauggugagccgccuccugcugaaccgguucaccaugacccaccgccggccgaccaucgagaaggacguggaccucggcgccggcacgcgccacgucaacgccgagcccgagacccccaacauggacgugaucggggagcggaucaagcgcaucaaggaggagcacaacuccaccuggcacuacgacgacgagaacccguacaagaccugggccuaccacggcagcuacgaggugaaggccacgggguccgcgagcuccaugaucaacggcgucgugaagcugcugaccaagcccugggacgucgugcccauggugacccagauggccaugaccgacacgacccccuucgggcagcagcgggucuucaaggagaagguggacacccgcaccccgcggagcaugcccggcacgcgccgggugaugggcaucaccgccgaguggcucuggcgcacccuggggcggaacaagaagccccgccugugcacccgggaggaguucacgaagaagguccgcaccaacgccgcgaugggcgccguguucaccgaggagaaccagugggacagcgccaaggccgccguggaggacgaggacuucuggaagcucgucgaccgcgagcgggagcugcacaagcuggggaagugcggcuccugcguguacaacaugauggggaagcgcgagaagaagcucggcgaguucggcaaggcgaaggggagccgggccaucugguacauguggcugggcgcccgcuaccuggaguucgaggcccucggguuccugaacgaggaccacugguucucccgggagaacagcuacuccggcguggagggggagggccugcacaagcucggcuacauccugcgcgacaucagcaagauccccgggggcgccauguacgcggacgacaccgccgggugggacacgcggaucaccgaggacgaccugcacaacgaggagaagaucacccagcagauggacccggagcaccgccagcucgccaacgccaucuucaagcugaccuaccagaacaaggucgugaaggugcagcggcccacccccacgggcaccgucauggacaucaucucccgcaaggaccagcggggcagcggccaggugggcaccuacgggcugaacaccuucacgaacauggaggcccagcucauccgccagauggagggcgagggggugcuguccaaggcggaccuggagaacccccaccucccggagaagaagaucacccaguggcuggagaccaagggcgucgagcggcugaagcgcauggccaucagcggcgacgacugcguggugaagcccaucgacgaccgguucgccaacgcccuccuggcccugaacgacauggggaagguccgcaaggacaucccccaguggcagcccuccaagggcuggcacgacuggcagcaggucccguucugcagccaccacuuccacgagcucaucaugaaggacgggcggaagcuggugguccccugccgcccccaggacgagcugaucggccgggcgcgcaucucccagggggccggcuggagccuccgggagaccgccugccugggcaaggccuacgcgcagauguggucccugauguacuuccaccgccgcgaccuccggcuggccagcaacgccaucugcuccgccgugcccgugcacugggucccgacgagccgcaccaccugguccauccacgcccaccaccaguggaugaccacggaggacaugcugaccguguggaaccggguguggaucgaggacaaccccuggauggaggacaagacccccgucaccacgugggagaacgugcccuaccucgggaagcgcgaggaccaguggugcggcagccugaucgggcugaccagccgggcgaccugggcccagaacaucccgaccgccauccagcagguccgcucccucaucggcaacgaggaguuccuggacuacaugcccagcaugaagcgguuccgcaaggaggaggaguccgagggggccaucugguga

SEQ ID NO: 10247 - RNA, 9873 nt, Artificial Sequence
  derived and/or modified CDS sequence (opt1) from DENV-3__FJ639782__SS-prME
accagccugugccucaugaugauccugcccgccgcccuggcguuccaccucaccagccgggacggggagccccggaugaucguggggaagaacgagcggggcaagagccugcuguucaagaccgccagcgggaucaacaugugcacccucaucgccauggaccugggggagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcggagcguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagaucguggggcuguacggcaacggggucgugacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggccaucguccgggaggcgaucaagcgccggcuccgcacccugauccuggcccccacccgggugguggccgccgagauggaggaggcccucaaggggcugcccauccgcuaccagaccacggcgaccaaguccgagcacaccggccgggagaucgucgaccugaugugccacgccaccuucacgaugcgccuccugagccccgugcgggugccgaacuacaaccugaucaucauggacgaggcccacuucaccgaccccgccuccaucgccgcgcgcggguacaucagcacccgggucggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucgugcccagcaucaaggcgggcaacgacaucgccaacugccuccggaagaacgggaagaaggucauccagcugucccgcaagacguucgacaccgaguaccagaagaccaagcugaacgacugggacuucguggugaccacggacaucagcgagaugggcgccaacuucaaggccgaccgggucaucgacccgcgccggugccucaagcccgugauccugaccgacggccccgagcgcgugauccuggccgggcccaugccggucaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcgcacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggugaccgagaucgggcgggugcccacccaccucgcccaccgcacccggaacgcccuggacaaccuggucaugcuccacacguccgagcacggcgggaaggccuaccgccacgcgguggaggagcugcccgagaccauggagacccugcuccugcugggccucaugauccugcugaccgggggcgccaugcuguuccugaucagcggcaaggggaucggcaagacgagcaucgggcugaucugcgugaucgccuccagcggcaugcucuggauggccgagaucccgcugcaguggaucgccuccgcgaucguccuggaguucuucaugauggugcuccugauccccgagcccgagaagcagcggacgccccaggacaaccagcuggccuacguggucaucgggauccucacccuggccgccaccaucgccgcgaacgagaugggccugcucgagacgaccaagcgcgaccugggcaugagcaaggagccggggguggugucccccaccagcuaccuggacgucgaccuccaccccgccuccgccuggacccuguacgccguggcgacgaccgugaucacccccaugcugcggcacaccaucgagaacagcacggccaacgucucccucgccgccaucgccaaccaggcgguggugcugaugggccuggacaagggguggccgaucagcaagauggaccucggcgucccccugcuggcccucgggugcuacucccaggugaacccccugacccugaccgccgccgugcuccugcugaucacccacuacgccaucaucggccccggccuccaggcgaaggccacgcgcgaggcccagaagcggaccgccgccgggaucaugaagaacccgaccgucgacggcaucaugaccaucgaccuggaccccgugaucuacgacagcaaguucgagaagcagcugggccaggugaugcuccugguccugugcgcggugcagcuccugcugaugcgcacguccugggcccucugcgaggcccugacccuggccaccggccccaucaccacgcucugggagggcagccccgggaaguucuggaacaccaccaucgcgguguccauggccaacaucuuccggggcagcuaccuggccggggccggccuggccuucuccaucaugaaguccgucgggaccggcaagcgcggcaccgggucccagggcgagacgcucggggagaaguggaagaagaagcugaaccagcugagccggaaggaguucgaccucuacaagaaguccggcaucaccgagguggaccgcaccgaggcgaaggaggggcugaagcggggcgagaucacccaccacgccgugucccgcggcagcgccaagcugcagugguucgucgagcggaacauggugaucccggaggggcgcgugaucgaccucggcugcgggcggggcgggugguccuacuacugcgccggccugaagaaggucacggaggugcgcggcuacaccaagggcgggcccgggcacgaggagcccgugcccaugagcaccuacggcuggaacaucgucaagcugauguccgggaaggacguguucuaccucccgcccgagaagugcgacacccugcugugcgacaucggcgagagcucccccagccccacgguggaggagucccggaccauccgcguccugaagaugguggagccguggcucaagaacaaccaguucugcaucaaggugcugaaccccuacaugcccaccgucaucgagcaccuggagcgccuccagcggaagcacggcgggaugcuggugcgcaacccccugagccggaacuccacccacgagauguacuggaucagcaacggcacggggaacaucguggccuccgucaacauggugagccgccuccugcugaaccgguucaccaugaccuaccgccggccgaccaucgagaaggacguggaccucggcgcgggcacgcgccacgucaacgccgagcccgagacccccaacauggacgugaucggggagcggaucaagcgcaucaaggaggagcacaacuccaccuggcacuacgacgacgagaacccguacaagaccugggccuaccacggcagcuacgaggugaaggccacgggguccgccagcuccaugaucaacggcgucgugaagcugcugaccaagcccugggacgucgugcccauggugacccagauggcgaugaccgacacgacccccuucgggcagcagcgggucuucaaggagaagguggacacccgcaccccgcggagcaugcccggcacgcgccgggugaugggcaucaccgccgaguggcucuggcgcacccuggggcggaacaagaagccccgccugugcacccgggaggaguucacgaagaagguccgcaccaacgccgccaugggcgcgguguucaccgaggagaaccagugggacagcgccaaggccgccguggaggacgaggacuucuggaagcucgucgaccgcgagcgggagcugcacaagcuggggaagugcggcuccugcguguacaacaugauggggaagcgcgagaagaagcucggcgaguucggcaaggccaaggggagccgggcgaucugguacauguggcugggcgcccgcuaccuggaguucgaggcccucggguuccugaacgaggaccacugguucucccgggagaacagcuacuccggcguggagggggagggccugcacaagcucggcuacauccugcgcgacaucagcaagauccccgggggcgccauguacgccgacgacaccgcggggugggacacgcggaucaccgaggacgaccugcacaacgaggagaagaucacccagcagauggacccggagcaccgccagcucgccaacgccaucuucaagcugaccuaccagaacaaggucgugaaggugcagcggcccacccccacgggcaccgucauggacaucaucucccgcaaggaccagcggggcagcggccaggugggcaccuacgggcugaacaccuucacgaacauggaggcccagcucauccgccagauggagggcgagggggugcuguccaaggccgaccuggagaacccccaccucccggagaagaagaucacccaguggcuggagaccaagggcgucgagcggcugaagcgcauggcgaucagcggcgacgacugcguggugaagcccaucgacgaccgguucgccaacgcccuccuggcccugaacgacauggggaagguccgcaaggacaucccccaguggcagcccuccaagggcuggcacgacuggcagcaggucccguucugcagccaccacuuccacgagcucaucaugaaggacgggcggaagcuggugguccccugccgcccccaggacgagcugaucggccgggcccgcaucucccagggggcgggcuggagccuccgggagaccgccugccugggcaaggccuacgcccagauguggucccugauguacuuccaccgccgcgaccuccggcuggcgagcaacgccaucugcuccgccgugcccgugcacugggucccgacgagccgcaccaccugguccauccacgcccaccaccaguggaugaccacggaggacaugcugaccguguggaaccggguguggaucgaggacaaccccuggauggaggacaagacccccgucaccacgugggagaacgugcccuaccucgggaagcgcgaggaccaguggugcggcagccugaucgggcugaccagccgggccaccugggcgcagaacaucccgaccgccauccagcagguccgcucccucaucggcaacgaggaguuccuggacuacaugcccagcaugaagcgguuccgcaaggaggaggaguccgagggggccaucugguga

SEQ ID NO: 10248 - RNA, 9873 nt, Artificial Sequence
  derived and/or modified CDS sequence (opt1) from DENV-3__FJ639785__SS-prME
accagccucugccucaugaugauccugcccgccgcccuggcguuccaccucaccagccgggacggcgagccccggaugaucguggggaagaacgagcggggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcggagcgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaccaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagacgugcaccuggccgaagucccacacccucuggagcaacggcgugcuggaguccgacaugaucauccccaagagccuggccgggcccaucucccagcacaacuaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcggggagguggacaacuucaccaugggcguccugugccucgccauccuguucgaggaggugaugcgggggaaguucggcaagaagcacaugaucgcggggguguucuucaccuucguccugcuccuguccggccagaucaccuggcgcgacauggcccacacgcugaucaugaucggcagcaacgccuccgaccggauggggaugggcgugaccuaccucgcccugaucgccaccuucaagauccagcccuuccuggcgcucggguucuuccugcgcaagcugaccagccgggagaaccuccugcugggcgugggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccaucuucacccugacggucgccuggcgcaccgccacccugauccucgcgggggugagccugcugccggucugccaguccagcuccaugcggaagaccgacuggcuccccaugacgguggccgccaugggcgugccgccccucccgcuguucaucuucagccucaaggacacccugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugacggucgagaaggccgcggacgugaccugggaggaggaggccgagcagaccggcgugagccacaaccugaugaucaccgucgacgacgacgggaccaugcgcaucaaggacgacgagacggagaacauccucaccgugcugcugaagaccgcccuccugaucguguccggcaucuucccguacagcauccccgccacccugcucgucuggcacacguggcagaagcagacccagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacacgauguggcacgugacccggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcacguuccagaccaccaccggggagaucggcgcgaucgcccuggacuucaagcccgggacgagcggcagccccaucaucaaccgcgagggcaagguggucgggcuguacggcaacgggguggugaccaagaacggcggguacgucuccggcaucgcccagaccaacgccgagccggacggccccacccccgagcuggaggaggagauguucaagaagcggaaccucacgaucauggaccugcaccccgggagcggcaagacccgcaaguaccugccggccaucgugcgggaggcgaucaagcgccggcuccgcacccugauccuggcccccacccggguggucgccgccgagauggaggaggcccucaaggggcugcccauccgcuaccagacgaccgcgaccaaguccgagcacaccggccgggagaucguggaccugaugugccacgccacguucaccaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugacggcgacgccgcccgggaccgccgacgccuucccgcaguccaacgcccccauccaggacgaggagcgcgacauccccgagcgcagcuggaacuccggcaacgaguggaucaccgacuucgccgggaagacggugugguucguccccagcaucaaggcgggcaacgacaucgccaacugccuccggaagaacgggaagaaggugauccagcugucccgcaagaccuucgacaccgaguaccagaagaccaagcugaacgacugggacuucguggucacgaccgacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggacggaggcgaagaugcugcuggacaacaucaacacccccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggacgaaggagggcgagaagaagaagcuccgcccccgguggcuggacgcccgcaccuacuccgacccgcuggcccucaaggaguucaaggacuucgccgcgggccgcaagagcaucgcccuggaccuggugaccgagaucgggcggguccccacccaccucgcccaccgcacgcggaacgcccuggacaaccuggugaugcuccacaccuccgagcacggcgggaaggccuaccgccacgcgguggaggagcugcccgagaccauggagacccugcuccugcugggccucaugauccugcugaccggcggggccaugcuguuccugaucagcgggaaggggaucggcaagaccagcaucgggcugaucugcgucaucgccuccagcggcaugcucuggauggccgagaucccgcugcaguggaucgccuccgcgaucgugcuggaguucuucaugauggugcuccugauccccgagcccgagaagcagcggacgccccaggacaaccagcuggccuacgucgugaucgggauccucacccuggccgccacgaucgccgcgaacgagaugggccugcucgagaccaccaagcgcgaccugggcaugagcaaggagccggggguggucucccccaccagcuaccuggacguggaccuccaccccgccuccgccuggacgcuguacgccguggcgaccaccgucaucacccccaugcugcggcacacgaucgagaacagcaccgccaacgugucccucgccgccaucgccaaccaggcggugguccugaugggccuggacaagggguggccgaucagcaagauggaccucggcgugccccugcuggcccucgggugcuacucccaggugaacccccugacccugaccgccgccguccuccugcugaucacgcacuacgccaucaucggccccggccuccaggcgaaggccacccgcgaggcccagaagcggaccgccgccgggaucaugaagaacccgaccguggacggcaucaugacgaucgaccuggaccccgugaucuacgacagcaaguucgagaagcagcuggggcaggucaugcuccuggugcugugcgcggugcagcuccugcugaugcgcaccuccugggcccucugcgaggcccugacccuggccaccggccccaucacgacccucugggagggcagccccgggaaguucuggaacaccaccaucgcggucuccauggccaacaucuuccggggcagcuaccuggccggggccggccuggccuucuccaucaugaaguccguggggaccggcaagcgcggcacggggucccagggcgagacccucggggagaaguggaagaagaagcugaaccagcugagccggaaggaguucgaccucuacaagaaguccggcaucaccgagguggaccgcaccgaggcgaaggaggggcugaagcggggcgagaucacgcaccacgccgucucccgcggcagcgccaagcugcagugguucguggagcggaacauggugaucccggaggggcgcgucaucgaccucggcugcgggcggggcgggugguccuacuacugcgccggccugaagaaggugaccgaggugcgcggcuacaccaagggcgggcccgggcacgaggagcccguccccaugagcaccuacggcuggaacaucgugaagcugauguccgggaaggacguguucuaccucccgcccgagaagugcgacacgcugcugugcgacaucggcgagagcucccccagccccaccgucgaggagucccggaccauccgcgugcugaagaugguggagccguggcucaagaacaaccaguucugcaucaagguccugaaccccuacaugcccaccgugaucgagcaccuggagcgccuccagcggaagcacggcgggaugcuggugcgcaacccccugagccggaacuccacgcacgagauguacuggaucagcaacggcaccgggaacaucgucgccuccgugaacauggugagccgccuccugcugaaccgguucaccaugacccaccgccggccgacgaucgagaaggacgucgaccucggcgcgggcacccgccacgugaacgccgagcccgagacccccaacauggacgugaucggggagcggaucaagcgcaucaaggaggagcacaacuccaccuggcacuacgacgacgagaacccguacaagacgugggccuaccacggcagcuacgaggucaaggccaccggguccgccagcuccaugaucaacggcguggucaagcugcugaccaagcccugggacguggugcccauggucacccagauggcgaugacggacaccacccccuucgggcagcagcggguguucaaggagaagguggacacccgcacgccgcggagcaugcccggcacccgccgggucaugggcaucaccgccgaguggcucuggcgcacccuggggcggaacaagaagccccgccugugcacgcgggaggaguucaccaagaaggugcgcaccaacgccgccaugggcgcgguguucaccgaggagaaccagugggacagcgccaaggccgccgucgaggacgaggacuucuggaagcucguggaccgcgagcgggagcugcacaagcuggggaagugcggcuccugcguguacaacaugauggggaagcgcgagaagaagcucggcgaguucggcaaggccaaggggagccgggcgaucugguacauguggcugggcgcccgcuaccuggaguucgaggcccucggguuccugaacgaggaccacugguucucccgggagaacagcuacuccggcgucgagggggagggccugcacaagcucggcuacauccugcgcgacaucagcaagauccccgggggcgccauguacgccgacgacacggcggggugggacacccggaucaccgaggacgaccugcacaacgaggagaagaucacccagcagauggacccggagcaccgccagcucgccaacgccaucuucaagcugaccuaccagaacaagguggugaagguccagcggcccacgcccaccggcaccgugauggacaucaucucccgcaaggaccagcggggcagcggccaggugggcaccuacgggcugaacacguucaccaacauggaggcccagcucauccgccagauggagggcgaggggguccuguccaaggccgaccuggagaacccccaccucccggagaagaagaucacccaguggcuggagaccaagggcguggagcggcugaagcgcauggcgaucagcggcgacgacugcguggucaagcccaucgacgaccgguucgccaacgcccuccuggcccugaacgacauggggaaggugcgcaaggacaucccccaguggcagcccuccaagggcuggcacgacuggcagcaggucccguucugcagccaccacuuccacgagcucaucaugaaggacgggcggaagcuggucgugcccugccgcccccaggacgagcugaucggccgggcccgcaucucccagggggcgggcuggagccuccgggagacggccugccugggcaaggccuacgcccagauguggucccugauguacuuccaccgccgcgaccuccggcuggcgagcaacgccaucugcuccgccgugcccguccacugggugccgaccagccgcaccaccugguccauccacgcccaccaccaguggaugacgaccgaggacaugcugaccguguggaaccgggucuggaucgaggacaaccccuggauggaggacaagacccccgugacgaccugggagaacgugcccuaccucgggaagcgcgaggaccaguggugcggcagccugaucgggcugaccagccgggccaccugggcgcagaacaucccgacggccauccagcagguccgcucccucaucggcaacgaggaguuccuggacuacaugcccagcaugaagcgguuccgcaaggaggaggaguccgagggggccaucugguga

SEQ ID NO: 10249 - RNA, 9873 nt, Artificial Sequence
  derived and/or modified CDS sequence (opt1) from DENV-3__FJ639786__SS-prME
accagccucugccucaugaugauccugcccgccgcccuggcguuccaccucaccagccgggacggcgagccgcggaugaucguggggaagaacgagcggggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcggagcgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccugggccagcggcgccaccaccgagacccccacguggaaccgcaaggagcuccuggugaccuucaagaacgcccacgcgaagaagcaggaggucguggugcuggggucccaggagggcgccaugcacaccgcccucaccggggccacggagauccagaacagcggcgggaccuccaucuucgccggccaccugaagugccggcugaagauggacaagcucgagcugaagggcaugagcuacgcgaugugcaccaacaccuucguccugaagaaggagguguccgagacgcagcacgggaccauccucaucaagguggaguacaagggcgaggacgucccgugcaagauccccuucagcaccgaggacgggcagggcaaggcccacaacggccgccugaucaccgccaaccccguggugacgaagaaggaggagcccgucaacaucgaggccgagccgcccuucggggagagcaacaucgugaucggcaucggggacaacgcgcugaagaucaacugguacaagaagggcuccagcaucgggaagauguucgaggccaccgcccggggcgcccgccggauggccauccugggcgacaccgcgugggacuucggguccgugggcgggguccucaacagccugggcaagauggugcaccagaucuucggguccgccuacaccgcccuguucagcggcguguccugggucaugaagaucggcaucggggugcuccugacguggaucggccugaacagcaagaacaccuccaugagcuucuccugcaucgccaucgggaucaucacccucuaccugggcgccgugguccaggcggacauggggugcgugaucaacuggaagggcaaggagcugaagugcggcagcgggaucuucgugaccaacgagguccacacguggaccgagcaguacaaguuccaggccgacucccccaagcgccucgccaccgccaucgccggcgcgugggagaacggggugugcggcauccgcagcaccacgcggauggagaaccugcuguggaagcagaucgccaacgagcucaacuacauccugugggagaacaacaucaagcugaccguggucgugggggacaucaucggcgugcucgagcagggcaagcgcacccugacgccccagccgauggagcugaaguacuccuggaagacgugggggaaggccaagaucgucaccgccgagacccagaacagcuccuucaucaucgacggccccaacacccccgagugccccagcgcgucccgggccuggaacgugugggagguggaggacuacggguucggcgucuucacgaccaacaucuggcucaagcugcgcgagguguacacccagcugugcgaccaccggcucaugagcgccgccgugaaggacgagcgcgccguccacgcggacaugggcuacuggaucgagagccagaagaacggguccuggaagcuggagaaggccagccugaucgaggugaagaccugcaccuggccgaagucccacacgcucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcaccacggucgugaucaccgagaacugcgggacccgcggccccagccuccggaccacgaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucaccaugggcguccugugccucgcgauccuguucgaggaggugaugcgggggaaguucggcaagaagcacaugaucgccgggguguucuucacguucguccugcuccuguccggccagaucaccuggcgcgacauggcccacacccugaucaugaucggcagcaacgccuccgaccggauggggaugggcgugaccuaccucgcccugaucgcgacguucaagauccagcccuuccuggcccucggguucuuccugcgcaagcugaccagccgggagaaccuccugcugggcgugggccucgccauggccaccacccugcagcugcccgaggacaucgagcagauggcgaacgggaucgcccucggccugauggcccugaagcucaucacgcaguucgagaccuaccagcuguggaccgcccugaucagccugaccugcuccaacacgaucuucacccugaccgucgccuggcgcaccgcgacgcugauccucgccggggugagccugcugccggucugccaguccagcuccaugcggaagaccgacuggcuccccaugaccguggccgccaugggcgugccgccccucccgcuguucaucuucagccucaaggacacccugaagcgccgcuccuggccccugaacgagggggucauggccgugggccucgugagcauccuggcguccagccugcuccggaacgacguccccauggccggcccccugguggccgggggccugcucaucgccugcuacgugaucacggggaccuccgccgaccugaccgucgagaaggcggccgacgugaccugggaggaggaggccgagcagacgggcgugagccacaaccugaugaucaccgucgacgacgacgggaccaugcgcaucaaggacgacgagaccgagaacauccucaccgugcugcugaagacggcccuccugaucguguccggcaucuucccguacagcauccccgccacccugcucgucuggcacaccuggcagaagcagacccagcgguccggcgugcugugggacgugcccagcccgcccgagacgcagaaggcggagcuggaggagggggucuaccgcaucaagcagcagggcaucuucgggaagacccaggugggcguggggguccagaaggagggcguguuccacaccauguggcacgugacccggggcgccguccucacguacaacgggaagcgccuggagcccaacugggccuccgugaagaaggaccugaucagcuacggcgggggcuggcggcucuccgcccaguggcagaagggggaggaggugcaggucaucgcgguggagcccggcaagaaccccaagaacuuccagaccaugcccggcaccuuccagaccacgaccggggagaucggcgccaucgcccuggacuucaagcccgggaccagcggcagccccaucaucaaccgcgagggcaagguggucgggcuguacggcaacgggguggugaccaagaacggcggguacgucuccggcaucgcccagacgaacgccgagccggacggccccacccccgagcuggaggaggagauguucaagaagcggaaccucaccaucauggaccugcaccccgggagcggcaagacccgcaaguaccugccggcgaucgugcgggaggccaucaagcgccggcuccgcacgcugauccuggcccccacccggguggucgccgccgagauggaggaggcgcucaaggggcugcccauccgcuaccagaccaccgccacgaaguccgagcacaccggccgggagaucguggaccugaugugccacgccaccuucaccaugcgccuccugagccccgugcgggucccgaacuacaaccugaucaucauggacgaggcccacuucacggaccccgccuccaucgcggcccgcggguacaucagcacccgggugggcaugggcgaggccgccgcgaucuucaugaccgccacgccgcccgggacggccgacgccuucccgcaguccaacgcccccauccaggacgaggagcgcgacauccccgagcgcagcuggaacuccggcaacgaguggaucaccgacuucgcggggaagaccgugugguucguccccagcaucaaggccggcaacgacaucgccaacugccuccggaagaacgggaagaaggugauccagcugucccgcaagaccuucgacacggaguaccagaagaccaagcugaacgacugggacuucguggucaccaccgacaucagcgagaugggcgccaacuucaagacggaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggugaccgagaucgggcggguccccacccaccucgcccaccgcacccggaacgcccuggacaaccuggugaugcuccacacguccgagcacggcgggaaggccuaccgccacgcgguggaggagcugcccgagaccauggagacccugcuccugcugggccucaugauccugcugaccgggggcgccaugcuguuccugaucagcggcaaggggaucggcaagacgagcaucgggcugaucugcgucaucgccuccagcggcaugcucuggauggccgagaucccgcugcaguggaucgccuccgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccacgaagcgcgaccugggcaugagcaaggagccggggguggucucccccaccagcuaccuggacguggaccuccaccccgccuccgccuggacccuguacgccguggcgaccacggucaucacccccaugcugcggcacaccaucgagaacagcaccgccaacgugucccucgccgccaucgccaaccaggcggugguccugaugggccuggacaagggguggccgaucagcaagauggaccucggcgugccccugcuggcccucgggugcuacucccaggugaacccccugacgcugaccgccgccguccuccugcugaucacccacuacgccaucaucggccccggccuccaggcgaaggccacccgcgaggcccagaagcggacggccgccgggaucaugaagaacccgaccguggacggcaucaugaccaucgaccuggaccccgugaucuacgacagcaaguucgagaagcagcuggggcaggucaugcuccuggugcugugcgcggugcagcuccugcugaugcgcaccuccugggcccucugcgaggcccugacgcuggccaccggccccaucaccacccucugggagggcagccccgggaaguucuggaacacgaccaucgcggucuccauggccaacaucuuccggggcagcuaccuggccggggccggccuggccuucuccaucaugaaguccguggggaccggcaagcgcggcaccgggucccagggcgagacccucggggagaaguggaagaagaagcugaaccagcugagccggcgcgaguucgaccucuacaagaaguccggcaucacggagguggaccggaccgaggcgaaggaggggcugaagcgcggcgagaucacccaccacgccgucucccggggcagcgccaagcugcagugguucguggagcgcaacauggugaucccggaggggcgggucaucgaccucggcugcgggcgcggcgggugguccuacuacugcgccggccugaagaaggugaccgaggugcggggcuacacgaagggcgggcccgggcacgaggagcccguccccaugagcaccuacggcuggaacaucgugaagcugauguccgggaaggacguguucuaccucccgcccgagaagugcgacacccugcugugcgacaucggcgagagcucccccagccccaccgucgaggagucccgcacgauccgcgugcugaagaugguggagccguggcucaagaacaaccaguucugcaucaagguccugaaccccuacaugcccaccgugaucgagcaccuggagcggcuccagcgcaagcacggcgggaugcuggugcggaacccccugagccgcaacuccacccacgagauguacuggaucagcaacggcaccgggaacaucgucgccuccgugaacauggugagccggcuccugcugaaccgcuucacgaugacccaccggcgcccgaccaucgagaaggacgucgaccucggcgcgggcacccggcacgugaacgccgagcccgagacgcccaacauggacgugaucggggagcgcaucaagcggaucaaggaggagcacaacuccaccuggcacuacgacgacgagaacccguacaagaccugggccuaccacggcagcuacgaggucaaggccaccggguccgccagcuccaugaucaacggcguggucaagcugcugacgaagcccugggacguggugcccauggucacccagauggcgaugaccgacaccacgcccuucgggcagcagcgcguguucaaggagaagguggacacccggaccccgcgccccaugcccggcacccggcgcgucaugggcaucacggccgaguggcucuggcggacccuggggcgcaacaagaagccccggcugugcacccgcgaggaguucaccaagaaggugcgcacgaacgccgccaugggcgcgguguucaccgaggagaaccagugggacagcgccaaggccgccgucgaggacgaggacuucuggaagcucguggaccgggagcgcgagcugcacaagcuggggaagugcggcagcugcguguacaacaugauggggaagcgggagaagaagcucggcgaguucggcaaggccaaggggucccgcgcgaucugguacauguggcugggcgcccgguaccuggaguucgaggcccucggguuccugaacgaggaccacugguucagccgcgagaacuccuacagcggcgucgagggggagggccugcacaagcucggcuacauccugcgggacaucuccaagauccccggcggggccauguacgccgacgacaccgcggggugggacacccgcaucacggaggacgaccugcacaacgaggagaagaucacccagcagauggaccccgagcaccggcagcucgccaacgccaucuucaagcugaccuaccagaacaagguggugaagguccagcgccccacccccaccgggacggugauggacaucaucagccggaaggaccagcgcggcuccggccaggugggcaccuacgggcugaacaccuucaccaacauggaggcccagcucauccggcagauggagggcgaggggguccugagcaaggccgaccuggagaacccgcaccuccccgagaagaagaucacgcaguggcuggagaccaagggcguggagcgccugaagcggauggcgaucuccggcgacgacugcguggucaagcccaucgacgaccgcuucgccaacgcccuccuggcccugaacgacauggggaaggugcggaaggacaucccccaguggcagccgagcaagggcuggcacgacuggcagcagguccccuucugcucccaccacuuccacgagcucaucaugaaggacgggcgcaagcuggucgugcccugccggccccaggacgagcugaucggccgcgcccggaucagccagggggcgggcuggucccuccgcgagaccgccugccugggcaaggccuacgcccagauguggagccugauguacuuccaccgccgggaccuccgccuggcguccaacgccaucugcagcgccgugccgguccacugggugcccaccucccggacgaccuggagcauccacgcccaccaccaguggaugaccaccgaggacaugcugacgguguggaaccgcgucuggaucgaggacaaccccuggauggaggacaagacccccgugaccaccugggagaacgugccguaccucgggaagcgggaggaccaguggugcggcucccugaucgggcugacgagccgcgccaccugggcgcagaacaucagcaccgccauccagcagguccggucccucaucggcaacgaggaguuccuggacuacaugcccagcaugaagcgcuuccggaaggaggaggaguccgagggggccaucugguga

SEQ ID NO: 10250 - RNA, 9873 nt, Artificial Sequence
  derived and/or modified CDS sequence (opt1) from DENV-3__FJ639787__SS-prME
accagccugugccucaugaugauccugcccgccgcccuggcguuccaccucaccagccgggacggcgagccgcggaugaucguggggaagaacgagcggggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcggagcgucgcccucgcgccccacgugggcauggggcuggacacccgcacccagaccuggcugagcgccgagggcgccuggcgccagguggagaaggucgagacgugggcccuccgccacccgggguucaccauccuggcgcuguuccucgcccacuacaucggcaccagccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccgugcucccggaggagcaggaccagaacuacgucugcaagcacaccuacguggaccggggguggggcaacgggugcggccuguucgggaagggcucccuggugaccugcgccaaguuccagugccucgagcccaucgagggcaaggucgugcaguacgagaaccugaaguacaccgugaucaucacgguccacaccggggaccagcaccaggugggcaacgagacccagggggucaccgccgagaucacgccccaggccagcaccaccgaggcgauccugcccgaguacggcacccucgggcuggagugcuccccgcgcaccggccuggacuucaacgagaugauccuccugacgaugaagaacaaggccuggauggugcaccggcagugguucuucgaccugccccuccccuggaccagcggcgccaccaccgagacgcccaccuggaaccgcaaggagcugcuggugaccuucaagaacgcccacgccaagaagcaggaggucguggugcucgggucccaggagggcgcgaugcacaccgcccugacgggggccaccgagauccagaacagcggcgggaccuccaucuucgccggccaccugaagugccggcucaagauggacaagcuggagcugaagggcaugagcuacgccaugugcaccaacacguucguccucaagaaggagguguccgagacccagcacgggaccauccugaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccucggcgacaccgccugggacuucggguccgugggcgggguccugaacagccugggcaagauggugcaccagaucuucggguccgcguacacggcccucuucagcggcguguccugggucaugaagaucggcaucggggugcugcugaccuggaucggccucaacagcaagaacaccuccaugagcuucuccugcaucgccaucgggaucaucacccuguaccugggcgccgugguccaggccgacauggggugcgugaucaacuggaagggcaaggagcucaagugcggcagcgggaucuucgugacgaacgagguccacaccuggaccgagcaguacaaguuccaggcggacucccccaagcgccuggccaccgccaucgccggcgccugggagaacggggugugcggcauccgcagcacgacccggauggagaaccugcucuggaagcagaucgcgaacgagcugaacuacauccugugggagaacaacaucaagcucaccguggucgugggggacaccaucggcgugcuggagcagggcaagcgcacgcugacgccccagccgauggagcucaaguacuccuggaagaccugggggaaggccaagaucgucaccgccgagacgcagaacagcuccuucaucaucgacggccccaacacccccgagugccccagcgccucccgggcguggaacgugugggagguggaggacuacggguucggcgucuucaccaccaacaucuggcugaagcugcgcgagguguacacccagcucugcgaccaccggcugaugagcgccgccgugaaggacgagcgcgccguccacgccgacaugggcuacuggaucgagagccagaagaacggguccuggaagcuggagaaggcgagccucaucgaggugaagacgugcaccuggccgaagucccacacccuguggagcaacggcgugcuggaguccgacaugaucauccccaagagccucgccgggcccaucucccagcacaacuaccggccgggcuaccacacccagacggccgggcccuggcaccugggcaagcuggagcucgacuucaacuacugcgagggcaccaccgucgugaucaccgagaacugcgggacgcgcggccccagccugcggaccaccaccguguccgggaagcugauccacgaguggugcugccgcagcugcacgcugccgccccugcgguacaugggcgaggacgggugcugguacggcauggagauccgccccaucuccgagaaggaggagaacauggucaagagccugguguccgccggcagcggggagguggacaacuucaccaugggcguccucugccuggccauccuguucgaggaggugaugcgggggaaguucggcaagaagcacaugaucgcggggguguucuucaccuucguccuccugcuguccggccagaucaccuggcgcgacauggcccacacgcucaucaugaucggcagcaacgccuccgaccggauggggaugggcgugaccuaccuggcccugaucgccaccuucaagauccagcccuuccucgcgcugggguucuuccugcgcaagcucaccagccgggagaaccugcugcucggcgugggccuggccauggccacgacccugcagcuccccgaggacaucgagcagauggccaacgggaucgcgcugggccugauggcccucaagcugaucacccaguucgagaccuaccagcuguggacggcccucaucagccugaccugcuccaacaccaucuucacccugacggucgccuggcgcaccgccacccucauccuggcgggggugagccugcuccccgucugccaguccagcuccaugcggaagaccgacuggcugcccaugacgguggccgccaugggcgugccgccccucccccuguucaucuucagccugaaggacacccugaagcgccgcuccuggccccucaacgagggggucauggccgugggccuggugagcauccuggccuccagccuccugcggaacgacguccccauggcgggcccccugguggccgggggccuccugaucgccugcuacgugaucaccgggaccuccgccgaccugacggucgagaaggccgcggacgugaccugggaggaggaggccgagcagaccggcgugagccacaaccucaugaucaccgucgacgacgacgggaccaugcgcaucaaggacgacgagacggagaacauccugaccgugcugcucaagaccgcccugcugaucguguccggcaucuucccguacagcauccccgccacccuccuggucuggcacacguggcagaagcagacccagcgguccggcgugcugugggacgugcccuccccgcccgagacccagaaggccgagcucgaggagggggucuaccgcaucaagcagcagggcaucuucgggaagacccaggugggcguggggguccagaaggagggcguguuccacacgauguggcacgugacccggggcgcgguccugaccuacaacgggaagcgccuggagcccaacugggccuccgugaagaaggaccucaucagcuacggcgggggcuggcggcuguccgcccaguggcagaagggggaggaggugcaggucaucgccguggagcccggcaagaaccccaagaacuuccagaccaugccgggcacguuccagaccaccaccggggagaucggcgcgaucgcccuggacuucaagcccgggacgagcggcagccccaucaucaaccgcgagggcaagguggucgggcuguacggcaacgggguggugaccaagaacggcggguacgucuccggcaucgcccagaccaacgccgagccggacggccccacccccgagcucgaggaggagauguucaagaagcggaaccugacgaucauggaccugcaccccgggagcggcaagacccgcaaguaccucccggccaucgugcgggaggcgaucaagcgccggcugcgcacccugauccucgcccccacccggguggucgccgccgagauggaggaggcccugaaggggcugcccauccgcuaccagacgaccgcgaccaaguccgagcacaccggccgggagaucguggaccucaugugccacgccacguucaccaugcgccugcugagccccgugcgggucccgaacuacaaccucaucaucauggacgaggcccacuucaccgaccccgccuccaucgccgcgcgcggguacaucagcacccgggugggcaugggcgaggccgccgccaucuucaugacggcgacgccgcccgggaccgccgacgccuucccgcaguccaacgcccccauccaggacgaggagcgcgacauccccgagcgcagcuggaacuccggcaacgaguggaucaccgacuucgccgggaagacggugugguucguccccagcaucaaggcgggcaacgacaucgccaacugccugcggaagaacgggaagaaggugauccagcugucccgcaagaccuucgacaccgaguaccagaagaccaagcucaacgacugggacuucguggucacgaccgacaucagcgagaugggcgccaacuucaaggccgaccgggugaucgacccgcgccggugccugaagcccgugauccugaccgacggccccgagcgcgucauccucgccgggcccaugccggugaccgcggccuccgccgcccagcggcgcggccggguggggcgcaacccccagaaggagaacgaccaguacaucuucaccggccagccccugaacaacgacgaggaccacgcccacuggacggaggcgaagaugcugcucgacaacaucaacacccccgaggggaucaucccggcccuguucgagcccgagcgggagaaguccgccgccaucgacggcgaguaccgccugaagggcgagucccggaagaccuucgucgagcucaugcgccgcggggaccugcccguguggcuggcgcacaaggucgccagcgagggcaucaaguacaccgaccgcaaguggugcuucgacgggcagcggaacaaccagauccucgaggagaacauggacguggagaucuggacgaaggagggcgagaagaagaagcugcgcccccgguggcuggacgcccgcaccuacuccgacccgcucgcccugaaggaguucaaggacuucgccgcgggccgcaagagcaucgcccuggaccucgugaccgagaucgggcggguccccacccaccuggcccaccgcacgcggaacgcccuggacaaccucgugaugcugcacaccuccgagcacggcgggaaggccuaccgccacgcgguggaggagcugcccgagaccauggagacccuccugcugcucggccugaugauccugcucaccggcggggccaugcuguuccugaucagcgggaaggggaucggcaagaccagcaucgggcucaucugcgucaucgccuccagcggcaugcuguggauggccgagaucccgcugcaguggaucgccuccgcgaucgugcucgaguucuucaugauggugcugcugauccccgagcccgagaagcagcggacgccccaggacaaccagcucgccuacgucgugaucgggauccugacccuggccgccacgaucgccgcgaacgagaugggccuccuggagaccaccaagcgcgaccugggcaugagcaaggagccggggguggucucccccaccagcuaccucgacguggaccugcaccccgccuccgccuggacgcuguacgccguggcgaccaccgucaucacccccaugcuccggcacacgaucgagaacagcaccgccaacgugucccuggccgccaucgccaaccaggcggugguccugaugggccucgacaagggguggccgaucagcaagauggaccugggcgugccccugcucgcccuggggugcuacucccaggugaacccccugacccucaccgccgccguccugcugcucaucacgcacuacgccaucaucggccccggccugcaggcgaaggccacccgcgaggcccagaagcggaccgccgccgggaucaugaagaacccgaccguggacggcaucaugacgaucgaccuggaccccgugaucuacgacagcaaguucgagaagcagcucgggcaggucaugcugcuggugcucugcgcggugcagcugcugcucaugcgcaccuccugggcccugugcgaggcccugacccucgccaccggccccaucacgacccugugggagggcagccccgggaaguucuggaacaccaccaucgcggucuccauggccaacaucuuccggggcagcuaccuggccggggccggccucgccuucuccaucaugaaguccguggggaccggcaagcgcggcacggggucccagggcgagacccugggggagaaguggaagaagaagcugaaccagcucagccggaaggaguucgaccuguacaagaaguccggcaucaccgagguggaccgcaccgaggcgaaggaggggcugaagcggggcgagaucacgcaccacgccgucucccgcggcagcgccaagcuccagugguucguggagcggaacauggugaucccggaggggcgcgucaucgaccugggcugcgggcggggcgggugguccuacuacugcgccggccugaagaaggugaccgaggugcgcggcuacaccaagggcgggcccgggcacgaggagcccguccccaugagcaccuacggcuggaacaucgugaagcucauguccgggaaggacguguucuaccugccgcccgagaagugcgacacgcugcugugcgacaucggcgagagcucccccagccccaccgucgaggagucccggaccauccgcgugcucaagaugguggagccguggcugaagaacaaccaguucugcaucaagguccugaaccccuacaugcccaccgugaucgagcaccucgagcgccugcagcggaagcacggcgggaugcuggugcgcaacccccucagccggaacuccacgcacgagauguacuggaucagcaacggcaccgggaacaucgucgccuccgugaacauggugagccgccugcugcucaaccgguucaccaugacccaccgccggccgacgaucgagaaggacgucgaccugggcgcgggcacccgccacgugaacgccgagcccgagacccccaacauggacgugaucggggagcggaucaagcgcaucaaggaggagcacaacuccaccuggcacuacgacgacgagaacccguacaagacgugggccuaccacggcagcuacgaggucaaggccaccggguccgccagcuccaugaucaacggcguggucaagcugcucaccaagcccugggacguggugcccauggucacccagauggcgaugacggacaccacccccuucgggcagcagcggguguucaaggagaagguggacacccgcacgccgcggagcaugcccggcacccgccgggucaugggcaucaccgccgaguggcuguggcgcacccuggggcggaacaagaagccccgccucugcacgcgggaggaguucaccaagaaggugcgcaccaacgccgccaugggcgcgguguucaccgaggagaaccagugggacagcgccaaggccgccgucgaggacgaggacuucuggaagcugguggaccgcgagcgggagcugcacaagcucgggaagugcggcuccugcguguacaacaugauggggaagcgcgagaagaagcugggcgaguucggcaaggccaaggggagccgggcgaucugguacauguggcugggcgcccgcuaccucgaguucgaggcccugggguuccugaacgaggaccacugguucucccgggagaacagcuacuccggcgucgagggggagggccuccacaagcugggcuacauccugcgcgacaucagcaagauccccgggggcgccauguacgccgacgacacggcggggugggacacccggaucaccgaggacgaccuccacaacgaggagaagaucacccagcagauggacccggagcaccgccagcuggccaacgccaucuucaagcugaccuaccagaacaagguggugaagguccagcggcccacgcccaccggcaccgugauggacaucaucucccgcaaggaccagcggggcagcggccaggugggcaccuacgggcucaacacguucaccaacauggaggcccagcugauccgccagauggagggcgaggggguccuguccaaggccgaccucgagaacccccaccucccggagaagaagaucacccaguggcuggagaccaagggcguggagcggcucaagcgcauggcgaucagcggcgacgacugcguggucaagcccaucgacgaccgguucgccaacgcccugcuggcccucaacgacauggggaaggugcgcaaggacaucccccaguggcagcccuccaagggcuggcacgacuggcagcaggucccguucugcagccaccacuuccacgagcugaucaugaaggacgggcggaagcuggucgugcccugccgcccccaggacgagcucaucggccgggcccgcaucucccagggggcgggcuggagccugcgggagacggccugccugggcaaggccuacgcccagauguggucccucauguacuuccaccgccgcgaccugcggcuggcgagcaacgccaucugcuccgccgugcccguccacugggugccgaccagccgcaccaccugguccauccacgcccaccaccaguggaugacgaccgaggacaugcucaccguguggaaccgggucuggaucgaggacaaccccuggauggaggacaagacccccgugacgaccugggagaacgugcccuaccuggggaagcgcgaggaccaguggugcggcagccugaucgggcucaccagccgggccaccugggcgcagaacaucccgacggccauccagcagguccgcucccugaucggcaacgaggaguuccuggacuacaugcccagcaugaagcgguuccgcaaggaggaggaguccgagggggccaucugguga

SEQ ID NO: 10251 - RNA, 9873 nt, Artificial Sequence
  derived and/or modified CDS sequence (opt1) from DENV-3__FJ639790__SS-prME
accagccugugccucaugaugauccugcccgccgcccuggcguuccaccucaccucccgggacggggagccgcggaugaucguggggaagaacgagcggggcaagagccugcuguucaagaccgccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguuccugaccuucguccuccugcuguccggccagaucaccuggcgcgacauggcccacacccucaucaugaucggcagcaacgccuccgaccggauggggaugggcgugacguaccuggcccugaucgccaccuucaagauccagcccuuccucgcgcugggguucuuccugcgcaagcucaccagccgggagaaccugcugcucggcgugggccuggccauggccaccacgcugcagcuccccgaggacaucgagcagauggccaacgggaucgcgcugggccugauggcccucaagcugaucacccaguucgagaccuaccagcuguggaccgcccucaucagccugacgugcuccaacaccaucuucacccugaccgucgccuggcgcacggccacccucauccuggcgggggugagccugcucccggucugccaguccagcuccaugcggaagaccgacuggcugcccaugaccguggccgccaugggcgugccgccccugccccuguucaucuucaaccugaaggacacgcugaagcgccgcagcuggccccucaacgagggggucauggccgugggccugguguccauccuggccagcucccuccugcggaacgacguccccauggcgggcccccugguggccgggggccuccugaucgccugcuacgugaucaccgggaccagcgccgaccugaccgucgagaaggccgcggacgugacgugggaggaggaggccgagcagaccggcgugucccacaaccucaugaucaccgucgacgacgacgggaccaugcgcaucaaggacgacgagaccgagaacauccugacggugcugcucaagaccgcccugcugaucgugagcggcaucuucccguacuccauccccgccacccuccuggucuggcacaccuggcagaagcagacgcagcggagcggcgugcugugggacgugcccagcccgcccgagacccagaaggccgagcucgaggagggggucuaccgcaucaagcagcagggcaucuucgggaagacccaggugggcguggggguccagaaggagggcguguuccacaccauguggcacgugacgcggggcgcgguccugaccuacaacgggaagcgccuggagcccaacugggccagcgugaagaaggaccucaucuccuacggcgggggcuggcggcugagcgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccuccggcagccccaucaucaaccgcgagggcaagguggucgggcuguacggcaacgggguggugacgaagaacggcggguacgucagcggcaucgcccagaccaacgccgagccggacggccccacccccgagcucgaggaggagauguucaagaagcggaaccugaccaucauggaccugcaccccggguccggcaagacgcgcaaguaccucccggccaucgugcgggaggcgaucaagcgccggcugcgcacccugauccucgcccccacccggguggucgccgccgagauggaggaggcccugaaggggcugcccauccgcuaccagaccacggcgaccaagagcgagcacaccggccgggagaucguggaccucaugugccacgccaccuucacgaugcgccugcugucccccgugcgggucccgaacuacaaccucaucaucauggacgaggcccacuucaccgaccccgccagcaucgccgcgcgcggguacaucuccacccgggugggcaugggcgaggccgccgccaucuucaugaccgcgacgccgcccgggaccgccgacgccuucccgcagagcaacgcccccauccaggacgaggagcgcgacauccccgagcgcuccuggaacagcggcaacgaguggaucaccgacuucgccgggaagaccgugugguucguccccuccaucaaggcgggcaacgacaucgccaacugccugcggaagaacgggaagaaggugauccagcugagccgcaagacguucgacaccgaguaccagaagaccaagcucaacgacugggacuucguggucaccacggacaucuccgagaugggcgccaacuucaaggccgaccgggugaucgacccgcgccggugccugaagcccgugauccugaccgacggccccgagcgcgucauccucgccgggcccaugccggugaccgcggccagcgccgcccagcggcgcggccggguggggcgcaacccccagaaggagaacgaccaguacaucuucaccggccagccccugaacaacgacgaggaccacgcccacuggaccgaggcgaagaugcugcucgacaacaucaacacgcccgaggggaucaucccggcccuguucgagcccgagcgggagaaguccgccgccaucgacggcgaguaccgccugaagggcgagagccggaagaccuucgucgagcucaugcgccgcggggaccugcccguguggcuggcgcacaaggucgccuccgagggcaucaaguacaccgaccgcaaguggugcuucgacgggcagcggaacaaccagauccucgaggagaacauggacguggagaucuggaccaaggagggcgagaagaagaagcugcgcccccgguggcuggacgcccgcacguacagcgacccgcucgcccugaaggaguucaaggacuucgccgcgggccgcaaguccaucgcccuggaccucgugaccgagaucgggcggguccccacccaccuggcccaccgcacccggaacgcccuggacaaccucgugaugcugcacacgagcgagcacggcgggaaggccuaccgccacgcgguggaggagcugcccgagaccauggagacccuccugcugcucggccugaugauccugcucaccgggggcgccaugcuguuccugaucuccggcaaggggaucggcaagacgagcaucgggcucaucugcgucaucgccagcuccggcaugcuguggauggccgagaucccgcugcaguggaucgccagcgcgaucgugcucgaguucuucaugauggugcugcugauccccgagcccgagaagcagcggacgccccaggacaaccagcucgccuacgucgugaucgggauccugacccuggccgccaucaucgccgcgaacgagaugggccuccuggagaccacgaagcgcgaccugggcauguccaaggagccggggguggucagccccaccuccuaccucgacguggaccugcaccccgccagcgccuggacccuguacgccguggcgaccacggucaucacccccaugcuccggcacaccaucgagaacuccaccgccaacgugagccuggccgccaucgccaaccaggcggugguccugaugggccucgacaagggguggccgaucuccaagauggaccugggcgugccccugcucgcccuggggugcuacagccaggugaacccccugacgcucaccgccgccguccugcugcucaucacccacuacgccaucaucggccccggccugcaggcgaaggccacccgcgaggcccagaagcggacggccgccgggaucaugaagaacccgaccguggacggcaucaugaccaucgaccuggaccccgugaucuacgacuccaaguucgagaagcagcucgggcaggucaugcugcuggugcucugcgcggugcagcugcugcucaugcgcaccagcugggcccugugcgaggcccugacgcucgccaccggccccaucaccacccugugggagggcucccccgggaaguucuggaacacgaccaucgcggucagcauggccaacaucuuccggggcuccuaccuggccggggccggccucgccuucagcaucaugaaguccguggggaccggcaagcgcggcaccgggagccagggcgagacccugggggagaaguggaagaagaagcugaaccagcucucccggaaggaguucgaccuguacaagaaguccggcaucacggagguggaccgcaccgaggcgaaggaggggcugaagcggggcgagaucacccaccacgccgucagccgcggcuccgccaagcuccagugguucguggagcggaacauggugaucccggaggggcgcgucaucgaccugggcugcgggcggggcggguggagcuacuacugcgccggccugaagaaggugaccgaggugcgcggcuacacgaagggcgggcccgggcacgaggagcccguccccauguccaccuacggcuggaacaucgugaagcucaugagcgggaaggacguguucuaccugccgcccgagaagugcgacacccugcugugcgacaucggcgaguccagccccucccccaccgucgaggagagccggacgauccgcgugcucaagaugguggagccguggcugaagaacaaccaguucugcaucaagguccugaaccccuacaugcccaccgugaucgagcaccucgagcgccugcagcggaagcacggcgggaugcuggugcgcaacccccucucccggaacagcacccacgagauguacuggaucuccaacggcaccgggaacaucgucgccagcgugaacauggugucccgccugcugcucaaccgguucacgaugacccaccgccggccgaccaucgagaaggacgucgaccugggcgcgggcacccgccacgugaacgccgagcccgagacgcccaacauggacgugaucggggagcggaucaagcgcaucaaggaggagcacaacagcaccuggcacuacgacgacgagaacccguacaagaccugggccuaccacggcuccuacgaggucaaggccaccgggagcgccuccagcaugaucaacggcguggucaagcugcucacgaagcccugggacguggugcccauggucacccagauggcgaugaccgacaccacgcccuucgggcagcagcggguguucaaggagaagguggacacccgcaccccgcgguccaugcccggcacccgccgggucaugggcaucacggccgaguggcuguggcgcacccuggggcggaacaagaagccccgccucugcacccgggaggaguucaccaagaaggugcgcacgaacgccgccaugggcgcgguguucaccgaggagaaccagugggacagcgccaaggccgccgucgaggacgaggacuucuggaagcugguggaccgcgagcgggagcugcacaagcucgggaagugcggcagcugcguguacaacaugauggggaagcgcgagaagaagcugggcgaguucggcaaggccaaggggucccgggcgaucugguacauguggcugggcgcccgcuaccucgaguucgaggcccugggguuccugaacgaggaccacugguucagccgggagaacuccuacagcggcgucgagggggagggccuccacaagcugggcuacauccugcgcgacaucuccaagauccccgggggcgccauguacgccgacgacaccgcggggugggacacccggaucacggaggacgaccuccacaacgaggagaagaucacccagcagauggacccggagcaccgccagcuggccaacgccaucuucaagcugaccuaccagaacaagguggugaagguccagcggcccacccccgccggcaccgugauggacaucaucagccgcaaggaccagcggggcuccggccaggugggcacguacgggcucaacaccuucaccaacauggaggcccagcugauccgccagauggagggcgaggggguccugagcaaggcggaccucgagaacccccaccucccggagaagaagaucacccaguggcuggagacgaagggcguggagcggcucaagcgcauggccaucuccggcgacgacugcguggucaagcccaucgacgaccgguucgccaacgcccugcuggcccucaacgacauggggaaggugcgcaaggacaucccccaguggcagcccagcaagggcuggcacgacuggcagcaggucccguucugcucccaccacuuccacgagcugaucaugaaggacgggcggaagcuggucgugcccugccgcccccaggacgagcucaucggccgggcgcgcaucagccagggggccggcuggucccugcgggagaccgccugccugggcaaggccuacgcgcagauguggagccucauguacuuccaccgccgcgaccugcggcuggccuccaacgccaucugcagcgccgugcccguccacugggugccgaccucccgcaccacguggagcauccacgcccaccaccaguggaugaccaccgaggacaugcucaccguguggaaccgggucuggaucgaggacaaccccuggauggaggacaagacgcccgugaccaccugggagaacgugcccuaccuggggaagcgcgaggaccaguggugcggcucccugaucgggcucaccagccgggcgacgugggcccagaacaucccgaccgccauccagcagguccgcagccugaucggcaacgaggaguuccuggacuacaugcccuccaugaagcgguuccgcaaggaggaggagagcgagggggccaucugguga

SEQ ID NO: 10252 - RNA, 9873 nt, Artificial Sequence
  derived and/or modified CDS sequence (opt1) from DENV-3__FJ639791__SS-prME
accagccucugccucaugaugauccugcccgccgcccuggcguuccaccucaccagccgggacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccgucgagggcaagguggugcaguacgagaaccucaaguacaccgucaucaucacggugcacaccggggaccagcaccaggucggcaacgagacccagggggugaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggucaccuucaagaacgcccacgccaagaagcaggagguggugguccuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucgugcugaagaaggagguguccgagacccagcacgggaccauccucaucaaggucgaguacaagggcgaggacgugccgugcaagauccccuucagcaccgaggacgggcagggcaaggcgcacaacggccgccugaucacggccaaccccguggucaccaagaaggaggagcccgugaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgucggcggggugcucaacagccugggcaagauggugcaccagaucuucggguccgcguacacggcccuguucagcggcgucuccugggugaugaagaucggcaucggggugcuccugaccuggaucggccugaacagcaagaacaccuccaugagcuucuccugcaucgccaucgggaucaucacccucuaccugggcgccgucgugcaggccgacauggggugcgugaucaacuggaagggcaaggagcugaagugcggcagcgggaucuucgucacgaacgaggugcacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccgucguggugggggacaucaucggcguccucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgccucccgggcguggaacgugugggaggucgaggacuacggguucggcguguucaccaccaacaucuggcucaagcugcgcgagguguacacccagcugugcgaccaccggcucaugagcgccgccgucaaggacgagcgcgccgugcacgccgacaugggcuacuggaucgagagccagaagaacggguccuggaagcuggagaaggcgagccugaucgaggugaagaccugcacguggccgaagucccacacccucuggagcaacggcguccuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggugaagucccugguguccgccggcagcggggaggucgacaacuucacgaugggcgugcugugccucgccauccuguucgaggaggugaugcgggggaaguucggcaagaagcacaugaucgcgggggucuucuucaccuucgugcugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgucggccucgccauggccaccacgcugcagcugcccgaggacaucgagcagauggccaacgggaucgcgcucggccugauggcccugaagcucaucacccaguucgagaucuaccagcuguggaccgcccugaucagccugaccugcuccaacacgaucuucacccugaccguggccuggcgcaccgccacgcugauccucgcgggggucagccugcugccggugugccaguccagcuccaugcggaagaccgacuggcuccccaugaccguggccgccaugggcgugccgccccucccgcuguucaucuucaaccucaaggacacccugaagcgccgcagcuggccccugaacgagggggugauggccgugggccucgucuccauccuggccagcucccugcuccggaacgacgugcccauggcgggcccccugguggccgggggccugcucaucgccugcuacgucaucacggggaccagcgccgaccugaccguggagaaggccgcggacgugaccugggaggaggaggccgagcagacgggcgucucccacaaccugaugaucaccguggacgacgacgggaccaugcgcaucaaggacgacgagaccgagaacauccucaccgugcugcugaagacggcccuccugaucgucagcggcaucuucccguacuccauccccgccacccugcucguguggcacaccuggcagaagcagacccagcggagcggcgugcugugggacguccccagcccgcccgagacgcagaaggccgagcuggaggaggggguguaccgcaucaagcagcagggcaucuucgggaagacccaggugggcgucggggugcagaaggagggcguguuccacaccauguggcacgucacccggggcgcggugcucacguacaacgggaagcgccuggagcccaacugggccagcgugaagaaggaccugaucuccuacggcgggggcuggcggcucagcgcccaguggcagaagggggaggagguccaggugaucgccguggagcccggcaagaaccccaagaacuuccagaccaugcccggcaccuuccagaccacgaccggggagaucggcgcgaucgcccuggacuucaagcccgggaccuccggcagccccaucaucaaccgcgagggcaaggucguggggcuguacggcaacgggguggucaccaagaacggcggguacgugagcggcaucgcccagacgaacgccgagccggacggccccacccccgagcuggaggaggagauguucaagaagcggaaccucaccaucauggaccugcaccccggguccggcaagacccgcaaguaccugccggccaucgugcgggaggcgaucaagcgccggcuccgcacgcugauccuggcccccacccgggucguggccgccgagauggaggaggcccucaaggggcugcccauccgcuaccagaccaccgcgaccaagagcgagcacacgggccgggagaucguggaccugaugugccacgccaccuucaccaugcgccuccugucccccguccgggugccgaacuacaaccugaucaucauggacgaggcccacuucacggaccccgccagcaucgccgcgcgcggguacaucuccacccgggugggcaugggcgaggccgccgccaucuucaugaccgcgacgccgcccgggacggccgacgccuucccgcagagcaacgcccccauccaggacgaggagcgcgacauccccgagcgcuccuggaacagcggcaacgaguggaucaccgacuucgccgggaagaccgucugguucgugcccuccaucaaggcgggcaacgacaucgccaacugccuccggaagaacgggaagaaggugauccagcugagccgcaagaccuucgacacggaguaccagaagaccaagcugaacgacugggacuucgucgugaccaccgacaucuccgagaugggcgccaacuucaaggccgaccgggugaucgacccgcgccggugccucaagcccgucauccugacggacggccccgagcgcgugauccuggccgggcccaugccggugaccgcggccagcgccgcccagcggcgcggccgggucgggcgcaacccccagaaggagaacgaccaguacaucuucaccggccagccccucaacaacgacgaggaccacgcccacuggaccgaggcgaagaugcugcuggacaacaucaacacccccgaggggaucaucccggcccucuucgagcccgagcgggagaaguccgccgccaucgacggcgaguaccgccugaagggcgagagccggaagacguucguggagcugaugcgccgcggggaccuccccgucuggcuggcgcacaagguggccuccgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcaccuacagcgacccgcuggcccucaaggaguucaaggacuucgccgcgggccgcaaguccaucgcccuggaccuggucacggagaucgggcgggugcccacccaccucgcccaccgcacccggaacgcccuggacaaccuggugaugcuccacaccagcgagcacggcgggaaggccuaccgccacgcggucgaggagcugcccgagacgauggagacccugcuccugcugggccucaugauccugcugaccgggggcgccaugcuguuccugaucuccggcaaggggaucggcaagaccagcaucgggcugaucugcgugaucgccagcuccggcaugcucuggauggccgagaucccgcugcaguggaucgccagcgcgaucgugcuggaguucuucaugaugguccuccugauccccgagcccgagaagcagcggacgccccaggacaaccagcuggccuacguggugaucgggauccucacccuggccgccaucaucgccgcgaacgagaugggccugcucgagaccaccaagcgcgaccugggcauguccaaggagccgggggucgugagccccacguccuaccuggacguggaccuccaccccgccagcgccuggacccuguacgccgucgcgaccaccgugaucacgcccaugcugcggcacaccaucgagaacuccaccgccaacgugagccucgccgccaucgccaaccaggcggucgugcugaugggccuggacaagggguggccgaucuccaagauggaccucggcgugccccugcuggcccucgggugcuacagccaggucaacccccugacccugacggccgccgugcuccugcugaucacccacuacgccaucaucggccccggccuccaggcgaaggccacccgcgaggcccagaagcggaccgccgccgggaucaugaagaacccgacgguggacggcaucaugaccaucgaccuggaccccgucaucuacgacuccaaguucgagaagcagcugggccaggugaugcuccuggugcugugcgcgguccagcuccugcugaugcgcaccagcugggcccucugcgaggcccugacccuggccacgggccccaucaccacccucugggagggcucccccgggaaguucuggaacaccacgaucgcggugagcauggccaacaucuuccggggcuccuaccuggccggggccggccuggccuucagcaucaugaaguccguggggaccggcaagcgcggcaccgggagccagggcgagacccucggggagaaguggaagaagaagcugaaccagcugucccggaaggaguucgaccucuacaagaaguccggcaucaccgaggucgaccgcacggaggcgaaggaggggcugaagcggggcgagaucacccaccacgccgugagccgcggcuccgccaagcugcagugguucguggagcggaacauggucaucccggaggggcgcgugaucgaccucggcugcgggcggggcggguggagcuacuacugcgccggccugaagaaggugaccgagguccgcggcuacaccaagggcgggcccgggcacgaggagcccgugcccauguccacguacggcuggaacaucgugaagcugaucagcgggaaggacgucuucuaccucccgcccgagaagugcgacacccugcugugcgacaucggcgaguccagccccucccccaccguggaggagagccggaccauccgcgugcugaagauggucgagccguggcucaagaacaaccaguucugcaucaaggugcugaaccccuacaugcccacggugaucgagcaccuggagcgccuccagcggaagcacggcgggaugcugguccgcaacccccugucccggaacagcacccacgagauguacuggaucuccaacggcagcgggaacaucguggccuccgugaacauggucagccgccuccugcugaaccgguucaccaugacccaccgccggccgacgaucgagaaggacguggaccucggcgcgggcacccgccacgugaacgccgagcccgagacccccaacauggacgucaucggggagcggaucaagcgcaucaaggaggagcacaacuccaccuggcacuacgacgacgagaacccguacaagacgugggccuaccacggcagcuacgaggugaaggccaccggguccgccagcuccaugaucaacggcgucgugaagcugcugaccaagcccugggacgugguccccauggugacccagauggcgaugacggacaccacccccuucgggcagcagcggguguucaaggagaaggucgacacccgcacgccgcggagcaugcccggcacccgccgggugaugggcaucaccgccgaguggcucuggcgcacccuggggcggaacaagaagccccgccugugcacgcgggaggaguucaccaagaaggugcgcaccaacgccgccaugggcgcggucuucaccgaggagaaccagugggacagcgccaaggccgccguggaggacgaggacuucuggaagcucguggaccgcgagcgggagcugcacaagcuggggaagugcggcuccugcgucuacaacaugauggggaagcgcgagaagaagcucggcgaguucggcaaggccaaggggagccgggcgaucugguacauguggcugggcgcccgcuaccuggaguucgaggcccucggguuccugaacgaggaccacugguucucccgggagaacagcuacuccggcguggagggggagggccugcacaagcucggcuacauccugcgcgacaucagcaagauccccgggggcgccauguacgccgacgacacggcggggugggacacccggaucaccgaggacgaccugcacaacgaggagaagaucacccagcagauggacccggagcaccgccagcucgccaacgccaucuucaagcugacguaccagaacaagguggucaaggugcagcggcccacccccaccggcaccgugauggacaucaucucccgcaaggaccagcggggcagcgggcaggucggcaccuacgggcugaacacguucaccaacauggaggcccagcucauccgccagauggagggcgagggggugcuguccaaggccgaccuggagaacccccaccucccggagaagaagaucacccaguggcuggagaccaagggcguggagcggcugaagcgcauggcgaucagcggcgacgacugcgucgugaagcccaucgacgaccgguucgccaacgcccuccuggcccugaacgacauggggaaggugcgcaaggacaucccccaguggcagcccuccaagggcuggcacgacuggcagcaggucccguucugcagccaccacuuccacgagcucaucaugaaggacgggcggaagcugguggugcccugccgcccccaggacgagcugaucggccgggcccgcaucucccagggggcgggcuggagccuccgggagacggccugccugggcaaggccuacgcccagauguggucccugauguacuuccaccgccgcgaccuccggcuggcgagcaacgccaucugcuccgccguccccgugcacugggugccgaccagccgcaccaccugguccauccacgcccaccaccaguggaugacgaccgaggacaugcugaccgucuggaaccggguguggaucgaggacaaccccuggauggaggacaagacccccgugacgaccugggagaacguccccuaccucgggaagcgcgaggaccaguggugcggcagccugaucgggcugaccagccgggccaccugggcgcagaacaucccgacggccauccagcagguccgcucccucaucggcaacgaggaguuccuggacuacaugcccagcaugaagcgguuccgcaaggaggaggaguccgagggggccaucugguga

SEQ ID NO: 10253 - RNA, 9873 nt, Artificial Sequence
  derived and/or modified CDS sequence (opt1) from DENV-3__FJ639792__SS-prME
accagccugugccucaugaugauccugcccgccgcccuggcguuccaccucaccagccgggacggggagccccggaugaucguggggaagaacgagcggggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcggagcgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucacccacaacgggaagcgccuggagcccaacugggccuccgugaagcgggaccugaucagcuacggcgggggcuggcgccucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgggagggcaagguggucgggcuguacggcaacgggguggugacgaagaacggcggguacgucuccggcaucgcccagaccaacgccgagccggacggccccacccccgagcuggaggaggagauguucaagaagcgcaaccucaccaucauggaccugcaccccgggagcggcaagacgcggaaguaccugccggccaucgugcgcgaggcgaucaagcggcgccuccggacccugauccuggcccccacccgcguggucgccgccgagauggaggaggcccucaaggggcugcccauccgguaccagaccacggcgaccaaguccgagcacaccggccgcgagaucguggaccugaugugccacgccaccuucacgaugcggcuccugagccccgugcgcgucccgaacuacaaccugaucaucauggacgaggcccacuucaccgaccccgccuccaucgccgcgcggggguacaucagcacccgcgugggcaugggcgaggccgccgccaucuucaugaccgcgacgccgcccgggaccgccgacgccuucccgcaguccaacgcccccauccaggacgaggagcgcgacauccccgagcggagcuggaacuccggcaacgaguggaucaccgacuucgccgggaagaccgugugguucguccccagcaucaaggcgggcaacgacaucgccaacugccuccgcaagaacgggaagaaggugauccagcugucccggaagacguucgacaccgaguaccagaagaccaagcugaacgacugggacuucguggucaccacggacaucagcgagaugggcgccaacuucaaggccgaccgcgugaucgacccgcggcgcugccucaagcccgugauccugaccgacggccccgagcgggucauccuggccgggcccaugccggugaccgcggccuccgccgcccagcgccggggccgcguggggcggaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgcgagaaguccgccgccaucgacggcgaguaccggcugaagggcgagucccgcaagaccuucgucgagcugaugcggcgcggggaccuccccguguggcuggcguacaaggucgccagcgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcccgcacguacuccgacccgcuggcccucaaggaguucaaggacuucgccgcgggccgcaagagcaucgcccuggaccuggugaccgagaucgggcgcguccccacccaccucgcccaccggacccgcaacgcccuggacaaccuggugaugcuccacacguccgagcacggcgggaaggccuaccggcacgcgguggaggagcugcccgagaccauggagacccugcuccugcugggccucaugauccugcugaccgggggcgccaugcuguuccugaucagcggcaaggggaucggcaagacgagcaucgggcugaucugcgucaucgccuccagcggcaugcucuggauggccgagaucccgcugcaguggaucgccuccgcgaucgugcuggaguucuucaugauggugcuccugauccccgagcccgagaagcagcgcacgccccaggacaaccagcuggccuacgucgugaucgggauccucacccuggccgccaucaucgccgcgaacgagaugggccugcucgagaccacgaagcgggaccugggcaugagcaaggagccggggguggucucccccaccagcuaccuggacguggaccuccaccccgccuccgccuggacccuguacgccguggcgaccacggucaucacccccaugcugcgccacaccaucgagaacagcaccgccaacgugucccucgccgccaucgccaaccaggcggugguccugaugggccuggacaagggguggccgaucagcaagauggaccucggcgugccccugcuggcccucgggugcuacucccaggugaacccccugacgcugaccgccgccguccuccugcugaucacccacuacgccaucaucggccccggccuccaggcgaaggccacccgggaggcccagaagcgcacggccgccgggaucaugaagaacccgaccguggacggcaucaugaccaucgaccuggaccccgugaucuacgacagcaaguucgagaagcagcuggggcaggucaugcuccuggugcugugcgcggugcagcuccugcugaugcggaccuccugggcccucugcgaggcccugacgcuggccaccggccccaucaccacccucugggagggcagccccgggaaguucuggaacacgaccaucgcggucuccauggccaacaucuuccgcggcagcuaccuggccggggccggccuggccuucuccaucaugaaguccguggggaccggcaagcggggcaccgggucccagggcgagacccucggggagaaguggaagaagaagcugaaccagcugagccgcaaggaguucgaccucuacaagaaguccggcaucacggagguggaccggaccgaggcgaaggaggggcugaagcgcggcgagaucacccaccacgccgucucccggggcagcgccaagcugcagugguucguggagcgcaacauggugaucccggaggggcgggucaucgaccucggcugcgggcgcggcgggugguccuacuacugcgccggccugaagaaggugaccgaggugcggggcuacacgaagggcgggcccgggcacgaggagcccguccccaugagcaccuacggcuggaacaucgugaagcugauguccgggaaggacguguucuaccucccgcccgagaagugcgacacccugcugugcgacaucggcgagagcucccccagccccaccgucgaggagucccgcacgauccgcgugcugaagaugguggagccguggcucaagaacaaccaguucugcaucaagguccugaaccccuacaugcccaccgugaucgagcaccuggagcggcuccagcgcaagcacggcgggaugcuggugcggaacccccugagccgcaacuccacccacgagauguacuggaucagcaacggcaccgggaacaucgucgccuccgugaacauggugagccggcuccugcugaaccgcuucacgaugacccaccggcgcccgaccaucgagaaggacgucgaccucggcgcgggcacccggcacgugaacgccgagcccgagacgcccaacauggacgugaucggggagcgcaucaagcggaucaaggaggagcacaacuccaccuggcacuacgacgacgagaacccguacaagaccugggccuaccacggcagcuacgaggucaaggccaccggguccgccagcuccaugaucaacggcguggucaagcugcugacgaagcccugggacguggugcccauggucacccagauggcgaugaccgacaccacgcccuucgggcagcagcgcguguucaaggagaagguggacacccggaccccgcgcagcaugcccggcacccggcgcgucaugggcaucacggccgaguggcucuggcggacccuggggcgcaacaagaagccccggcugugcacccgcgaggaguucaccaagaaggugcgcacgaacgccgccaugggcgcgguguucaccgaggagaaccagugggacagcgccaaggccgccgucgaggacgaggacuucuggaagcucguggaccgggagcgcgagcugcacaagcuggggaagugcggcuccugcguguacaacaugauggggaagcgggagaagaagcucggcgaguucggcaaggccaaggggagccgcgcgaucugguacauguggcugggcgcccgguaccuggaguucgaggcccucggguuccugaacgaggaccacugguucucccgcgagaacagcuacuccggcgucgagggggagggccugcacaagcucggcuacauccugcgggacaucagcaagauccccgggggcgccauguacgccgacgacaccgcggggugggacacccgcaucacggaggacgaccugcacaacgaggagaagaucacccagcagauggacccggagcaccggcagcucgccaacgccaucuucaagcugaccuaccagaacaagguggugaagguccagcgccccacccccaccggcacggugauggacaucaucucccggaaggaccagcgcggcagcggccaggugggcaccuacgggcugaacaccuucaccaacauggaggcccagcucauccggcagauggagggcgaggggguccuguccaaggccgaccuggagaacccccaccucccggagaagaagaucacgcaguggcuggagaccaagggcguggagcgccugaagcggauggcgaucagcggcgacgacugcguggucaagcccaucgacgaccgcuucgccaacgcccuccuggcccugaacgacauggggaaggugcggaaggacaucccccaguggcagcccuccaagggcuggcacgacuggcagcaggucccguucugcagccaccacuuccacgagcucaucaugaaggacgggcgcaagcuggucgugcccugccggccccaggacgagcugaucggccgcgcccggaucucccagggggcgggcuggagccuccgcgagaccgccugccugggcaaggccuacgcccagauguggucccugauguacuuccaccgccgggaccuccgccuggcgagcaacgccaucugcuccgccgugcccguccacugggugccgaccagccggacgaccugguccauccacgcccaccaccaguggaugaccaccgaggacaugcugacgguguggaaccgcgucuggaucgaggacaaccccuggauggaggacaagacccccgugaccaccugggagaacgugcccuaccucgggaagcgggaggaccaguggugcggcagccugaucgggcugacgagccgcgccaccugggcgcagaacaucccgaccgccauccagcagguccggucccucaucggcaacgaggaguuccuggacuacaugcccagcaugaagcgcuuccggaaggaggaggaguccgagggggccaucugguga

SEQ ID NO: 10254 - RNA, 9873 nt, Artificial Sequence
  derived and/or modified CDS sequence (opt1) from DENV-3__FJ639793__SS-prME
accagccucugccucaugaugauccugcccgcgacccuggccuuccaccucaccagccgggacggggagccccggaugaucguggggaagaacgagcggggcaagagccugcuguucaagaccgcgagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcggagcgucgcccucgcgccccacgugggcauggggcuggacacccgcacccagacguggaugagcgcggagggcgccuggcgccagguggagaaggucgagaccugggcccugcgccacccgggguucaccauccucgcccuguuccuggcgcacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacaucaccacggacagccgcugccccacccagggcgaggcggugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacacggugaucaucaccguccacaccggggaccagcaccaggugggcaacgagacccagggggucacggccgagaucacgccccaggccagcaccaccgaggccauccugcccgaguacggcacccuggggcucgagugcuccccgcgcacgggccuggacuucaacgagaugauccugcucaccaugaagaacaaggcguggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgccaugcacacggcgcucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgucccgugcaagauccccuucagcacggaggacgggcagggcaaggcccacaacggccgccugaucaccgcgaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggccaccgcgcggggcgcccgccggauggccauccugggcgacacggccugggacuucggguccgugggcgggguccucaacagccugggcaagauggugcaccagaucuucggguccgccuacaccgcgcuguucagcggcguguccugggucaugaagaucggcaucggggugcuccugaccuggaucggccugaacagcaagaacaccuccaugagcuucuccugcaucgccaucgggaucaucacgcucuaccugggcgccgugguccaggccgacauggggugcgugaucaacuggaagggcaaggagcugaagugcggcagcgggaucuucgugaccaacgagguccacaccuggaccgagcaguacaaguuccaggccgacucccccaagcgccucgcgacggccaucgccggcgccugggagaacggggugugcggcauccgcagcaccacccggauggagaaccugcuguggaagcagaucgccaacgagcucaacuacauccugugggagaacaacaucaagcugaccguggucgugggggacaucaucggcgugcucgagcagggcaagcgcacgcugacgccccagccgauggagcugaaguacuccuggaagaccugggggaaggcgaagaucgucaccgccgagacgcagaacagcuccuucaucaucgacggccccaacacccccgagugccccagcgccucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaacuaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaccuccgagaaggaggagaacauggucaagagccugguguccgccggcagcggggagguggacaacuucaccaugggcguccugugccucgccauccuguucgaggaggugaugcgggggaaguucggcaagaagcacaugaucgccgggguguucuucaccuucguccugcuccuguccggccagaucacguggcgcgacauggcgcacacccugaucaugaucggcagcaacgccuccgaccggauggggaugggcgugaccuaccucgcccugaucgccaccuucaagauccagcccuuccuggcccucggguucuuccugcgcaagcugacgagccgggagaaccuccugcugggcgugggccucgcgauggccaccacccugcagcugcccgaggacaucgagcagauggccaacgggaucgcccucggccugauggcgcugaagcucaucacccaguucgagacguaccagcuguggaccgcccugaucagccugaccugcuccaacaccaucuucacgcugaccgucgccuggcgcaccgccacccugauccucgccggggugagccugcugccggucugccaguccagcuccaugcggaagacggacuggcuccccaugaccguggcggccaugggcgugccgccccucccgcuguucaucuucagccucaaggacacccugaagcgccgcuccuggccccugaacgagggggucauggccgugggccucgugagcauccuggccuccagccugcuccggaacgacguccccauggccggcccccugguggccggcgggcugcucaucgccugcuacgugaucaccgggacguccgccgaccugaccgucgagaaggccgccgacgugaccugggaggaggaggcggagcagaccggggugagccacaaccugaugaucaccgucgacgacgacgggacgaugcgcaucaaggacgacgagaccgagaacauccucaccgugcugcugaagaccgcccuccugaucguguccggcaucuucccguacagcauccccgccacgcugcucgucuggcacaccuggcagaagcagacccagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacccggggcgccguccucaccuacaacgggaagcgccuggagcccaacugggcguccgugaagaaggaccugaucagcuacggcgggggcuggcggcucuccgcccaguggcagaagggggaggaggugcaggucaucgccguggagcccggcaagaaccccaagaacuuccagacgaugcccggcaccuuccagaccaccacgggggagaucggcgccaucgcgcuggacuucaagcccgggaccagcggcagccccaucaucaaccgcgagggcaagaucguggggcuguacggcaacggggucgugaccaagaacggcggguacguguccggcaucgcccagaccaacgccgagccggacggccccacgcccgagcuggaggaggagauguucaagaagcggaaccucaccaucauggaccugcaccccgggagcggcaagacccgcaaguaccugccggccaucguccgggaggccaucaagcgccggcuccgcacccugauccuggcgcccacgcgggugguggccgccgagauggaggaggcccucaaggggcugcccauccgcuaccagaccaccgccaccaaguccgagcacacgggccgggagaucgucgaccugaugugccacgcgaccuucaccaugcgccuccugagccccgugcgggugccgaacuacaaccugaucaucauggacgaggcccacuucaccgaccccgccuccaucgccgcccgcggguacaucagcacgcgggucggcaugggcgaggcggccgccaucuucaugaccgccacgccgcccgggaccgcggacgccuucccgcaguccaacgcccccauccaggacgaggagcgcgacauccccgagcgcagcuggaacuccggcaacgaguggaucacggacuucgccgggaagaccgugugguucgugcccagcaucaaggccggcaacgacaucgcgaacugccuccggaagaacgggaagaaggucauccagcugucccgcaagaccuucgacaccgaguaccagaagacgaagcugaacgacugggacuucguggugaccaccgacaucagcgagaugggcgccaacuucaaggccgaccgggucaucgacccgcgccggugccucaagcccgugauccugaccgacggccccgagcgcgugauccuggccgggcccaugccggucaccgccgcguccgccgcccagcggcgcggccggguggggcgcaacccccagaaggagaacgaccaguacaucuucacgggccagccccucaacaacgacgaggaccacgcccacuggaccgaggccaagaugcugcuggacaacaucaacacccccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcccacaagguggcgagcgagggcaucaaguacacggaccgcaaguggugcuucgacgggcagcggaacaaccagauccuggaggagaacauggacgucgagaucuggaccaaggagggcgagaagaagaagcuccgcccccgguggcuggacgcccgcaccuacuccgacccgcuggcccucaaggaguucaaggacuucgccgccggccgcaagagcaucgcgcuggaccuggugaccgagaucgggcgggugcccacgcaccucgcccaccgcacccggaacgcccuggacaaccuggucaugcuccacaccuccgagcacggcgggaaggccuaccgccacgccguggaggagcugcccgagaccauggagacgcugcuccugcugggccucaugauccugcugaccgggggcgcgaugcuguuccugaucagcggcaaggggaucggcaagaccagcaucgggcugaucugcgugaucgccuccagcggcaugcucuggauggccgagaucccgcugcaguggaucgccuccgccaucguccuggaguucuucaugauggugcuccugauccccgagcccgagaagcagcggacgccccaggacaaccagcuggcguacguggucaucgggauccucacgcuggccgccaucaucgccgccaacgagaugggccugcucgagaccaccaagcgcgaccugggcaugagcaaggagccggggguggugucccccaccagcuaccuggacgucgaccuccaccccgcguccgccuggacgcuguacgccguggccaccaccgugaucacccccaugcugcggcacacgaucgagaacagcaccgcgaacgucucccucgccgccaucgccaaccaggccguggugcugaugggccuggacaagggguggccgaucagcaagauggaccucggcgucccccugcuggcgcucgggugcuacucccaggugaacccccugacccugaccgccgccgugcuccugcugaucacgcacuacgccaucaucggccccggccuccaggccaaggcgacccgcgaggcccagaagcggaccgccgccgggaucaugaagaacccgaccgucgacggcaucaugacgaucgaccuggaccccgugaucuacgacagcaaguucgagaagcagcugggccaggugaugcuccugguccugugcgccgugcagcuccugcugaugcgcaccuccugggcgcucugcgaggcccugacccuggccaccggccccaucacgacccucugggagggcagccccgggaaguucuggaacaccaccaucgccguguccauggcgaacaucuuccggggcagcuaccuggccggggccggccuggccuucuccgucaugaaguccguggggaccggcaagcgcggcacggggucccagggcgagacccucggggagaaguggaagaagaagcugaaccagcugagccggaaggaguucgaccucuacaagaaguccggcaucaccgagguggaccgcaccgaggccaaggaggggcugaagcggggcgagaucacgcaccacgcggucucccgcggcagcgccaagcugcagugguucguggagcggaacauggugaucccggaggggcgcgucaucgaccucggcugcgggcggggcgggugguccuacuacugcgccggccugaagaaggugaccgaggugcgcggcuacaccaagggcgggcccgggcacgaggagcccguccccaugagcaccuacggcuggaacaucgugaagcugauguccgggaaggacguguucuaccucccgcccgagaagugcgacacgcugcugugcgacaucggcgagagcucccccagccccaccgucgaggagucccggaccauccgcgugcugaagaugguggagccguggcucaagaacaaccaguucugcaucaagguccugaaccccuacaugcccaccgugaucgagcaccuggagcgccuccagcggaagcacggcgggaugcuggugcgcaacccccugagccggaacuccacgcacgagauguacuggaucagcaacggcaccgggaacaucgucgccuccgugaacauggugagccgccuccugcugaaccgguucaccaugacccaccgccggccgacgaucgagaaggacgucgaccucggcgccggcacccgccacgugaacgcggagcccgagacccccaacauggacgugaucggggagcggaucaagcgcaucaaggaggagcacaacuccaccuggcacuacgacgacgagaacccguacaagacgugggccuaccacggcagcuacgaggucaaggccaccggguccgccagcuccaugaucaacggcguggucaagcugcugaccaagcccugggacguggugcccauggucacccagauggccaugacggacaccacccccuucgggcagcagcggguguucaaggagaagguggacacccgcacgccgcggagcaugcccggcacccgccgggucaugggcaucaccgcggaguggcucuggcgcacccuggggcggaacaagaagccccgccugugcacgcgggaggaguucaccaagaaggugcgcaccaacgccgccaugggcgccguguucaccgaggagaaccagugggacagcgcgaaggccgccgucgaggacgaggacuucuggaagcucguggaccgcgagcgggagcugcacaagcuggggaagugcggcuccugcguguacaacaugauggggaagcgcgagaagaagcucggcgaguucggcaaggccaaggggagccgggccaucugguacauguggcugggcgcgcgcuaccuggaguucgaggcccucggguuccugaacgaggaccacugguucucccgggagaacagcuacuccggcgucgagggggagggccugcacaagcucggcuacauccugcgcgacaucagcaagauccccgggggcgccauguacgccgacgacacggccgggugggacacccggaucaccgaggacgaccugcacaacgaggagaagaucacccagcagauggacccggagcaccgccagcucgcgaacgccaucuucaagcugaccuaccagaacaagguggugaagguccagcggcccacgcccaccggcaccgugauggacaucaucucccgcaaggaccagcggggcagcggccaggugggcaccuacgggcugaacacguucaccaacauggaggcccagcucauccgccagauggagggcgaggggguccuguccaaggccgaccuggagaacccccaccucccggagaagaagaucacccaguggcuggagaccaagggcguggagcggcugaagcgcauggccaucagcggcgacgacugcguggucaagcccaucgacgaccgguucgcgaacgcccuccuggcccugaacgacauggggaaggugcgcaaggacaucccccaguggcagcccuccaagggcuggcacgacuggcagcaggucccguucugcagccaccacuuccacgagcucaucaugaaggacgggcggaagcuggucgugcccugccgcccccaggacgagcugaucggccgggcccgcaucucccagggggccggcuggagccuccgggagacggcgugccugggcaaggccuacgcccagauguggucccugauguacuuccaccgccgcgaccuccggcuggccagcaacgcgaucugcuccgccgugcccguccacugggugccgaccagccgcaccaccugguccauccacgcccaccaccaguggaugacgaccgaggacaugcugaccguguggaaccgggucuggaucgaggacaaccccuggauggaggacaagacccccgugacgaccugggagaacgugcccuaccucgggaagcgcgaggaccaguggugcggcagccugaucgggcugaccagccgggccaccugggcccagaacaucccgacggcgauccagcagguccgcucccucaucggcaacgaggaguuccuggacuacaugcccagcaugaagcgguuccgcaaggaggaggaguccgagggggccaucugguga

SEQ ID NO: 10255 - RNA, 9873 nt, Artificial Sequence
  derived and/or modified CDS sequence (opt1) from DENV-3__FJ639795__SS-prME
accagccugugccucaugaugauccugcccgccgcccuggcguuccaccucaccagccgggacggggagccgcggaugaucguggggaagaacgagcggggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcggagcguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaccaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagacgugcaccuggccgaagucccacacccucuggagcaacggcgugcuggaguccgacaugaucauccccaagagccuggccgggcccaucucccagcacaacuaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcggggagguggacaacuucaccaugggcguccugugccucgccauccuguucgaggaggugaugcgggggaaguucggcaagaagcacaugaucgcggggguguucuucaccuucguccugcuccuguccggccagaucaccuggcgcgacauggcccacacgcugaucaugaucggcagcaacgccuccgaccggauggggaugggcaucaccuaccucgcccugaucgccaccuucaagauccagcccuuccuggcgcucggguucuuccugcgcaagcugaccagccgggagaaccuccugcugggcgugggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccaucuucacccugacgguggccuggcgcaccgccacccugauccucgcgggggucagccugcugccggugugccaguccagcuccaugcggaagaccgacuggcuccccaugacggucgccgccaugggcgugccgccccucccgcuguucaucuucagccucaaggacacccugaagcgccgcuccuggccccugaacgagggggugauggccgucggccucgugagcauccuggccuccagccugcuccggaacgacgugcccauggcgggcccccuggucgccgggggccugcucaucgccugcuacgugaucaccgggaccuccgccgaccugacgguggagaaggccgcggacgucaccugggaggaggaggccgagcagaccggcgugagccacaaccugaugaucaccguggacgacgacgggaccaugcgcaucaaggacgacgagacggagaacauccucaccguccugcugaagaccgcccuccugaucguguccggcaucuucccguacagcauccccgccacccugcucguguggcacacguggcagaagcagacccagcgguccggcguccugugggacgugcccagcccgcccgagacccagaaggccgagcuggaggaggggguguaccgcaucaagcagcagggcaucuucgggaagacccaggucggcgugggggugcagaaggagggcgucuuccacacgauguggcacgugacccggggcgcggugcucaccuacaacgggaagcgccuggagcccaacugggccuccgucaagaaggaccugaucagcuacggcgggggcuggcggcucuccgcccaguggcagaagggggaggagguccaggugaucgccgucgagcccggcaagaaccccaagaacuuccagaccaugcccggcacguuccagaccaccaccggggagaucggcgcgaucgcccuggacuucaagcccgggacgagcggcagccccaucaucaaccgcgagggcaaggugguggggcuguacggcaacggggucgugaccaagaacggcggguacguguccggcaucgcccagaccaacgccgagccggacggccccacccccgagcuggaggaggagauguucaagaagcggaaccucacgaucauggaccugcaccccgggagcggcaagacccgcaaguaccugccggccaucguccgggaggcgaucaagcgccggcuccgcacccugauccuggcccccacccgggugguggccgccgagauggaggaggcccucaaggggcugcccauccgcuaccagacgaccgcgaccaaguccgagcacaccggccgggagaucgucgaccugaugugccacgccacguucaccaugcgccuccugagccccgugcgggugccgaacuacaaccugaucaucauggacgaggcccacuucaccgaccccgccuccaucgccgcgcgcggguacaucagcacccgggucggcaugggcgaggccgccgccaucuucaugacggcgacgccgcccgggaccgccgacgccuucccgcaguccaacgcccccauccaggacgaggagcgcgacauccccgagcgcagcuggaacuccggcaacgaguggaucaccgacuucgccgggaagacggugugguucgugcccagcaucaaggcgggcaacgacaucgccaacugccuccggaagaacgggaagaaggucauccagcugucccgcaagaccuucgacaccgaguaccagaagaccaagcugaacgacugggacuucguggugacgaccgacaucagcgagaugggcgccaacuucaaggccgaccgggucaucgacccgcgccggugccucaagcccgugauccugaccgacggccccgagcgcgugauccuggccgggcccaugccggucaccgcggccuccgccgcccagcggcgcggccggguggggcgcaacccccagaaggagaacgaccaguacaucuucaccggccagccccucaacaacgacgaggaccacgcccacuggacggaggcgaagaugcugcuggacaacaucaacacccccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcgcacaagguggccagcgagggcaucaaguacaccgaccgcaaguggugcuucgacgggcagcggaacaaccagauccuggaggagaacauggacgucgagaucuggacgaaggagggcgagaagaagaagcuccgcccccgguggcuggacgcccgcaccuacuccgacccgcuggcccucaaggaguucaaggacuucgccgcgggccgcaagagcaucgcccuggaccuggugaccgagaucgggcgggugcccacccaccucgcccaccgcacgcggaacgcccuggacaaccuggucaugcuccacaccuccgagcacggcgggaaggccuaccgccacgcgguggaggagcugcccgagaccauggagacccugcuccugcugggccucaugauccugcugaccggcggggccaugcuguuccugaucagcgggaaggggaucggcaagaccagcaucgggcugaucugcgugaucgccuccagcggcaugcucuggauggccgagaucccgcugcaguggaucgccuccgcgaucguccuggaguucuucaugauggugcuccugauccccgagcccgagaagcagcggacgccccaggacaaccagcuggccuacguggucaucgggauccucacccuggccgccacgaucgccgcgaacgagaugggccugcucgagaccaccaagcgcgaccugggcaugagcaaggagccggggguggugucccccaccagcuaccuggacgucgaccuccaccccgccuccgccuggacgcuguacgccguggcgaccaccgugaucacccccaugcugcggcacacgaucgagaacagcaccgccaacgucucccucgccgccaucgccaaccaggcgguggugcugaugggccuggacaagggguggccgaucagcaagauggaccucggcgucccccugcuggcccucgggugcuacucccaggugaacccccugacccugaccgccgccgugcuccugcugaucacgcacuacgccaucaucggccccggccuccaggcgaaggccacccgcgaggcccagaagcggaccgccgccgggaucaugaagaacccgaccgucgacggcaucaugacgaucgaccuggaccccgugaucuacgacagcaaguucgagaagcagcugggccaggugaugcuccugguccugugcgcggugcagcuccugcugaugcgcaccuccugggcccucugcgaggcccugacccuggccaccggccccaucacgacccucugggagggcagccccgggaaguucuggaacaccaccaucgcgguguccauggccaacaucuuccggggcagcuaccuggccggggccggccuggccuucuccaucaugaaguccgucgggaccggcaagcgcggcacggggucccagggcgagacccucggggagaaguggaagaagaagcugaaccagcugagccggaaggaguucgaccucuacaagaaguccggcaucaccgagguggaccgcaccgaggcgaaggaggggcugaagcggggcgagaucacgcaccacgccgugucccgcggcagcgccaagcugcagugguucgucgagcggaacauggugaucccggaggggcgcgugaucgaccucggcugcgggcggggcgggugguccuacuacugcgccggccugaagaaggucaccgaggugcgcggcuacaccaagggcgggcccgggcacgaggagcccgugcccaugagcaccuacggcuggaacaucgucaagcugauguccgggaaggacguguucuaccucccgcccgagaagugcgacacgcugcugugcgacaucggcgagagcucccccagccccaccguggaggagucccggaccauccgcguccugaagaugguggagccguggcucaagaacaaccaguucugcaucaaggugcugaaccccuacaugcccaccgucaucgagcaccuggagcgccuccagcggaagcacggcgggaugcuggugcgcaacccccugagccggaacuccacgcacgagauguacuggaucagcaacggcaccgggaacaucguggccuccgucaacauggugagccgccuccugcugaaccgguucaccaugacccaccgccggccgacgaucgagaaggacguggaccucggcgcgggcacccgccacgucaacgccgagcccgagacccccaacauggacgugaucggggagcggaucaagcgcaucaaggaggagcacaacuccaccuggcacuacgacgacgagaacccguacaagacgugggccuaccacggcagcuacgaggugaaggccaccggguccgccagcuccaugaucaacggcgucgugaagcugcugaccaagcccugggacgucgugcccauggugacccagauggcgaugacggacaccacccccuucgggcagcagcgggucuucaaggagaagguggacacccgcacgccgcggagcaugcccggcacccgccgggugaugggcaucaccgccgaguggcucuggcgcacccuggggcggaacaagaagccccgccugugcacgcgggaggaguucaccaagaagguccgcaccaacgccgccaugggcgcgguguucaccgaggagaaccagugggacagcgccaaggccgccguggaggacgaggacuucuggaagcucgucgaccgcgagcgggagcugcacaagcuggggaagugcggcuccugcguguacaacaugauggggaagcgcgagaagaagcucggcgaguucggcaaggccaaggggagccgggcgaucugguacauguggcugggcgcccgcuaccuggaguucgaggcccucggguuccugaacgaggaccacugguucucccgggagaacagcuacuccggcguggagggggagggccugcacaagcucggcuacauccugcgcgacaucagcaagauccccgggggcgccauguacgccgacgacacggcggggugggacacccggaucaccgaggacgaccugcacaacgaggagaagaucacccagcagauggacccggagcaccgccagcucgccaacgccaucuucaagcugaccuaccagaacaaggucgugaaggugcagcggcccacgcccaccggcaccgucauggacaucaucucccgcaaggaccagcggggcagcggccaggugggcaccuacgggcugaacacguucaccaacauggaggcccagcucauccgccagauggagggcgagggggugcugcugaaggccgaccucgagaacccccaccuccccgagaagaagaucacccaguggcuggagaccaagggcgucgagcggcucaagcgcauggcgaucuccggcgacgacugcguggugaagcccaucgacgaccgguucgccaacgcccugcuggcccucaacgacauggggaagguccgcaaggacaucccccaguggcagcccagcaagggcuggcacgacuggcagcaggucccguucugcucccaccacuuccacgagcugaucaugaaggacgggcggaagcuggugguccccugccgcccccaggacgagcucaucggccgggcccgcaucagccagggggcgggcuggucccugcgggagacggccugccugggcaaggccuacgcccagauguggagccucauguacuuccaccgccgcgaccugcggcuggcguccaacgccaucugcagcgccgugcccgugcacugggucccgaccucccgcaccaccuggagcauccacgcccaccaccaguggaugacgaccgaggacaugcucaccguguggaaccggguguggaucgaggacaaccccuggauggaggacaagacccccgucacgaccugggagaacgugcccuaccuggggaagcgcgaggaccaguggugcggcucccugaucgggcucaccagccgggccaccugggcgcagaacaucccgacggccauccagcagguccgcagccugaucggcaacgaggaguuccuggacuacaugcccuccaugaagcgguuccgcaaggaggaggagagcgagggggccaucugguga

SEQ ID NO: 10256 - RNA, 9873 nt, Artificial Sequence
  derived and/or modified CDS sequence (opt1) from DENV-3__FJ639798__SS-prME
accagccugugccucaugaugauccugcccgccgcccuggcguuccaccucaccagccgggacggggagccgcggaugaucguggggaagaacgagcgcggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcggagcguggcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccgucgagggcaagguggugcaguacgagaaccucaaguacaccgucaucaucacggugcacaccggggaccagcaccaggucggcaacgagacccagggggugaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggucaccuucaagaacgcccacgccaagaagcaggagguggugguccuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucgugcugaagaaggagguguccgagacccagcacgggaccauccucaucaaggucgaguacaagggcgaggacgugccgugcaagauccccuucagcaccgaggacgggcagggcaaggcgcacaacggccgccugaucacggccaaccccguggucaccaagaaggaggagcccgugaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgucggcggggugcucaacagccugggcaagauggugcaccagaucuucggguccgcguacacggcccuguucagcggcgucuccugggugaugaagaucggcaucggggugcuccugaccuggaucggccugaacagcaagaacaccuccaugagcuucuccugcaucgccaucgggaucaucacccucuaccugggcgccgucgugcaggccgacauggggugcgugaucaacuggaagggcaaggagcugaagugcggcagcgggaucuucgucacgaacgaggugcacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccgucguggugggggacaucaucggcguccucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgccucccgggcguggaacgugugggaggucgaggacuacggguucggcguguucaccaccaacaucuggcucaagcugcgcgagguguacacccagcugugcgaccaccggcucaugagcgccgccgucaaggacgagcgcgccgugcacgccgacaugggcuacuggaucgagagccagaagaacggguccuggaagcuggagaaggcgagccugaucgaggugaagaccugcacguggccgaagucccacacccucuggagcaacggcguccuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggaggucgacaacuucacgaugggcgugcugugccucgccauccuguucgaggaggugaugcgggggaaguucggcaagaagcacaugaucgcgggggucuucuucaccuucgugcugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgucggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccguggccuggcgcacggccacccugauccucgcgggggucagccugcugccggugugccaguccagcuccaugcggaagaccgacuggcuccccaugaccguggccgccaugggcgugccgccccucccgcuguucaucuucagccucaaggacacgcugaagcgccgcuccuggccccugaacgagggggugauggccgugggccucgucagcauccuggccuccagccugcuccggaacgacgugcccauggcgggcccccugguggccgggggccugcucaucgccugcuacgucaucaccgggaccuccgccgaccugaccguggagaaggccgcggacgugacgugggaggaggaggccgagcagaccggcgucagccacaaccugaugaucaccguggacgacgacgggaccaugcgcaucaaggacgacgagaccgagaacauccucacggugcugcugaagaccgcccuccugaucgucuccggcaucuucccguacagcauccccgccacccugcucguguggcacaccuggcagaagcagacgcagcgguccggcgugcugugggacguccccagcccgcccgagacccagaaggccgagcuggaggaggggguguaccgcaucaagcagcagggcaucuucgggaagacccaggugggcgucggggugcagaaggagggcguguuccacaccauguggcacgucacgcggggcgcggugcucaccuacaacgggaagcgccuggagcccaacugggccuccgugaagaaggaccugaucagcuacggcgggggcuggcggcucuccgcccaguggcagaagggggaggagguccaggugaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaaggucguggggcuguacggcaacgggguggucacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccgggucguggccgccgagauggaggaggcccucaaggggcugcccauccgcuaccagaccacggcgaccaaguccgagcacaccggccgggagaucguggaccugaugugccacgccaccuucacgaugcgccuccugagccccguccgggugccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgucugguucgugcccagcaucaaggcgggcaacgacaucgccaacugccuccggaagaacgggaagaaggugauccagcugucccgcaagacguucgacaccgaguaccagaagaccaagcugaacgacugggacuucgucgugaccacggacaucagcgagaugggcgccaacuucaaggccgaccgggugaucgacccgcgccggugccucaagcccgucauccugaccgacggccccgagcgcgugauccuggccgggcccaugccggugaccgcggccuccgccgcccagcggcgcggccgggucgggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcgcacaagguggccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggucaccgagaucgggcgggugcccacccaccucgcccaccgcacccggaacgcccuggacaaccuggugaugcuccacacguccgagcacggcgggaaggccuaccgccacgcggucgaggagcugcccgagaccauggagacccugcuccugcugggccucaugauccugcugaccgggggcgccaugcuguuccugaucagcggcaaggggaucggcaagacgagcaucgggcugaucugcgugaucgccuccagcggcaugcucuggauggccgagaucccgcugcaguggaucgccuccgcgaucgugcuggaguucuucaugaugguccuccugauccccgagcccgagaagcagcggacgccccaggacaaccagcuggccuacguggugaucgggauccucacccuggccgccaccaucgccgcgaacgagaugggccugcucgagacgaccaagcgcgaccugggcaugagcaaggagccgggggucgugucccccaccagcuaccuggacguggaccuccaccccgccuccgccuggacccuguacgccgucgcgacgaccgugaucacccccaugcugcggcacaccaucgagaacagcacggccaacgugucccucgccgccaucgccaaccaggcggucgugcugaugggccuggacaagggguggccgaucagcaagauggaccucggcgugccccugcuggcccucgggugcuacucccaggucaacccccugacccugaccgccgccgugcuccugcugaucacccacuacgccaucaucggccccggccuccaggcgaaggccacgcgcgaggcccagaagcggaccgccgccgggaucaugaagaacccgaccguggacggcaucaugaccaucgaccuggaccccgucaucuacgacagcaaguucgagaagcagcugggccaggugaugcuccuggugcugugcgcgguccagcuccugcugaugcgcacguccugggcccucugcgaggcccugacccuggccaccggccccaucaccacgcucugggagggcagccccgggaaguucuggaacaccaccaucgcgguguccauggccaacaucuuccggggcagcuaccuggccggggccggccuggccuucuccaucaugaaguccguggggaccggcaagcgcggcaccgggucccagggcgagacgcucggggagaaguggaagaagaagcugaaccagcugagccggcgcgaguucgaccucuacaagaaguccggcaucaccgaggucgaccggaccgaggcgaaggaggggcugaagcgcggcgagaucacccaccacgccgugucccggggcagcgccaagcugcagugguucguggagcgcaacauggucaucccggaggggcgggugaucgaccucggcugcgggcgcggcgggugguccuacuacugcgccggccugaagaaggugacggagguccggggcuacaccaagggcgggcccgggcacgaggagcccgugcccaugagcaccuacggcuggaacaucgugaagcugauguccgggaaggacgucuucuaccucccgcccgagaagugcgacacccugcugugcgacaucggcgagagcucccccagccccacgguggaggagucccgcaccauccgcgugcugaagauggucgagccguggcucaagaacaaccaguucugcaucaaggugcugaaccccuacaugcccaccgugaucgagcaccuggagcggcuccagcgcaagcacggcgggaugcugguccggaacccccugagccgcaacuccacccacgagauguacuggaucagcaacggcacggggaacaucguggccuccgugaacauggucagccggcuccugcugaaccgcuucaccaugacccaccggcgcccgaccaucgagaaggacguggaccucggcgcgggcacgcggcacaucaacgccgagcccgagacccccaacauggacgugaucggggagcgcaucaagcggaucaaggaggagcacaacuccaccuggcacuacgacgaggagaacccguacaagaccugggccuaccacggcagcuacgaggucaaggccacgggguccgccagcuccaugaucaacggcguggucaagcugcugaccaagcccugggacguggugcccauggucacccagauggcgaugaccgacacgacccccuucgggcagcagcgcguguucaaggagaagguggacacccggaccccgcgccccaugcccggcacgcggcgcgucaugggcaucaccgccgaguggcucuggcggacccuggggcgcaacaagaagccccggcugugcacccgcgaggaguucacgaagaaggugcgcaccaacgccgccaugggcgcgguguucaccgaggagaaccagugggacagcgccaaggccgccgucgaggacgaggacuucuggaagcucguggaccgggagcgcgagcugcacaagcuggggaagugcggcagcugcguguacaacaugauggggaagcgggagaagaagcucggcgaguucggcaaggccaaggggucccgcgcgaucugguacauguggcugggcgcccgguaccuggaguucgaggcccucggguuccugaacgaggaccacugguucagccgcgagaacuccuacagcggcgucgagggggagggccugcacaagcucggcuacauccugcgggacaucuccaagauccccggcggggccauguacgccgacgacaccgcggggugggacacgcgcaucaccgaggacgaccugcacaacgaggagaagaucacccagcagauggaccccgagcaccggcagcucgccaacgccaucuucaagcugaccuaccagaacaagguggugaagguccagcgccccacccccacggggaccgugauggacaucaucagccggaaggaccagcgcggcuccggccaggugggcaccuacgggcugaacaccuucacgaacauggaggcccagcucauccggcagauggagggcgaggggguccugagcaaggccgaccuggagaacccgcaccuccccgagaagaagaucacccaguggcuggagaccaagggcguggagcgccugaagcggauggcgaucuccggcgacgacugcguggucaagcccaucgacgaccgcuucgccaacgcccuccuggcccugaacgacauggggaaggugcggaaggacaucccccaguggcagccgagcaagggcuggcacgacuggcagcagguccccuucugcucccaccacuuccacgagcucaucaugaaggacgggcgcaagcuggucgugcccugccggccccaggacgagcugaucggccgcgcccggaucagccagggggcgggcuggucccuccgcgagaccgccugccugggcaaggccuacgcccagauguggagccugauguacuuccaccgccgggaccuccgccuggcguccaacgccaucugcagcgccgugccgguccacugggugcccacgucccggaccaccuggagcauccacgcccaccaccaguggaugaccacggaggacaugcugaccguguggaaccgcgucuggaucgaggacaaccccuggauggaggacaagacccccgugaccacgugggagaacgugccguaccucgggaagcgggaggaccaguggugcggcucccugaucgggcugaccagccgcgccaccugggcgcagaacauccccaccgccauccagcagguccggagccucaucggcaacgaggaguuccuggacuacaugcccuccaugaagcgcuuccggaaggaggaggagagcgagggggccaucugguga

SEQ ID NO: 10257 - RNA, 9873 nt, Artificial Sequence
  derived and/or modified CDS sequence (opt1) from DENV-3__FJ639799__SS-prME
accagccugugccucaugaugauccugcccgccgcccuggcguuccaccucaccagccgggacggggagccccggaugaucguggggaagaacgagcgcggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcggagcgucgcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacgugaccaccgacagccgcugccccacgcagggcgaggccguccugccggaggagcaggaccagaacuacgugugcaagcacaccuacguggaccggggguggggcaacgggugcggccucuucgggaagggcucccuggugaccugcgccaaguuccagugccuggagcccaucgagggcaagguggugcaguacgagaaccucaaguacaccgucaucaucacggugcacaccggggaccagcaccaggucggcaacgagacccagggggugaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggucaccuucaagaacgcccacgccaagaagcaggagguggugguccuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucgugcugaagaaggagguguccgagacccagcacgggaccauccucaucaaggucgaguacaagggcgaggacgugccgugcaagauccccuucagcaccgaggacgggcagggcaaggcgcacaacggccgccugaucacggccaaccccguggucaccaagaaggaggagcccgugaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgucggcggggugcucaacagccugggcaagauggugcaccagaucuucggguccgcguacacggcccuguucagcggcgucuccugggugaugaagaucggcaucggggugcuccugaccuggaucggccugaacagcaagaacaccuccaugagcuucuccugcaucgccaucgggaucaucacccucuaccugggcgccgucgugcaggccgacauggggugcgugaucaacuggaagggcaaggagcugaagugcggcagcgggaucuucgucacgaacgaggugcacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccgucguggugggggacaucaucggcguccucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgccucccgggcguggaacgugugggaggucgaggacuacggguucggcguguucaccaccaacaucuggcucaagcugcgcgagguguacacccagcugugcgaccaccggcucaugagcgccgccgucaaggacgagcgcgccgugcacgccgacaugggcuacuggaucgagagccagaagaacggguccuggaagcuggagaaggcgagccugaucgaggugaagaccugcacguggccgaagucccacacccucuggagcaacggcguccuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggaggucgacaacuucacgaugggcgugcugugccucgccauccuguucgaggaggugaugcgggggaaguucggcaagaagcacaugaucgcgggggucuucuucaccuucgugcugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgucggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccguggccuggcgcacggccacccugauccucgcgggggucagccugcugccggugugccaguccagcuccaugcggaagaccgacuggcuccccaugaccguggccgccaugggcgugccgccccucccgcuguucaucuucagccucaaggacacgcugaagcgccgcuccuggccccugaacgagggggugauggccgugggccucgucagcauccuggccuccagccugcuccggaacgacgugcccauggcgggcccccugguggccgggggccugcucaucgccugcuacgucaucaccgggaccuccgccgaccugaccguggagaaggccgcggacgugacgugggaggaggaggccgagcagaccggcgucagccacaaccugaugaucaccguggacgacgacgggaccaugcgcaucaaggacgacgagaccgagaacauccucacggugcugcugaagaccgcccuccugaucgucuccggcaucuucccguacagcauccccgccacccugcucguguggcacaccuggcagaagcagacgcagcgguccggcgugcugugggacguccccagcccgcccgagacccagaaggccgagcuggaggaggggguguaccgcaucaagcagcagggcaucuucgggaagacccaggugggcgucggggugcagaaggagggcguguuccacaccauguggcacgucacgcggggcgcggugcucaccuacaacgggaagcgccuggagcccaacugggccuccgugaagaaggaccugaucagcuacggcgggggcuggcggcucuccgcccaguggcagaagggggaggagguccaggugaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaaggucguggggcuguacggcaacgggguggucacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccgggucguggccgccgagauggaggaggcccucaaggggcugcccauccgcuaccagaccacggcgaccaaguccgagcacaccggccgggagaucguggaccugaugugccacgccaccuucacgaugcgccuccugagccccguccgggugccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgucugguucgugcccagcaucaaggcgggcaacgacaucgccaacugccuccggaagaacgggaagaaggugauccagcugucccgcaagacguucgacaccgaguaccagaagaccaagcugaacgacugggacuucgucgugaccacggacaucagcgagaugggcgccaacuucaaggccgaccgggugaucgacccgcgccggugccucaagcccgucauccugaccgacggccccgagcgcgugauccuggccgggcccaugccggugaccgcggccuccgccgcccagcggcgcggccgggucgggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcgcacaagguggccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggucaccgagaucgggcgggugcccacccaccucgcccaccgcacccggaacgcccuggacaaccuggugaugcuccacacguccgagcacggcgggaaggccuaccgccacgcggucgaggagcugcccgagaccauggagacccugcuccugcugggccucaugauccugcugaccgggggcgccaugcuguuccugaucagcggcaaggggaucggcaagacgagcaucgggcugaucugcgugaucgccuccagcggcaugcucuggauggccgagaucccgcugcaguggaucgccuccgcgaucgugcuggaguucuucaugaugguccuccugauccccgagcccgagaagcagcggacgccccaggacaaccagcuggccuacguggugaucgggauccucacccuggccgccaucaucgccgcgaacgagaugggccugcucgagaccacgaagcgcgaccugggcaugagccgggagccgggggucgugucccccaccagcuaccuggacguggaccuccaccccgccuccgccuggacccuguacgccgucgcgaccacggugaucacccccaugcugcgccacaccaucgagaacagcaccgccaacgugucccucgccgccaucgccaaccaggcggucgugcugaugggccuggacaagggguggccgaucagcaagauggaccucggcgugccccugcuggcccucgggugcuacucccaggucaacccccugacgcugaccgccgccgugcuccugcugaucacccacuacgccaucaucggccccggccuccaggcgaaggccacccgggaggcccagaagcgcacggccgccgggaucaugaagaacccgaccguggacggcaucaugaccaucgaccuggaccccgucaucuacgacagcaaguucgagaagcagcugggccaggugaugcuccuggugcugugcgcgguccagcuccugcugaugcggaccuccugggcccucugcgaggcccugacgcuggccaccggccccaucaccacccucugggagggcagccccgggaaguucuggaacacgaccaucgcgguguccauggccaacaucuuccgcggcagcuaccuggccggggccggccuggccuucuccaucaugaaguccguggggaccggcaagcggggcaccgggucccagggcgagacccucggggagaaguggaagaagaagcugaaccagcugagccgcaaggaguucgaccucuacaagaaguccggcaucacggaggucgaccggaccgaggcgaaggaggggcugaagcgcggcgagaucacccaccacgccgugucccggggcagcgccaagcugcagugguucguggagcgcaacauggucaucccggaggggcgggugaucgaccucggcugcgggcgcggcgggugguccuacuacugcgccggccugaagaaggugaccgagguccggggcuacacgaagggcgggcccgggcacgaggagcccgugcccaugagcaccuacggcuggaacaucgugaagcugauguccgggaaggacgucuucuaccucccgcccgagaagugcgacacccugcugugcgacaucggcgagagcucccccagccccaccguggaggagucccgcacgauccgcgugcugaagauggucgagccguggcucaagaacaaccaguucugcaucaaggugcugaaccccuacaugcccgccgugaucgagcaccuggagcggcuccagcgcaagcacggcgggaugcugguccggaacccccugagccgcaacuccacccacgagauguacuggaucagcaacggcaccgggaacaucguggcguccgugaacauggucagccggcuccugcugaaccgcuucaccaugacgcaccggcgcccgaccaucgagaaggacguggaccucggcgccggcacccggcacgugaacgccgagcccgagacccccaacauggacgucaucggggagcgcaucaagcggaucaaggaggagcacaacuccacguggcacuacgacgacgagaacccguacaagaccugggccuaccacggcagcuacgaggugaaggccaccggguccgcgagcuccaugaucaacggcgucgugaagcugcugaccaagcccugggacgugguccccauggugacgcagauggccaugaccgacaccacccccuucgggcagcagcgcguguucaaggagaaggucgacacgcggaccccgcgcagcaugcccggcacccggcgcgugaugggcaucaccgccgaguggcucuggcggacgcuggggcgcaacaagaagccccggcugugcacccgcgaggaguucaccaagaaggugcgcaccaacgccgcgaugggcgccgucuucacggaggagaaccagugggacagcgccaaggccgccguggaggacgaggacuucuggaagcucguggaccgggagcgcgagcugcacaagcuggggaagugcggcuccugcgucuacaacaugauggggaagcgggagaagaagcucggcgaguucggcaaggcgaaggggagccgcgccaucugguacauguggcugggcgcccgguaccuggaguucgaggcccucggguuccugaacgaggaccacugguucucccgcgagaacagcuacuccggcguggagggggagggccugcacaagcucggcuacauccugcgggacaucagcaagauccccgggggcgccauguacgcggacgacaccgccgggugggacacccgcaucaccgaggacgaccugcacaacgaggagaagaucacgcagcagauggacccggagcaccggcagcucgccaacgccaucuucaagcugaccuaccagaacaagguggucaaggugcagcgccccacccccaccggcaccgugauggacaucaucucccggaaggaccagcgcggcagcgggcaggucggcacguacgggcugaacaccuucaccaacauggaggcccagcucauccggcagauggagggcgagggggugcuguccaaggcggaccuggagaacccccaccucccggagaagaagaucacccaguggcuggagacgaagggcguggagcgccugaagcggauggccaucagcggcgacgacugcgucgugaagcccaucgacgaccgcuucgccaacgcccuccuggcccugaacgacauggggaaggugcggaaggacaucccccaguggcagcccuccaagggcuggcacgacuggcagcaggucccguucugcagccaccacuuccacgagcucaucaugaaggacgggcgcaagcugguggugcccugccggccccaggacgagcugaucggccgcgcgcggaucucccagggggccggcuggagccuccgcgagaccgccugccugggcaaggccuacgcgcagauguggucccugauguacuuccaccgccgggaccuccgccuggccagcaacgccaucugcuccgccguccccgugcacugggugccgaccagccggaccacgugguccauccacgcccaccaccaguggaugaccaccgaggacaugcugaccgucuggaaccgcguguggaucgaggacaaccccuggauggaggacaagacgcccgugaccaccugggagaacguccccuaccucgggaagcgggaggaccaguggugcggcagccugaucgggcugaccagccgcgcgacgugggcccagaacaucccgaccgccauccagcagguccggucccucaucggcaacgaggaguuccuggacuacaugcccagcaugaagcgcuuccggaaggaggaggaguccgagggggccaucugguga

SEQ ID NO: 10258 - RNA, 9873 nt, Artificial Sequence
  derived and/or modified CDS sequence (opt1) from DENV-3__FJ639800__SS-prME
accagccucugccucaugaugauccugcccgccgcccuggcguuccaccucaccagccgcgacggcgagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagguccagaacagcggcgggaccuccaucuucgccggccaccugaagugccggcugaagauggacaagcucgagcugaagggcaugagcuacgccaugugcaccaacacguucgugcugaagaaggagguguccgagacccagcacgggaccauccucaucaaggucgaguacaagggcgaggacgugccgugcaagauccccuucagcaccgaggacgggcagggcaaggcgcacaacggccgccugaucacggccaaccccguggucaccaagaaggaggagcccgugaacaucgaggccgagccgcccuucggggagagcaacaucgugaucggcaucggggacaacgcccugcggaucaacugguacaagaagggcuccagcaucgggaagauguucgaggcgaccgcccgcggcgcccggcgcauggccauccugggcgacaccgccugggacuucggguccgucggcggggugcucaacagccugggcaagauggugcaccagaucuucggguccgcguacacggcccuguucagcggcgucuccugggugaugaagaucggcaucggggugcuccugaccuggaucggccugaacagcaagaacaccuccaugagcuucuccugcaucgccaucgggaucaucacccucuaccugggcgccgucgugcaggccgacauggggugcgugaucaacuggaagggcaaggagcugaagugcggcagcgggaucuucgucacgaacgaggugcacaccuggaccgagcaguacaaguuccaggcggacucccccaagcgccucgccaccgccaucgccggcgccugggagaacggggugugcggcauccggagcacgacccgcauggagaaccugcuguggaagcagaucgcgaacgagcucaacuacauccugugggagaacaacaucaagcugaccgucguggugggggacaccaucggcguccucgagcagggcaagcggacgcugacgccccagccgauggagcugaaguacuccuggaagaccugggggaaggccaagaucgugaccgccgagacgcagaacagcuccuucaucaucgacggccccaacacccccgagugccccagcgccucccgcgcguggaacgugugggaggucgaggacuacggguucggcguguucaccaccaacaucuggcucaagcugcgggagguguacacccagcugugcgaccaccgccucaugagcgccgccgucaaggacgagcgggccgugcacgccgacaugggcuacuggaucgagagccagaagaacggguccuggaagcuggagaaggcgagccugaucgaggugaagacgugcaccuggccgaagucccacacccucuggagcaacggcguccuggaguccgacaugaucauccccaagagccuggccgggcccaucucccagcacaacuaccgcccgggcuaccacacccagacggccgggcccuggcaccucggcaagcuggagcuggacuucaacuacugcgagggcaccaccguggugaucaccgagaacugcgggacgcggggccccagccuccgcaccaccaccgucuccgggaagcugauccacgaguggugcugccggagcugcacgcugcccccgcuccgcuacaugggcgaggacgggugcugguacggcauggagauccggcccaucuccgagaaggaggagaacauggugaagucccugguguccgccggcagcggggaggucgacaacuucaccaugggcgugcugugccucgccauccuguucgaggaggugaugcgcgggaaguucggcaagaagcacaugaucgcgggggucuucuucaccuucgugcugcuccuguccggccagaucaccuggcgggacauggcccacacgcugaucaugaucggcagcaacgccuccgaccgcauggggaugggcgugaccuaccucgcccugaucgccaccuucaagauccagcccuuccuggcgcucggguucuuccugcggaagcugaccagccgcgagaaccuccugcugggcgucggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccaucuucacccugacgguggccuggcggaccgccacccugauccucgcgggggucagccugcugccggugugccaguccagcuccaugcgcaagaccgacuggcuccccaugacgguggccgccaugggcgugccgccccucccgcuguucaucuucaaccucaaggacacccugaagcgccggagcuggccccugaacgagggggugauggccgugggccucgucuccauccuggccagcucccugcuccgcaacgacgugcccauggcgggcccccugguggccgggggccugcucaucgccugcuacgucaucaccgggaccagcgccgaccugacgguggagaaggccgcggacgugaccugggaggaggaggccgagcagaccggcgucucccacaaccugaugaucaccguggacgacgacgggaccaugcggaucaaggacgacgagacggagaacauccucaccgugcugcugaagaccgcccuccugaucgucagcggcaucuucccguacuccauccccgccacccugcucguguggcacacguggcagaagcagacccagcgcagcggcgugcugugggacguccccagcccgcccgagacccagaaggccgagcuggaggaggggguguaccggaucaagcagcagggcaucuucgggaagacccaggugggcgucggggugcagaaggagggcguguuccacacgauguggcacgucacccgcggcgcggugcucaccuacaacgggaagcggcuggagcccaacugggccagcgugaagaaggaccugaucuccuacggcgggggcuggcgccucagcgcccaguggcagaagggggaggagguccaggugaucgccguggagcccggcaagaaccccaagaacuuccagaccaugcccggcacguuccagaccaccaccggggagaucggcgcgaucgcccuggacuucaagcccgggacguccggcagccccaucaucaaccgggagggcaaggucguggggcuguacggcaacgggguggucaccaagaacggcggguacgugagcggcaucgcccagaccaacgccgagccggacggccccacccccgagcuggaggaggagauguucaagaagcgcaaccucacgaucauggaccugcaccccggguccggcaagacccggaaguaccugccggccaucgugcgcgaggcgaucaagcggcgccuccggacccugauccuggcccccacccgcgucguggccgccgagauggaggaggcccucaaggggcugcccauccgguaccagacgaccgcgaccaagagcgagcacaccggccgcgagaucguggaccugaugugccacgccacguucaccaugcggcuccugucccccguccgcgugccgaacuacaaccugaucaucauggacgaggcccacuucaccgaccccgccagcaucgccgcgcggggguacaucuccacccgcgugggcaugggcgaggccgccgccaucuucaugacggcgacgccgcccgggaccgccgacgccuucccgcagagcaacgcccccauccaggacgaggagcgcgacauccccgagcgguccuggaacagcggcaacgaguggaucaccgacuucgccgggaagacggucugguucgugcccuccaucaaggcgggcaacgacaucgccaacugccuccgcaagaacgggaagaaggugauccagcugagccggaagaccuucgacaccgaguaccagaagaccaagcugaacgacugggacuucgucgugacgaccgacaucuccgagaugggcgccaacuucaaggccgaccgcgugaucgacccgcggcgcugccucaagcccgucauccugaccgacggccccgagcgggugauccuggccgggcccaugccggugaccgcggccagcgccgcccagcgccggggccgcgucgggcggaacccccagaaggagaacgaccaguacaucuucaccggccagccccucaacaacgacgaggaccacgcccacuggacggaggcgaagaugcugcuggacaacaucaacacccccgaggggaucaucccggcccucuucgagcccgagcgcgagaaguccgccgccaucgacggcgaguaccggcugaagggcgagagccgcaagaccuucguggagcugaugcggcgcggggaccuccccgucuggcuggcgcacaagguggccuccgagggcaucaaguacaccgaccggaaguggugcuucgacgggcagcgcaacaaccagauccuggaggagaacauggacguggagaucuggacgaaggagggcgagaagaagaagcuccggccccgcuggcuggacgcccgcaccuacagcgacccgcuggcccucaaggaguucaaggacuucgccgcgggccggaaguccaucgcccuggaccuggucaccgagaucgggcgcgugcccacccaccucgcccaccggacgcgcaacgcccuggacaaccuggugaugcuccacaccagcgagcacggcgggaaggccuaccggcacgcggucgaggagcugcccgagaccauggagacccugcuccugcugggccucaugauccugcugaccggcggggccaugcuguuccugaucuccgggaaggggaucggcaagaccagcaucgggcugaucugcgugaucgccagcuccggcaugcucuggauggccgagaucccgcugcaguggaucgccagcgcgaucgugcuggaguucuucaugaugguccuccugauccccgagcccgagaagcagcgcacgccccaggacaaccagcuggccuacguggugaucgggauccucacccuggccgccaucaucgccgcgaacgagaugggccugcucgagacgaccaagcgggaccugggcauguccaaggagccgggggucgugagccccaccuccuaccuggacguggaccuccaccccgccagcgccuggacccuguacgccgucgcgacgaccgugaucacccccaugcugcgccacaccaucgagaacuccacggccaacgugagccucgccgccaucgccaaccaggcggucgugcugaugggccuggacaagggguggccgaucuccaagauggaccucggcgugccccugcuggcccucgggugcuacagccaggucaacccccugacccugaccgccgccgugcuccugcugaucacccacuacgccaucaucggccccggccuccaggcgaaggccacgcgggaggcccagaagcgcaccgccgccgggaucaugaagaacccgaccguggacggcaucaugaccaucgaccuggaccccgucaucuacgacuccaaguucgagaagcagcugggccaggugaugcuccuggugcugugcgcgguccagcuccugcugaugcggacgagcugggcccucugcgaggcccugacccuggccaccggccccaucaccacgcucugggagggcucccccgggaaguucuggaacaccaccaucgcggugagcauggccaacaucuuccgcggcuccuaccuggccggggccggccuggccuucagcaucaugaaguccguggggaccggcaagcggggcaccgggagccagggcgagacgcucggggagaaguggaagaagaagcugaaccagcugucccgcaaggaguucgaccucuacaagaaguccggcaucaccgaggucgaccggaccgaggcgaaggaggggcugaagcgcggcgagaucacccaccacgccgugagccggggcuccgccaagcugcagugguucguggagcgcaacauggucaucccggaggggcgggugaucgaccucggcugcgggcgcggcggguggagcuacuacugcgccggccugaagaaggugacggagguccggggcuacaccaagggcgggcccgggcacgaggagcccgugcccauguccaccuacggcuggaacaucgugaagcugaugagcgggaaggacgucuucuaccucccgcccgagaagugcgacacccugcugugcgacaucggcgaguccagccccucccccacgguggaggagagccgcaccauccgcgugcugaagauggucgagccguggcucaagaacaaccaguucugcaucaaggugcugaaccccuacaugcccaccgugaucgagcaccuggagcggcuccagcgcaagcacggcgggaugcugguccggaacccccugucccgcaacagcacccacgagauguacuggaucuccaacggcagcgggaacaucguggccuccgugaacauggucagccggcuccugcugaaccgcuucacgaugacccaccggcgcccgaccaucgagaaggacguggaccucggcgcgggcacccggcacgugaacgccgagcccgagacgcccaacauggacgucaucggggagcgcaucaagcggaucaaggaggagcacaacuccaccuggcacuacgacgacgagaacccguacaagaccugggccuaccacggcagcuacgaggugaaggccaccggguccgccagcuccaugaucaacggcgucgugaagcugcugacgaagcccugggacgugguccccauggugacccagauggcgaugaccgacaccacgcccuucgggcagcagcgcguguucaaggagaaggucgacacccggaccccgcgcagcaugcccggcacccggcgcgugaugggcaucacggccgaguggcucuggcggacccuggggcgcaacaagaagccccggcugugcacccgcgaggaguucaccaagaaggugcgcacgaacgccgccaugggcgcggucuucaccgaggagaaccagugggacagcgccaaggccgccguggaggacgaggacuucuggaagcucguggaccgggagcgcgagcugcacaagcuggggaagugcggcuccugcgucuacaacaugauggggaagcgggagaagaagcucggcgaguucggcaaggccaaggggagccgcgcgaucugguacauguggcugggcgcccgguaccuggaguucgaggcccucggguuccugaacgaggaccacugguucucccgcgagaacagcuacuccggcguggagggggagggccugcacaagcucggcuacauccugcgggacaucagcaagauccccgggggcgccauguacgccgacgacaccgcggggugggacacccgcaucacggaggacgaccugcacaacgaggagaagaucacccagcagauggacccggagcaccggcagcucgccaacgccaucuucaagcugaccuaccagaacaagguggucaaggugcagcgccccacccccaccggcacggugauggacaucaucucccggaaggaccagcgcggcagcgggcaggucggcaccuacgggcugaacaccuucaccaacauggaggcccagcucauccggcagauggagggcgagggggugcuguccaaggccgaccuggagaacccccaccucccggagaagaagaucacgcaguggcuggagaccaagggcguggagcgccugaagcggauggcgaucagcggcgacgacugcgucgugaagcccaucgacgaccgcuucgccaacgcccuccuggcccugaacgacauggggaaggugcggaaggacaucccccaguggcagcccuccaagggcuggcacgacuggcagcaggucccguucugcagccaccacuuccacgagcucaucaugaaggacgggcgcaagcugguggugcccugccggccccaggacgagcugaucggccgcgcccggaucucccagggggcgggcuggagccuccgcgagaccgccugccugggcaaggccuacgcccagauguggucccugauguacuuccaccgccgggaccuccgccuggcgagcaacgccaucugcuccgccguccccgugcacugggugccgaccagccggacgaccugguccauccacgcccaccaccaguggaugaccaccgaggacaugcugacggucuggaaccgcguguggaucgaggacaaccccuggauggaggacaagacccccgugaccaccugggagaacguccccuaccucgggaagcgggaggaccaguggugcggcagccugaucgggcugacgagccgcgccaccugggcgcagaacaucccgaccgccauccagcagguccggucccucaucggcaacgaggaguuccuggacuacaugcccagcaugaagcgcuuccggaaggaggaggaguccgagggggccaucugguga

SEQ ID NO: 10259 - RNA, 9873 nt, Artificial Sequence
  derived and/or modified CDS sequence (opt1) from DENV-3__FJ639801__SS-prME
accagccucugccucaugaugauccuccccgccgcccuggcguuccaccucaccagccgggacggcgagccccggaugaucguggggaagaacgagcggggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcggagcgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaccaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagacgugcaccuggccgaagucccacacccucuggagcaacggcgugcuggaguccgacaugaucauccccaagagccuggccgggcccaucucccagcacaacuaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcggggagguggacaacuucaccaugggcguccugugccucgccauccuguucgaggaggugaugcgggggaaguucggcaagaagcacaugaucgcggggguguucuucaccuucguccugcuccuguccggccagaucaccuggcgcgacauggcccacacgcugaucaugaucggcagcaacgccuccgaccggauggggaugggcgugaccuaccucgcccugaucgccaccuucaagauccagcccuuccuggcgcucggguucuuccugcgcaagcugaccagccgggagaaccuccugcugggcgugggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccaucuucacccugacggucgccuggcgcaccgccacccugauccucgcgggggugagccugcugccggucugccaguccagcuccaugcggaagaccgacuggcuccccaugacgguggccgccaugggcgugccgccccucccgcuguucaucuucagccucaaggacacccugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugacggucgagaaggccgcggacgugaccugggaggaggaggccgagcagaccggcgugagccacaaccugaugaucaccgucgacgacgacgggaccaugcgcaucaaggacgacgagacggagaacauccucaccgugcugcugaagaccgcccuccugaucguguccggcaucuucccguacagcauccccgccacccugcucgucuggcacacguggcagaagcagacccagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacacgauguggcacgugacccggggcgcgguccugaccugcaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcacguuccagaccaccaccggggagaucggcgcgaucgcccuggacuucaagcccgggacgagcggcagccccaucaucaaccgcgagggcaagguggucgggcuguacggcaacgggguggugaccaagaacggcggguacgucuccggcaucgcccagaccaacgccgagccggacggccccacccccgagcuggaggaggagauguucaagaagcggaaccucacgaucauggaccugcaccccgggagcggcaagacccgcaaguaccugccggccaucgugcgggaggcgaucaagcgccggcuccgcacccugauccuggcccccacccggguggucgccgccgagauggaggaggcccucaaggggcugcccauccgcuaccagacgaccgcgaccaaguccgagcacaccggccgggagaucguggaccugaugugccacgccacguucaccaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugacggcgacgccgcccgggaccgccgacgccuucccgcaguccaacgcccccauccaggacgaggagcgcgacauccccgagcgcagcuggaacuccggcaacgaguggaucaccgacuucgccgggaagacggugugguucguccccagcaucaaggcgggcaacgacaucgccaacugccuccggaagaacgggaagaaggugauccagcugucccgcaagaccuucgacaccgaguaccagaagaccaagcugaacgacugggacuucguggucacgaccgacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggacggaggcgaagaugcugcuggacaacaucaacacccccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggacgaaggagggcgagaagaagaagcuccgcccccgguggcuggacgcccgcaccuacuccgacccgcuggcccucaaggaguucaaggacuucgccgcgggccgcaagagcaucgcccuggaccuggugaccgagaucgggcggguccccacccaccucgcccaccgcacgcggaacgcccuggacaaccuggugaugcuccacaccuccgagcacggcgggaaggccuaccgccacgcgguggaggagcugcccgagaccauggagacccugcuccugcugggccucaugauccugcugaccggcggggccaugcuguuccugaucagcgggaaggggaucggcaagaccagcaucgggcugaucugcgucaucgccuccagcggcaugcucuggauggccgagaucccgcugcaguggaucgccuccgcgaucgugcuggaguucuucaugauggugcuccugauccccgagcccgagaagcagcggacgccccaggacaaccagcuggccuacgucgugaucgggauccucacccuggccgccacgaucgccgcgaacgagaugggccugcucgagaccaccaagcgcgaccugggcaugagcaaggagccggggguggucucccccaccagcuaccuggacguggaccuccaccccgccuccgccuggacgcuguacgccguggcgaccaccgucaucacccccaugcugcggcacacgaucgagaacagcaccgccaacgugucccucgccgccaucgccaaccaggcggugguccugaugggccuggacaagggguggccgaucagcaagauggaccucggcgugccccugcuggcccucgggugcuacucccaggugaacccccugacccugaccgccgccguccuccugcugaucacgcacuacgccaucaucggccccggccuccaggcgaaggccacccgcgaggcccagaagcggaccgccgccgggaucaugaagaacccgaccguggacggcaucaugacgaucgaccuggaccccgugaucuacgacagcaaguucgagaagcagcuggggcaggucaugcuccuggugcugugcgcggugcagcuccugcugaugcgcaccuccugggcccucugcgaggcccugacccuggccaccggccccaucacgacccucugggagggcagccccgggaaguucuggaacaccaccaucgcggucuccauggccaacaucuuccggggcagcuaccuggccggggccggccuggccuucuccaucaugaaguccguggggaccggcaagcgcggcacggggucccagggcgagacccucggggagaaguggaagaagcggcugaaccagcugagccgcaaggaguucgaccucuacaagaaguccggcaucaccgagguggaccggaccgaggcgaaggaggggcugaagcgcggcgagaucacgcaccacgccgucucccggggcagcgccaagcugcagugguucguggagcgcaacauggugaucccggaggggcgggucaucgaccucggcugcgggcgcggcgggugguccuacuacugcgccggccugaagaaggugaccgaggugcggggcuacaccaagggcgggcccgggcacgaggagcccguccccaugagcaccuacggcuggaacaucgugaagcugauguccgggaaggacguguucuaccucccgcccgagaagugcgacacgcugcugugcgacaucggcgagagcucccccagccccaccgucgaggagucccgcaccauccgcgugcugaagaugguggagccguggcucaagaacaaccaguucugcaucaagguccugaaccccuacaugcccaccgugaucgagcaccuggagcggcuccagcgcaagcacggcgggaugcuggugcggaacccccugagccgcaacuccacgcacgagauguacuggaucagcaacggcaccgggaacaucgucgccuccgugaacauggugagccggcuccugcugaaccgcuucaccaugacccaccggcgcccgacgaucgagaaggacgucgaccucggcgcgggcacccggcacgugaacgccgagcccgagacccccaacauggacgugaucggggagcgcaucaagcggaucaaggaggagcacaacuccaccuggcacuacgacgacgagaacccguacaagacgugggccuaccacggcagcuacgaggucaaggccaccggguccgccagcuccaugaucaacggcguggucaagcugcugaccaagcccugggacguggugcccauggucacccagauggcgaugacggacaccacccccuucgggcagcagcgcguguucaaggagaagguggacacccggacgccgcgcagcaugcccggcacccggcgcgucaugggcaucaccgccgaguggcucuggcggacccuggggcgcaacaagaagccccggcugugcacgcgcgaggaguucaccaagaaggugcgcaccaacgccgccaugggcgcgguguucaccgaggagaaccagugggacagcgccaaggccgccgucgaggacgaggacuucuggaagcucguggaccgggagcgcgagcugcacaagcuggggaagugcggcuccugcguguacaacaugauggggaagcgggagaagaagcucggcgaguucggcaaggccaaggggagccgcgcgaucugguacauguggcugggcgcccgguaccuggaguucgaggcccucggguuccugaacgaggaccacugguucucccgcgagaacagcuacuccggcgucgagggggagggccugcacaagcucggcuacauccugcgggacaucagcaagauccccgggggcgccauguacgccgacgacacggcggggugggacacccgcaucaccgaggacgaccugcacaacgaggagaagaucacccagcagauggacccggagcaccggcagcucgccaacgccaucuucaagcugaccuaccagaacaagguggugaagguccagcgccccacgcccaccggcaccgugauggacaucaucucccggaaggaccagcgcggcagcggccaggugggcaccuacgggcugaacacguucaccaacauggaggcccagcucauccggcagauggagggcgaggggguccuguccaaggccgaccuggagaacccccaccucccggagaagaagaucacccaguggcuggagaccaagggcguggagcgccugaagcggauggcgaucagcggcgacgacugcguggucaagcccaucgacgaccgcuucgccaacgcccuccuggcccugaacgacauggggaaggugcggaaggacaucccccaguggcagcccuccaagggcuggcacgacuggcagcaggucccguucugcagccaccacuuccacgagcucaucaugaaggacgggcgcaagcuggucgugcccugccggccccaggacgagcugaucggccgcgcccggaucucccagggggcgggcuggagccuccgcgagacggccugccugggcaaggccuacgcccagauguggucccugauguacuuccaccgccgggaccuccgccuggcgagcaacgccaucugcuccgccgugcccguccacugggugccgaccagccggaccaccugguccauccacgcccaccaccaguggaugacgaccgaggacaugcugaccguguggaaccgcgucuggaucgaggacaaccccuggauggaggacaagacccccgugacgaccugggagaacgugcccuaccucgggaagcgggaggaccaguggugcggcagccugaucgggcugaccagccgcgccaccugggcgcagaacaucccgacggccauccagcagguccggucccucaucggcaacgaggaguuccuggacuacaugcccagcaugaagcgcuuccggaaggaggaggaguccgagggggccaucugguga

SEQ ID NO: 10260 - RNA, 9873 nt, Artificial Sequence
  derived and/or modified CDS sequence (opt1) from DENV-3__KF955471__SS-prME
accagccugugccucaugaugauccugcccgccgcccuggcguuccaccucaccucccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucaaccucaaggacacgcugaagcgccgcagcuggccccugaacgagggggucauggccgugggccucguguccauccuggccagcucccugcuccggaacgacguccccauggcgggcccccugguggccgggggccugcucaucgccugcuacgugaucaccgggaccagcgccgaccugaccgucgagaaggccgcggacgugacgugggaggaggaggccgagcagaccggcgugucccacaaccugaugaucaccgucgacgacgacgggaccaugcgcaucaaggacgacgagaccgagaacauccucacggugcugcugaagaccgcccuccugaucgugagcggcaucuucccguacuccauccccgccacccugcucgucuggcacaccuggcagaagcagacgcagcggagcggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccagcgugaagaaggaccugaucuccuacggcgggggcuggcggcucagcgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccuccggcagccccaucaucaaccgcgagggcaagguggucgggcuguacggcaacgggguggugacgaagaacggcggguacgucagcggcaucgcccagaccaacgccgagccggacggccccacccccgagcuggaggaggagauguucaagaagcggaaccucaccaucauggaccugcaccccggguccggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaagagcgagcacaccggccgggagaucguggaccugaugugccacgccaccuucacgaugcgccuccugucccccgugcgggucccgaacuacaaccugaucaucauggacgaggcccacuucaccgaccccgccagcaucgccgcgcgcggguacaucuccacccgggugggcaugggcgaggccgccgccaucuucaugaccgcgacgccgcccgggaccgccgacgccuucccgcagagcaacgcccccauccaggacgaggagcgcgacauccccgagcgcuccuggaacagcggcaacgaguggaucaccgacuucgccgggaagaccgugugguucguccccuccaucaaggcgggcaacgacaucgccaacugccuccggaagaacgggaagaaggugauccagcugagccgcaagacguucgacaccgaguaccagaagaccaagcugaacgacugggacuucguggucaccacggacaucuccgagaugggcgccaacuucaaggccgaccgggugaucgacccgcgccggugccucaagcccgugauccugaccgacggccccgagcgcgucauccuggccgggcccaugccggugaccgcggccagcgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagagccggaagaccuucgucgagcugaugcgccgcggggaccuccccguguggcuggcgcacaaggucgccuccgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacagcgacccgcuggcccucaaggaguucaaggacuucgccgcgggccgcaaguccaucgcccuggaccuggugaccgagaucgggcggguccccacccaccucgcccaccgcacccggaacgcccuggacaaccuggugaugcuccacacgagcgagcacggcgggaaggccuaccgccacgcgguggaggagcugcccgagaccauggagacccugcuccugcugggccucaugauccugcugaccgggggcgccaugcuguuccugaucuccggcaaggggaucggcaagacgagcaucgggcugaucugcgucaucgccagcuccggcaugcucuggauggccgagaucccgcugcaguggaucgccagcgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccacgaagcgcgaccugggcauguccaaggagccggggguggucagccccaccuccuaccuggacguggaccuccaccccgccagcgccuggacccuguacgccguggcgaccacggucaucacccccaugcugcggcacaccaucgagaacuccaccgccaacgugagccucgccgccaucgccaaccaggcggugguccugaugggccuggacaagggguggccgaucuccaagauggaccucggcgugccccugcuggcccucgggugcuacagccaggugaacccccugacgcugaccgccgccguccuccugcugaucacccacuacgccaucaucggccccggccuccaggcgaaggccacccgcgaggcccagaagcggacggccgccgggaucaugaagaacccgaccguggacggcaucaugaccaucgaccuggaccccgugaucuacgacuccaaguucgagaagcagcuggggcaggucaugcuccuggugcugugcgcggugcagcuccugcugaugcgcaccagcugggcccucugcgaggcccugacgcuggccaccggccccaucaccacccucugggagggcucccccgggaaguucuggaacacgaccaucgcggucagcauggccaacaucuuccggggcuccuaccuggccggggccggccuggccuucagcaucaugaaguccguggggaccggcaagcgcggcaccgggagccagggcgagacccucggggagaaguggaagaagaagcugaaccagcugucccggaaggaguucgaccucuacaagaaguccggcaucacggagguggaccgcaccgaggcgaaggaggggcugaagcggggcgagaucacccaccacgccgucagccgcggcuccgccaagcugcagugguucguggagcggaacauggugaucccggaggggcgcgucaucgaccucggcugcgggcggggcggguggagcuacuacugcgccggccugaagaaggugaccgaggugcgcggcuacacgaagggcgggcccgggcacgaggagcccguccccauguccaccuacggcuggaacaucgugaagcugaugagcgggaaggacguguucuaccucccgcccgagaagugcgacacccugcugugcgacaucggcgaguccagccccucccccaccgucgaggagagccggacgauccgcgugcugaagaugguggagccguggcucaagaacaaccaguucugcaucaagguccugaaccccuacaugcccaccgugaucgagcaccuggagcgccuccagcggaagcacggcgggaugcuggugcgcaacccccugucccggaacagcacccacgagauguacuggaucuccaacggcagcgggaacaucgucgccuccgugaacauggugagccgccuccugcugaaccgguucaccaugacgcaccgccggccgaccaucgagaaggacgucgaccucggcgcgggcacccgccacgugaacgccgagcccgagacccccaacauggacgugaucggggagcggaucaagcgcaucaaggaggagcacaacuccacguggcacuacgacgacgagaacccguacaagaccugggccuaccacggcagcuacgaggucaaggccaccggguccgccagcuccaugaucaacggcguggucaagcugcugaccaagcccugggacguggugcccauggucacgcagauggcgaugaccgacaccacccccuucgggcagcagcggguguucaaggagaagguggacacgcgcaccccgcggagcaugcccggcacccgccgggucaugggcaucaccgccgaguggcucuggcgcacgcuggggcggaacaagaagccccgccugugcacccgggaggaguucaccaagaaggugcgcaccaacgccgccaugggcgcgguguucacggaggagaaccagugggacagcgccaaggccgccgucgaggacgaggacuucuggaagcucguggaccgcgagcgggagcugcacaagcuggggaagugcggcuccugcguguacaacaugauggggaagcgcgagaagaagcucggcgaguucggcaaggccaaggggagccgggcgaucugguacauguggcugggcgcccgcuaccuggaguucgaggcccucggguuccugaacgaggaccacugguucucccgggagaacagcuacuccggcgucgagggggagggccugcacaagcucggcuacauccugcgcgacaucagcaagauccccgggggcgccauguacgccgacgacaccgcggggugggacacccggaucaccgaggacgaccugcacaacgaggagaagaucacgcagcagauggacccggagcaccgccagcucgccaacgccaucuucaagcugaccuaccagaacaagguggugaagguccagcggcccacccccaccggcaccgugauggacaucaucucccgcaaggaccagcggggcagcggccaggugggcacguacgggcugaacaccuucaccaacauggaggcccagcucauccgccagauggagggcgaggggguccuguccaaggccgaccuggagaacccccaccucccggagaagaagaucacccaguggcuggagacgaagggcguggagcggcugaagcgcauggcgaucagcggcgacgacugcguggucaagcccaucgacgaccgguucgccaacgcccuccuggcccugaacgacauggggaaggugcgcaaggacaucccccaguggcagcccuccaagggcuggcacgacuggcagcaggucccguucugcagccaccacuuccacgagcucaucaugaaggacgggcggaagcuggucgugcccugccgcccccaggacgagcugaucggccgggcccgcaucucccagggggcgggcuggagccuccgggagaccgccugccugggcaaggccuacgcccagauguggucccugauguacuuccaccgccgcgaccuccggcuggcgagcaacgccaucugcuccgccgugcccguccacugggugccgaccagccgcaccacgugguccauccacgcccaccaccaguggaugaccaccgaggacaugcugaccguguggaaccgggucuggaucgaggacaaccccuggauggaggacaagacgcccgugaccaccugggagaacgugcccuaccucgggaagcgcgaggaccaguggugcggcagccugaucgggcugaccagccgggccacgugggcgcagaacaucccgaccgccauccagcagguccgcucccucaucggcaacgaggaguuccuggacuacaugcccagcaugaagcgguuccgcaaggaggaggaguccgagggggccaucugguga

SEQ ID NO: 10261 - RNA, 9873 nt, Artificial Sequence
  derived and/or modified CDS sequence (opt1) from DENV-3__FJ639803__SS-prME
accagccugugccucaugaugauccugcccgccgcccuggcguuccaccucaccucccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucaaccucaaggacacgcugaagcgccgcagcuggccccugaacgagggggucauggccgugggccucguguccauccuggccagcucccugcuccggaacgacguccccauggcgggcccccugguggccgggggccugcucaucgccugcuacgugaucaccgggaccagcgccgaccugaccgucgagaaggccgcggacgugacgugggaggaggaggccgagcagaccggcgugucccacaaccugaugaucaccgucgacgacgacgggaccaugcgcaucaaggacgacgagaccgagaacauccucacggugcugcugaagaccgcccuccugaucgugagcggcaucuucccguacuccauccccgccacccugcucgucuggcacaccuggcagaagcagacgcagcggagcggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccagcgugaagaaggaccugaucuccuacggcgggggcuggcggcucagcgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccuccggcagccccaucaucaaccgcgagggcaagguggucgggcuguacggcaacgggguggugacgaagaacggcggguacgucagcggcaucgcccagaccaacgccgagccggacggccccacccccgagcuggaggaggagauguucaagaagcggaaccucaccaucauggaccugcaccccggguccggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaagagcgagcacaccggccgggagaucguggaccugaugugccacgccaccuucacgaugcgccuccugucccccgugcgggucccgaacuacaaccugaucaucauggacgaggcccacuucaccgaccccgccagcaucgccgcgcgcggguacaucuccacccgggugggcaugggcgaggccgccgccaucuucaugaccgcgacgccgcccgggaccgccgacgccuucccgcagagcaacgcccccauccaggacgaggagcgcgacauccccgagcgcuccuggaacagcggcaacgaguggaucaccgacuucgccgggaagaccgugugguucguccccuccaucaaggcgggcaacgacaucgccaacugccuccggaagaacgggaagaaggugauccagcugagccgcaagacguucgacaccgaguaccagaagaccaagcugaacgacugggacuucguggucaccacggacaucuccgagaugggcgccaacuucaaggccgaccgggugaucgacccgcgccggugccucaagcccgugauccugaccgacggccccgagcgcgucauccuggccgggcccaugccggugaccgcggccagcgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagagccggaagaccuucgucgagcugaugcgccgcggggaccuccccguguggcuggcgcacaaggucgccuccgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacagcgacccgcuggcccucaaggaguucaaggacuucgccgcgggccgcaaguccaucgcccuggaccuggugaccgagaucgggcggguccccacccaccucgcccaccgcacccggaacgcccuggacaaccuggugaugcuccacacgagcgagcacggcgggaaggccuaccgccacgcgguggaggagcugcccgagaccauggagacccugcuccugcugggccucaugauccugcugaccgggggcgccaugcuguuccugaucuccggcaaggggaucggcaagacgagcaucgggcugaucugcgucaucgugagcuccggcaugcucuggauggccgagaucccgcugcaguggaucgccagcgccaucgugcuggaguucuucaugaugguccuccugauccccgagcccgagaagcagcggacgccccaggacaaccagcuggcguacguggugaucgggauccucacccuggccgccaucaucgccgccaacgagaugggccugcucgagaccacgaagcgcgaccugggcauguccaaggagccgggggucgugagccccaccuccuaccuggacguggaccuccaccccgcgagcgccuggacccuguacgccgucgccaccacggugaucacccccaugcugcggcacaccaucgagaacuccaccgcgaacgugagccucgccgccaucgccaaccaggccgucgugcugaugggccuggacaagggguggccgaucuccaagauggaccucggcgugccccugcuggcgcucgggugcuacagccaggucaacccccugacgcugaccgccgccgugcuccugcugaucacccacuacgccaucaucggccccggccuccaggccaaggcgacccgcgaggcccagaagcggacggccgccgggaucaugaagaacccgaccguggacggcaucaugaccaucgaccuggaccccgucaucuacgacuccaaguucgagaagcagcugggccaggugaugcuccuggugcugugcgccguccagcuccugcugaugcgcaccagcugggcgcucugcgaggcccugacgcuggccaccggccccaucaccacccucugggagggcucccccgggaaguucuggaacacgaccaucgccgugagcauggcgaacaucuuccggggcuccuaccuggccggggccggccuggccuucagcaucaugaaguccguggggaccggcaagcgcggcaccgggagccagggcgagacccucggggagaaguggaagaagaagcugaaccagcugucccggaaggaguucgaccucuacaagaaguccggcaucacggaggucgaccgcaccgaggccaaggaggggcugaagcggggcgagaucacccaccacgcggugagccgcggcuccgccaagcugcagugguucguggagcggaacauggucaucccggaggggcgcgugaucgaccucggcugcgggcggggcggguggagcuacuacugcgccggccugaagaaggugaccgagguccgcggcuacacgaagggcgggcccgggcacgaggagcccgugcccauguccaccuacggcuggaacaucgugaagcugaugagcgggaaggacgucuucuaccucccgcccgagaagugcgacacccugcugugcgacaucggcgaguccagccccucccccaccguggaggagagccggacgauccgcgugcugaagauggucgagccguggcucaagaacaaccaguucugcaucaaggugcugaaccccuacaugcccaccgugaucgagcaccuggagcgccuccagcggaagcacggcgggaugcugguccgcaacccccugucccggaacagcacccacgagauguacuggaucuccaacggcagcgggaacaucguggccuccgugaacauggucagccgccuccugcugaaccgguucaccaugacgcaccgccggccgaccaucgagaaggacguggaccucggcgccggcacccgccacgugaacgcggagcccgagacccccaacauggacgucaucggggagcggaucaagcgcaucaaggaggagcacaacuccacguggcacuacgacgacgagaacccguacaagaccugggccuaccacggcagcuacgaggugaaggccaccggguccgccagcuccaugaucaacggcgucgugaagcugcugaccaagcccugggacgugguccccauggugacgcagauggccaugaccgacaccacccccuucgggcagcagcggguguucaaggagaaggucgacacgcgcaccccgcggagcaugcccggcacccgccgggugaugggcaucaccgcggaguggcucuggcgcacgcuggggcggaacaagaagccccgccugugcacccgggaggaguucaccaagaaggugcgcaccaacgccgccaugggcgccgucuucacggaggagaaccagugggacagcgcgaaggccgccguggaggacgaggacuucuggaagcucguggaccgcgagcgggagcugcacaagcuggggaagugcggcuccugcgucuacaacaugauggggaagcgcgagaagaagcucggcgaguucggcaaggccaaggggagccgggccaucugguacauguggcugggcgcgcgcuaccuggaguucgaggcccucggguuccugaacgaggaccacugguucucccgggagaacagcuacuccggcguggagggggagggccugcacaagcucggcuacauccugcgcgacaucagcaagauccccgggggcgccauguacgccgacgacaccgccgggugggacacccggaucaccgaggacgaccugcacaacgaggagaagaucacgcagcagauggacccggagcaccgccagcucgcgaacgccaucuucaagcugaccuaccagaacaagguggucaaggugcagcggcccacccccaccggcaccgugauggacaucaucucccgcaaggaccagcggggcagcgggcaggucggcacguacgggcugaacaccuucaccaacauggaggcccagcucauccgccagauggagggcgagggggugcuguccaaggccgaccuggagaacccccaccucccggagaagaagaucacccaguggcuggagacgaagggcguggagcggcugaagcgcauggccaucagcggcgacgacugcgucgugaagcccaucgacgaccgguucgcgaacgcccuccuggcccugaacgacauggggaaggugcgcaaggacaucccccaguggcagcccuccaagggcuggcacgacuggcagcaggucccguucugcagccaccacuuccacgagcucaucaugaaggacgggcggaagcugguggugcccugccgcccccaggacgagcugaucggccgggcccgcaucucccagggggccggcuggagccuccgggagaccgcgugccugggcaaggccuacgcccagauguggucccugauguacuuccaccgccgcgaccuccggcuggccagcaacgcgaucugcuccgccguccccgugcacugggugccgaccagccgcaccacgugguccauccacgcccaccaccaguggaugaccaccgaggacaugcugaccgucuggaaccggguguggaucgaggacaaccccuggauggaggacaagacgcccgugaccaccugggagaacguccccuaccucgggaagcgcgaggaccaguggugcggcagccugaucgggcugaccagccgggccacgugggcccagaacaucccgaccgcgauccagcagguccgcucccucaucggcaacgaggaguuccuggacuacaugcccagcaugaagcgguuccgcaaggaggaggaguccgagggggccaucugguga

SEQ ID NO: 10262 - RNA, 9873 nt, Artificial Sequence
  derived and/or modified CDS sequence (opt1) from DENV-3__FJ639804__SS-prME
accagccugugccucaugaugauccugcccgccgcccuggcguuccaccucaccucccgggacggggagccccggaugaucguggggaagaacgagcggggcaagagccugcuguucaagaccgccuccgggaucaacaugugcacccucaucgccauggaccugggggagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagucccaggugggcguggggguccagaaggagggcguguuccacaccauguggcacgugacccggggcgcgguccucacguacaacgggaagcgccuggagcccaacugggccagcgugaagaaggaccugaucuccuacggcgggggcuggcggcucagcgcccaguggcagaagggggaggaggugcaggucaucgccguggagcccggcaagaaccccaagaacuuccagaccaugcccggcaccuuccagaccacgaccggggagaucggcgcgaucgcccuggacuucaagcccgggaccagcggcucccccaucaucaaccgcgagggcaagaucguggggcuguacggcaacggggucgugaccaagaacggcggguacgugagcggcaucgcccagacgaacgccgagccggacggccccacccccgagcuggaggaggagauguucaagaagcggaaccucaccaucauggaccugcaccccggguccggcaagacccgcaaguaccugccggccaucguccgggaggcgaucaagcgccggcuccgcacgcugauccuggcccccacccgggugguggccgccgagauggaggaggcccucaaggggcugcccauccgcuaccagaccaccgcgaccaagagcgagcacacgggccgggagaucgucgaccugaugugccacgccaccuucaccaugcgccuccugucccccgugcgggugccgaacuacaaccugaucaucauggacgaggcccacuucacggaccccgccagcaucgccgcgcgcggguacaucuccacccgggucggcaugggcgaggccgccgccaucuucaugaccgcgacgccgcccgggacggccgacgccuucccgcagagcaacgcccccauccaggacgaggagcgcgacauccccgagcgcuccuggaacagcggcaacgaguggaucaccgacuucgccgggaagaccgugugguucgugcccuccaucaaggcgggcaacgacaucgccaacugccuccggaagaacgggaagaaggucauccagcugagccgcaagaccuucgacacggaguaccagaagaccaagcugaacgacugggacuucguggugaccaccgacaucuccgagaugggcgccaacuucaaggccgaccgggucaucgacccgcgccggugccucaagcccgugauccugacggacggccccgagcgcgugauccuggccgggcccaugccggucaccgcggccagcgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacccccgaggggaucaucccggcccucuucgagcccgagcgggagaaguccgccgccaucgacggcgaguaccgccugaagggcgagagccggaagacguucguggagcugaugcgccgcggggaccuccccgucuggcuggcgcacaagguggccuccgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcaccuacagcgacccgcuggcccucaaggaguucaaggacuucgccgcgggccgcaaguccaucgcccuggaccuggugacggagaucgggcgggugcccacccaccucgcccaccgcacccggaacgcccuggacaaccuggucaugcuccacaccagcgagcacggcgggaaggccuaccgccacgcgguggaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucguccuggaguucuucaugauggugcuccugauccccgagcccgagaagcagcggacgccccaggacaaccagcuggccuacguggucaucgggauccucacccuggccgccaccaucgccgcgaacgagaugggccugcucgagaccacgaagcgcgaccugggcauguccaaggagccggggguggugagccccaccuccuaccuggacgucgaccuccaccccgccagcgccuggacccuguacgccguggcgaccacggugaucacccccaugcugcggcacaccaucgagaacuccaccgccaacgucagccucgccgccaucgccaaccaggcgguggugcugaugggccuggacaagggguggccgaucuccaagauggaccucggcgucccccugcuggcccucgggugcuacagccaggugaacccccugacgcugaccgccgccgugcuccugcugaucacccacuacgccaucaucggccccggccuccaggcgaaggccacccgcgaggcccagaagcggacggccgccgggaucaugaagaacccgaccgucgacggcaucaugaccaucgaccuggaccccgugaucuacgacuccaaguucgagaagcagcugggccaggugaugcuccugguccugugcgcggugcagcuccugcugaugcgcaccagcugggcccucugcgaggcccugacgcuggccaccggccccaucaccacccucugggagggcucccccgggaaguucuggaacacgaccaucgcggugagcauggccaacaucuuccggggcuccuaccuggccggggccggccuggccuucagcaucaugaaguccgucgggaccggcaagcgcggcaccgggagccagggcgagacccucggggagaaguggaagaagaagcugaaccagcugagccggaaggaguucgaccucuacaagaaguccggcaucacggagguggaccgcaccgaggcgaaggaggggcugaagcggggcgagaucacccaccacgccgugagccgcggcuccgccaagcugcagugguucgucgagcggaacauggugaucccggaggggcgcgugaucgaccucggcugcgggcggggcggguggagcuacuacugcgccggccugaagaaggucaccgaggugcgcggcuacacgaagggcgggcccgggcacgaggagcccgugcccauguccaccuacggcuggaacaucgucaagcugaugagcgggaaggacguguucuaccucccgcccgagaagugcgacacccugcugugcgacaucggcgaguccagccccucccccaccguggaggagagccggacgauccgcguccugaagaugguggagccguggcucaagaacaaccaguucugcaucaaggugcugaaccccuacaugcccaccgucaucgagcaccuggagcgccuccagcggaagcacggcgggaugcuggugcgcaacccccugucccggaacagcacccacgagauguacuggaucuccaacggcaccgggaacaucguggccagcgucaacauggugucccgccuccugcugaaccgguucacgaugaccuaccgccggccgaccaucgagaaggacguggaccucggcgcgggcacccgccacgucaacgccgagcccgagacgcccaacauggacgugaucggggagcggaucgagcgcaucaaggaggagcacaacagcaccuggcacuacgacgacgagaacccguacaagaccugggccuaccacggcuccuacgaggugaaggccaccgggagcgccuccagcaugaucaacggcgucgugaagcugcugacgaagcccugggacgucgugcccauggugacccagauggcgaugaccgacaccacgcccuucgggcagcagcgggucuucaaggagaagguggacacccgcaucccgcggagcaugcccggcacccgccgggugaugggcaucaccgccgaguggcucuggcgcacgcuggggcggaacaagaagccccgccugugcacccgggaggaguucaccaagaagguccgcaccaacgccgccaugggcgcgguguucacggaggagaaccagugggacuccgccaaggccgccguggaggacgaggacuucuggaagcucgucgaccgcgagcgggagcugcacaagcuggggaagugcggcagcugcguguacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgccgacgacaccgcggggugggacacccggaucaccgaggacgaccugcacaacgaggagaagaucacgcagcagauggacccggagcaccgccagcucgccaacgccaucuucaagcugaccuaccagaacaaggucgugaaggugcagcggcccacccccaccggcaccgucauggacaucaucagccgcaaggaccagcggggcuccggccaggugggcacguacgggcugaacaccuucaccaacauggaggcccagcucauccgccagauggagggcgagggggugcugagcaaggccgaccuggagaacccccaccucccggagaagaagaucacccaguggcuggagacgaagggcgucgagcggcugcgccggauggcgaucuccggcgacgacugcguggugaagcccaucgacgaccgcuucgccaacgcccuccuggcccugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcccggaucagccagggggcgggcuggucccuccgcgagaccgccugccugggcaaggccuacgcccagauguggagccugauguacuuccaccgccgggaccuccgccuggcguccaacgccaucugcagcgccgugcccgugcacugggucccgaccucccggaccacguggagcauccacgcccaccaccaguggaugaccaccgaggacaugcugaccguguggaaccgcguguggaucgaggacaaccccuggauggaggacaagacgcccgucaccaccugggagaacgugcccuaccucgggaagcgggaggaccaguggugcggcagccugaucgggcugaccucccgcgccacgugggcgcagaacaucccgaccgccauccagcagguccggagccucaucggcaacgaggaguuccuggacuacaugcccuccaugaagcgcuuccggaaggaggaggagagcgagggggccaucugguga

SEQ ID NO: 10263 - RNA, 9873 nt, Artificial Sequence
  derived and/or modified CDS sequence (opt1) from DENV-3__FJ639805__SS-prME
accagccugugccucaugaugauccugcccgccgcccuggcguuccaccucaccucccgggacggggagccgcggaugaucguggggaagaacgagcgcggcaagagccugcuguucaagaccgccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguuccugaccuucguccuccugcuguccggccagaucaccuggcgcgacauggcccacacccucaucaugaucggcagcaacgccuccgaccggauggggaugggcgugacguaccuggcccugaucgccaccuucaagauccagcccuuccucgcgcugggguucuuccugcgcaagcucaccagccgggagaaccugcugcucggcgugggccuggccauggccaccacgcugcagcuccccgaggacaucgagcagauggccaacgggaucgcgcugggccugauggcccucaagcugaucacccaguucgagaccuaccagcuguggaccgcccucaucagccugacgugcuccaacaccaucuucacccugaccgucgccuggcgcacggccacccucauccuggcgggggugagccugcucccggucugccaguccagcuccaugcggaagaccgacuggcugcccaugaccguggccgccaugggcgugccgccccugccccuguucaucuucaaccugaaggacacgcugcgccgccggagcuggccccucaacgagggggucauggccgugggccugguguccauccuggccagcucccuccugcgcaacgacguccccauggcgggcccccugguggccgggggccuccugaucgccugcuacgugaucaccgggaccagcgccgaccugaccgucgagaaggccgcggacgugacgugggaggaggaggccgagcagaccggcgugucccacaaccucaugaucaccgucgacgacgacgggaccaugcggaucaaggacgacgagaccgagaacauccugacggugcugcucaagaccgcccugcugaucgugagcggcaucuucccguacuccauccccgccacccuccuggucuggcacaccuggcagaagcagacgcagcgcagcggcgugcugugggacgugcccagcccgcccgagacccagaaggccgagcucgaggagggggucuaccggaucaagcagcagggcaucuucgggaagacccaggugggcguggggguccagaaggagggcguguuccacaccauguggcacgugacgcgcggcgcgguccugaccuacaacgggaagcggcuggagcccaacugggccagcgugaagaaggaccucaucuccuacggcgggggcuggcgccugagcgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccuccggcagccccaucaucaaccgggagggcaagguggucgggcuguacggcaacgggguggugacgaagaacggcggguacgucagcggcaucgcccagaccaacgccgagccggacggccccacccccgagcucgaggaggagauguucaagaagcgcaaccugaccaucauggaccugcaccccggguccggcaagacgcggaaguaccucccggccaucgugcgcgaggcgaucaagcggcgccugcggacccugauccucgcccccacccgcguggucgccgccgagauggaggaggcccugaaggggcugcccauccgguaccagaccacggcgaccaagagcgagcacaccggccgcgagaucguggaccucaugugccacgccaccuucacgaugcggcugcugucccccgugcgcgucccgaacuacaaccucaucaucauggacgaggcccacuucaccgaccccgccagcaucgccgcgcggggguacaucuccacccgcgugggcaugggcgaggccgccgccaucuucaugaccgcgacgccgcccgggaccgccgacgccuucccgcagagcaacgcccccauccaggacgaggagcgcgacauccccgagcgguccuggaacagcggcaacgaguggaucaccgacuucgccgggaagaccgugugguucguccccuccaucaaggcgggcaacgacaucgccaacugccugcgcaagaacgggaagaaggugauccagcugagccggaagacguucgacaccgaguaccagaagaccaagcucaacgacugggacuucguggucaccacggacaucuccgagaugggcgccaacuucaaggccgaccgcgugaucgacccgcggcgcugccugaagcccgugauccugaccgacggccccgagcgggucauccucgccgggcccaugccggugaccgcggccagcgccgcccagcgccggggccgcguggggcggaacccccagaaggagaacgaccaguacaucuucaccggccagccccugaacaacgacgaggaccacgcccacuggaccgaggcgaagaugcugcucgacaacaucaacacgcccgaggggaucaucccggcccuguucgagcccgagcgcgagaaguccgccgccaucgacggcgaguaccggcugaagggcgagagccgcaagaccuucgucgagcucaugcggcgcggggaccugcccguguggcuggcgcacaaggucgccuccgagggcaucaaguacaccgaccggaaguggugcuucgacgggcagcgcaacaaccagauccucgaggagaacauggacguggagaucuggaccaaggagggcgagaagaagaagcugcggccccgcuggcuggacgcccgcacguacagcgacccgcucgcccugaaggaguucaaggacuucgccgcgggccggaaguccaucgcccuggaccucgugaccgagaucgggcgcguccccacccaccuggcccaccggacccgcaacgcccuggacaaccucgugaugcugcacacgagcgagcacggcgggaaggccuaccggcacgcgguggaggagcugcccgagaccauggagacccuccugcugcucggccugaugauccugcucaccgggggcgccaugcuguuccugaucuccggcaaggggcucggcaagacgagcaucgggcugaucugcgucaucgccagcuccggcaugcuguggauggccgagaucccgcuccaguggaucgccagcgcgaucgugcuggaguucuucaugauggugcugcucauccccgagcccgagaagcagcgcacgccccaggacaaccagcuggccuacgucgugaucgggauccugacccucgccgccaucaucgccgcgaacgagaugggccugcuggagaccacgaagcgggaccucggcauguccaaggagccggggguggucagccccaccuccuaccuggacguggaccugcaccccgccagcgccuggacccucuacgccguggcgaccacggucaucacccccaugcugcgccacaccaucgagaacuccaccgccaacgugagccuggccgccaucgccaaccaggcggugguccucaugggccuggacaagggguggccgaucuccaagauggaccugggcgugccccuccuggcccuggggugcuacagccaggugaacccccucacgcugaccgccgccguccugcuccugaucacccacuacgccaucaucggccccggccugcaggcgaaggccacccgggaggcccagaagcgcacggccgccgggaucaugaagaacccgaccguggacggcaucaugaccaucgaccucgaccccgugaucuacgacuccaaguucgagaagcagcuggggcaggucaugcugcucgugcugugcgcggugcagcugcuccugaugcggaccagcugggcccugugcgaggcccucacgcuggccaccggccccaucaccacccugugggagggcucccccgggaaguucuggaacacgaccaucgcggucagcauggccaacaucuuccgcggcuccuaccucgccggggccggccuggccuucagcaucaugaaguccguggggaccggcaagcggggcaccgggagccagggcgagacccugggggagaaguggaagaagaagcucaaccagcugucccgcaaggaguucgaccuguacaagaaguccggcaucacggagguggaccggaccgaggcgaaggaggggcucaagcgcggcgagaucacccaccacgccgucagccggggcuccgccaagcugcagugguucguggagcgcaacauggugaucccggaggggcgggucaucgaccugggcugcgggcgcggcggguggagcuacuacugcgccggccucaagaaggugaccgaggugcggggcuacacgaagggcgggcccgggcacgaggagcccguccccauguccaccuacggcuggaacaucgugaagcugaugagcgggaaggacguguucuaccugccgcccgagaagugcgacacccugcucugcgacaucggcgaguccagccccucccccaccgucgaggagagccgcacgauccgcgugcugaagaugguggagccguggcugaagaacaaccaguucugcaucaagguccucaaccccuacaugcccaccgugaucgagcaccuggagcggcugcagcgcaagcacggcgggaugcucgugcggaacccccugucccgcaacagcacccacgagauguacuggaucuccaacggcaccgggaacaucgucgccagcgugaacauggugucccggcugcuccugaaccgcuucacgaugacccaccggcgcccgaccaucgagaaggacgucgaccugggcgcgggcacccggcacgugaacgccgagcccgagacgcccaacauggacgugaucggggagcgcaucaagcggaucaaggaggagcacaacagcaccuggcacuacgacgacgagaacccguacaagaccugggccuaccacggcuccuacgaggucaaggccaccgggagcgccuccagcaugaucaacggcguggucaagcuccugacgaagcccugggacguggugcccauggucauccagauggcgaugaccgacaccacccccuucgggcagcagcgcguguucaaggagaagguggacacgcggaccccgcgcuccaugcccggcacccggcgcgucaugggcaucaccgccgaguggcuguggcggacgcucgggcgcaacaagaagccccggcugugcacccgcgaggaguucaccaagaaggugcgcaccaacgccgccaugggcgcgguguucacggaggagaaccagugggacagcgccaaggccgccgucgaggacgaggacuucuggaagcugguggaccgggagcgcgagcuccacaagcuggggaagugcggcagcugcguguacaacaugauggggaagcgggagaagaagcugggcgaguucggcaaggccaaggggucccgcgcgaucugguacauguggcucggcgcccgguaccuggaguucgaggcccugggguuccucaacgaggaccacugguucagccgcgagaacuccuacagcggcgucgagggggagggccugcacaagcugggcuacauccuccgggacaucuccaagauccccgggggcgccauguacgccgacgacaccgcggggugggacacccgcaucaccgaggacgaccugcacaacgaggagaagaucacgcagcagauggacccggagcaccggcagcuggccaacgccaucuucaagcucaccuaccagaacaagguggugaagguccagcgccccacccccaccggcaccgugauggacaucaucagccggaaggaccagcgcggcuccggccaggugggcacguacgggcugaacaccuucaccaacauggaggcccagcugauccggcagauggagggcgaggggguccucagcaaggccgaccuggagaacccccaccucccggagaagaagaucacccaguggcucgagacgaagggcguggagcgccugaagcggauggcgaucuccggcgacgacugcguggucaagcccaucgacgaccgcuucgccaacgcccugcucgcccugaacgacauggggaaggugcggaaggacaucccccaguggcagcccagcaagggcuggcacgacuggcagcaggucccguucugcucccaccacuuccacgagcugaucaugaaggacgggcgcaagcucgucgugcccugccggccccaggacgagcugaucggccgcgcccggaucagccagggggcgggcuggucccugcgcgagaccgccugccucggcaaggccuacgcccagauguggagccugauguacuuccaccgccgggaccugcgccucgcguccaacgccaucugcagcgccgugcccguccacugggugccgaccucccggaccacguggagcauccacgcccaccaccaguggaugaccaccgaggacaugcugaccguguggaaccgcgucuggaucgaggacaaccccuggauggaggacaagacgcccgugaccaccugggagaacgugcccuaccuggggaagcgggaggaccaguggugcggcucccucaucgggcugaccagccgcgccacgugggcgcagaacaucccgaccgccauccagcagguccggagccugaucggcaacgaggaguuccucgacuacaugcccuccaugaagcgcuuccggaaggaggaggagagcgagggggccaucugguga

SEQ ID NO: 10264 - RNA, 9873 nt, Artificial Sequence
  derived and/or modified CDS sequence (opt1) from DENV-3__FJ639807__SS-prME
accagccucugccucaugaugauccugcccgccgcccuggcguuccaccucaccagccgggacggcgagccccggaugaucguggggaagaacgagcggggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcggagcgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaccaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagacgugcaccuggccgaagucccacacccucuggagcaacggcgugcuggaguccgacaugaucauccccaagagccuggccgggcccaucucccagcacaacuaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcggggagguggacaacuucaccaugggcguccugugccucgccauccuguucgaggaggugaugcgggggaaguucggcaagaagcacaugaucgcggggguguucuucaccuucguccugcuccuguccggccagaucaccuggcgcgacauggcccacacgcugaucaugaucggcagcaacgccuccgaccggauggggaugggcgugaccuaccucgcccugaucgccaccuucaagauccagcccuuccuggcgcucggguucuuccugcgcaagcugaccagccgggagaaccuccugcugggcgugggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccaucuucacccugacggucgccuggcgcaccgccacccugauccucgcgggggugagccugcugccggucugccaguccagcuccaugcggaagaccgacuggcuccccaugacgguggccgccaugggcgugccgccccucccgcuguucaucuucagccucaaggacacccugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugacggucgagaaggccgcggacgugaccugggaggaggaggccgagcagaccggcgugagccacaaccugaugaucaccgucgacgacgacgggaccaugcgcaucaaggacgacgagacggagaacauccucaccgugcugcugaagaccgcccuccugaucguguccggcaucuucccguacagcauccccgccacccugcucgucuggcacacguggcagaagcagacccagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacacgauguggcacgugacccggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcacguuccagaccaccaccggggagaucggcgcgaucgcccuggacuucaagcccgggacgagcggcagccccaucaucaaccgcgagggcaagguggucgggcuguacggcaacgggguggugaccaagaacggcggguacgucuccggcaucgcccagaccaacgccgagccggacggccccacccccgagcuggaggaggagauguucaagaagcggaaccucacgaucauggaccugcaccccgggagcggcaagacccgcaaguaccugccggccaucgugcgggaggcgaucaagcgccggcuccgcacccugauccuggcccccacccggguggucgccgccgagauggaggaggcccucaaggggcugcccauccgcuaccagacgaccgcgaccaaguccgagcacaccggccgggagaucguggaccugaugugccacgccacguucaccaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugacggcgacgccgcccgggaccgccgacgccuucccgcaguccaacgcccccauccaggacgaggagcgcgacauccccgagcgcagcuggaacuccggcaacgaguggaucaccgacuucgccgggaagacggugugguucguccccagcaucaaggcgggcaacgacaucgccaacugccuccggaagaacgggaagaaggugauccagcugucccgcaagaccuucgacaccgaguaccagaagaccaagcugaacgacugggacuucguggucacgaccgacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggacggaggcgaagaugcugcuggacaacaucaacacccccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggacgaaggagggcgagaagaagaagcuccgcccccgguggcuggacgcccgcaccuacuccgacccgcuggcccucaaggaguucaaggacuucgccgcgggccgcaagagcaucgcccuggaccuggugaccgagaucgggcggguccccacccaccucgcccaccgcacgcggaacgcccuggacaaccuggugaugcuccacaccuccgagcacggcgggaaggccuaccgccacgcgguggaggagcugcccgagaccauggagacccugcuccugcugggccucaugauccugcugaccggcggggccaugcuguuccugaucagcgggaaggggaucggcaagaccagcaucgggcugaucugcgucaucgccuccagcggcaugcucuggauggccgagaucccgcugcaguggaucgccuccgcgaucgugcuggaguucuucaugauggugcuccugauccccgagcccgagaagcagcggacgccccaggacaaccagcuggccuacgucgugaucgggauccucacccuggccgccacgaucgccgcgaacgagaugggccugcucgagaccaccaagcgcgaccugggcaugagcaaggagccggggguggucucccccaccagcuaccuggacguggaccuccaccccgccuccgccuggacgcuguacgccguggcgaccaccgucaucacccccaugcugcggcacacgaucgagaacagcaccgccaacgugucccucgccgccaucgccaaccaggcggugguccugaugggccuggacaagggguggccgaucagcaagauggaccucggcgugccccugcuggcccucgggugcuacucccaggugaacccccugacccugaccgccgccguccuccugcugaucacgcacuacgccaucaucggccccggccuccaggcgaaggccacccgcgaggcccagaagcggaccgccgccgggaucaugaagaacccgaccguggacggcaucaugacgaucgaccuggaccccgugaucuacgacagcaaguucgagaagcagcuggggcaggucaugcuccuggugcugugcgcggugcagcuccugcugaugcgcaccuccugggcccucugcgaggcccugacccuggccaccggccccaucacgacccucugggagggcagccccgggaaguucuggaacaccaccaucgcggucuccauggccaacaucuuccggggcagcuaccuggccggggccggccuggccuucuccaucaugaaguccguggggaccggcaagcgcggcacggggucccagggcgagacccucggggagaaguggaagaagcggcugaaccagcugagccgcaaggaguucgaccucuacaagaaguccggcaucaccgagguggaccggaccgaggcgaaggaggggcugaagcgcggcgagaucacgcaccacgccgucucccggggcagcgccaagcugcagugguucguggagcgcaacauggugaucccggaggggcgggucaucgaccucggcugcgggcgcggcgggugguccuacuacugcgccggccugaagaaggugaccgaggugcggggcuacaccaagggcgggcccgggcacgaggagcccguccccaugagcaccuacggcuggaacaucgugaagcugauguccgggaaggacguguucuaccucccgcccgagaagugcgacacgcugcugugcgacaucggcgagagcucccccagccccaccgucgaggagucccgcaccauccgcgugcugaagaugguggagccguggcucaagaacaaccaguucugcaucaagguccugaaccccuacaugcccaccgugaucgagcaccuggagcggcuccagcgcaagcacggcgggaugcuggugcggaacccccugagccgcaacuccacgcacgagauguacuggaucagcaacggcaccgggaacaucgucgccuccgugaacauggugagccggcuccugcugaaccgcuucaccaugacccaccggcgcccgacgaucgagaaggacgucgaccucggcgcgggcacccggcacgugaacgccgagcccgagacccccaacauggacgugaucggggagcgcaucaagcggaucaaggaggagcacaacuccaccuggcacuacgacgacgagaacccguacaagacgugggccuaccacggcagcuacgaggucaaggccaccggguccgccagcuccaugaucaacggcguggucaagcugcugaccaagcccugggacguggugcccauggucacccagauggcgaugacggacaccacccccuucgggcagcagcgcguguucaaggagaagguggacacccggacgccgcgcagcaugcccggcacccggcgcgucaugggcaucaccgccgaguggcucuggcggacccuggggcgcaacaagaagccccggcugugcacgcgcgaggaguucaccaagaaggugcgcaccaacgccgccaugggcgcgguguucaccgaggagaaccagugggacagcgccaaggccgccgucgaggacgaggacuucuggaagcucguggaccgggagcgcgagcugcacaagcuggggaagugcggcuccugcguguacaacaugauggggaagcgggagaagaagcucggcgaguucggcaaggccaaggggagccgcgcgaucugguacauguggcugggcgcccgguaccuggaguucgaggcccucggguuccugaacgaggaccacugguucucccgcgagaacagcuacuccggcgucgagggggagggccugcacaagcucggcuacauccugcgggacaucagcaagauccccgggggcgccauguacgccgacgacacggcggggugggacacccgcaucaccgaggacgaccugcacaacgaggagaagaucacccagcagauggacccggagcaccggcagcucgccaacgccaucuucaagcugaccuaccagaacaagguggugaagguccagcgccccacgcccaccggcaccgugauggacaucaucucccggaaggaccagcgcggcagcggccaggugggcaccuacgggcugaacacguucaccaacauggaggcccagcucauccggcagauggagggcgaggggguccuguccaaggccgaccuggagaacccccaccucccggagaagaagaucacccaguggcuggagaccaagggcguggagcgccugaagcggauggcgaucagcggcgacgacugcguggucaagcccaucgacgaccgcuucgccaacgcccuccuggcccugaacgacauggggaaggugcggaaggacaucccccaguggcagcccuccaagggcuggcacgacuggcagcaggucccguucugcagccaccacuuccacgagcucaucaugaaggacgggcgcaagcuggucgugcccugccggccccaggacgagcugaucggccgcgcccggaucucccagggggcgggcuggagccuccgcgagacggccugccugggcaaggccuacgcccagauguggucccugauguacuuccaccgccgggaccuccgccuggcgagcaacgccaucugcuccgccgugcccguccacugggugccgaccagccggaccaccugguccauccacgcccaccaccaguggaugacgaccgaggacaugcugaccguguggaaccgcgucuggaucgaggacaaccccuggauggaggacaagacccccgugacgaccugggagaacgugcccuaccucgggaagcgggaggaccaguggugcggcagccugaucgggcugaccagccgcgccaccugggcgcagaacaucccgacggccauccagcagguccggucccucaucggcaacgaggaguuccuggacuacaugcccagcaugaagcgcuuccggaaggaggaggaguccgagggggccaucugguga

SEQ ID NO: 10265 - RNA, 9873 nt, Artificial Sequence
  derived and/or modified CDS sequence (opt1) from DENV-3__FJ639810__SS-prME
accagccugugccucaugaugauccugcccgcggcccuggcguuccaccucaccagccgggacggcgagccgcggaugaucguggggaagaacgagcggggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcggagcgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacacggggugcgugaucaacuggaagggcaaggagcugaagugcggcagcgggaucuucgugaccaacgagguccacaccuggaccgagcaguacaaguuccaggcggacucccccaagcgccucgccacggccaucgccggcgccugggagaacggggugugcggcauccgcagcaccacccggauggagaaccugcuguggaagcagaucgcgaacgagcucaacuacauccugugggagaacaacaucaagcugaccguggucgugggggacaucaucggcgugcucgagcagggcaagcgcacgcugacgccccagccgauggagcugaaguacuccuggaagaccugggggaaggcccggaucgucaccgccgagacgcagaacagcuccuucaucaucgacggccccaacacccccgagugccccaacaccagccgcgccuggaacgugugggagguggaggacuacggguucggcgucuucaccaccaacaucuggcucaagcugcgggagguguacacgcagcugugcgaccaccgccucauguccgcggccgugaaggacgagcgggccguccacgccgacaugggcuacuggaucgagagccagaagaacgggagcuggaagcuggagaaggccucccugaucgaggugaagaccugcaccuggcccaagagccacacccucugguccaacggcgugcuggagagcgacaugaucauccccaagucccuggcggggcccaucagccagcacaacuaccgcccgggcuaccacacgcagaccgccgggcccuggcaccucggcaagcuggagcuggacuucaacuacugcgagggcaccaccgucgugaucacggagaacugcgggacccggggccccucccuccgcaccaccacggugagcgggaagcugauccacgaguggugcugccgguccugcacccugcccccgcuccgcuacaugggcgaggacgggugcugguacggcauggagauccggcccaucagcgagaaggaggagaacauggucaagucccuggugagcgccggcuccggggagguggacaacuucaccaugggcguccugugccucgccauccuguucgaggaggugaugcgcgggaaguucggcaagaagcacaugaucgccggggugcuguucaccuucguccuccugcugagcggccagaucacguggcgggacauggcgcacacccucaucaugaucggcuccaacgccagcgaccgcauggggaugggcgugaccuaccuggcccugaucgccaccuucaagauccagcccuuccucgcccugggguucuuccugcggaagcucacgucccgcgagaaccugcugcucggcgugggccuggcgauggccaccacccugcagcuccccgaggacaucgagcagauggccaacgggaucgcccugggccugauggcgcucaagcugaucacccaguucgagacguaccagcuguggaccgcccucaucagccugaccugcagcaacaccaucuucacgcugaccgucgccuggcggaccgccacccucauccuggccggggugucccugcucccggucugccagagcuccagcaugcgcaagacggacuggcugcccaugaccguggcggccaugggcgugccgccccugccccuguucaucuucugccugaaggacacccugaagcgccgguccuggccccucaacgagggggucauggccgugggccuggugagcauccuggccuccagccuccugcgcaacgacguccccauggccggcccccugguggccggcgggcuccugaucgccugcuacgugaucaccgggacguccgccgaccugaccgucgagaaggccgccgacgugaccugggaggaggaggcggagcagaccggggugagccacaaccucaugaucaccgucgacgacgacgggacgaugcggaucaaggacgacgagaccgagaacauccugaccgugcugcucaagaccgcccugcugaucguguccggcaucuucccguacagcauccccgccacgcuccuggucuggcacaccuggcagaagcagacccagcgcuccggcgugcugugggacgugcccuccccgcccgagacccagaaggccgagcucgaggagggggucuaccggaucaagcagcagggcaucuucgggaagacccaggugggcguggggguccagaaggagggcguguuccacaccauguggcacgugacccgcggcgccguccugaccuacaacgggaagcggcuggagcccaacugggcguccgugaagaaggaccucaucagcuacggcgggggcuggcgccuguccgcccaguggcagaagggggaggaggugcaggucaucgccguggagcccggcaagaaccccaagaacuuccagacgaugccgggcaccuuccagaccaccacgggggagaucggcgccaucgcgcuggacuucaagcccgggaccagcggcucccccaucaucaaccgggagggcaagguggucgggcuguacggcaacgggguggugaccaagaacggcggguacgucagcggcaucgcccagaccaacgccgagccggacggccccacgcccgagcucgaggaggagauguucaagaagcgcaaccugaccaucauggaccugcaccccgggagcggcaagacccggaaguaccucccggccaucgugcgcgaggccaucaagcggcgccugcggacccugauccucgcgcccacgcgcguggucgccgccgagauggaggaggcccugaaggggcugcccauccgguaccagaccaccgccaccaaguccgagcacacgggccgcgagaucguggaccucaugugccacgcgaccuucaccaugcggcugcugagccccgugcgcgucccgaacuacaaccucaucaucauggacgaggcccacuucaccgaccccgccuccaucgccgcccggggguacaucagcacgcgcgugggcaugggcgaggcggccgccaucuucaugaccgccacgccgcccgggaccgcggacgccuucccgcaguccaacgcccccauccaggacgaggagcgcgacauccccgagcggagcuggaacuccggcaacgaguggaucacggacuucgccgggaagaccgugugguucguccccagcaucaaggccggcaacgacaucgcgaacugccugcgcaagaacgggaagaaggugauccagcugucccggaagaccuucgacaccgaguaccagaagacgaagcucaacgacugggacuucguggucaccaccgacaucagcgagaugggcgccaacuucaaggccgaccgcgugaucgacccgcggcgcugccugaagcccgugauccugaccgacggccccgagcgggucauccucgccgggcccaugccggugaccgccgcguccgccgcccagcgccggggccgcguggggcggaacccccagaaggagaacgaccaguacaucuucacgggccagccccugaacaacgacgaggaccacgcccacuggaccgaggccaagaugcugcucgacaacaucaacacccccgaggggaucaugccggcgcuguucgagcccgagcgcgagaaguccgccgccaucgacggcgaguaccggcugaagggcgagucccgcaagaccuucgucgagcucaugcggcgcggggaccugcccguguggcuggcccacaaggucgcgagcgagggcaucaaguacacggaccggaaguggugcuucgacgggcagcgcaacaaccagauccucgaggagaacauggacguggagaucuggaccaaggagggcgagaagaagaagcugcggccccgcuggcuggacgcccgcaccuacuccgacccgcucgcccugaaggaguucaaggacuucgccgccggccgcaagagcaucgcgcuggaccucgugaccgagaucgggcgcguccccacgcaccuggcccaccggacccgcaacgcccuggacaaccucgugaugcugcacaccuccgagcacggcgggaaggccuaccggcacgccguggaggagcugcccgagaccauggagacgcuccugcugcucggccugaugauccugcucaccgggggcgcgaugcuguuccugaucagcggcaaggggaucggcaagaccuccaucgggcucaucugcgucaucgccagcagcggcaugcuguggauggccgagaucccgcugcaguggaucgccuccgccaucgugcucgaguucuucaugauggugcugcugauccccgagcccgagaagcagcgcacgccccaggacaaccagcucgcguacgucgugaucgggauccugacgcuggccgccaucaucgccgccaacgagaugggccuccuggagaccaccaagcgggaccugggcaugagcaaggagccggggguggucucccccaccagcuaccucgacguggaccugcaccccgcguccgccuggacgcuguacgccguggccaccaccgucaucacccccaugcuccgccacacgaucgagaacagcaccgcgaacgugucccuggccgccaucgccaaccaggccgugguccugaugggccucgacaagggguggccgaucagcaagauggaccugggcgugccccugcucgcgcuggggugcuacucccaggugaacccccugacccucaccgccgccguccugcugcucaucacgcacuacgccaucaucggccccggccugcaggccaaggcgacccgggaggcccagaagcgcaccgccgccgggaucaugaagaacccgaccguggacggcaucaugacgaucgaccuggaccccgugaucuacgacagcaaguucgagaagcagcucgggcaggucaugcugcuggugcucugcgccgugcagcugcugcucaugcggaccuccugggcgcugugcgaggcccugacccucgccaccggccccaucacgacccugugggagggcagccccgggaaguucuggaacaccaccaucgccgucuccauggcgaacaucuuccgcggcagcuaccuggccggggccggccucgccuucuccaucaugaaguccguggggaccggcaagcggggcacggggucccagggcgagacccugggggagaaguggaagaagaagcugaaccagcucagccgcaaggaguucgaccuguacaagaaguccggcaucaccgagguggaccggaccgaggccaaggaggggcugaagcgcggcgagaucacgcaccacgcggucagccggggcagcgccaagcuccagugguucguggagcgcaacauggugaucccggaggggcgggucaucgaccugggcugcgggcgcggcgggugguccuacuacugcgccggccugaagaaggugaccgaggugcggggcuacaccaagggcgggcccgggcacgaggagcccguccccaugagcaccuacggcuggaacaucgugaagcucauguccgggaaggacguguucuaccugccgcccgagaagugcgacacgcugcugugcgacaucggcgagagcucccccagccccaccgucgaggagucccgcaccauccgcgugcucaagaugguggagccguggcugaagaacaaccaguucugcaucaagguccugaaccccuacaugcccgccgugaucgagcaccucgagcggcugcagcgcaagcacggcgggaugcuggugcggaacccccucagccgcaacuccacccacgagauguacuggaucagcaacggcacggggaacaucgucgccuccgugaacauggugagccggcugcugcucaaccgcuucaccaugacccaccggcgcccgaccaucgagaaggacgucgaccugggcgcgggcacgcggcacgugaacgccgagcccgagacccccaacauggacgugaucggggagcgcaucaagcggaucaaggaggagcacaacuccaccuggcacuacgacgacgagaacccguacaagaccugggccuaccacggcagcuacgaggucaaggccacgggguccgccagcuccaugaucaacggcguggucaagcugcucaccaagcccugggacguggugcccauggucacccagauggcgaugaccgacacgacccccuucgggcagcagcgcguguucaaggagaagguggacacccggaccccgcgcagcaugcccggcacgcggcgcgucaugggcaucaccgccgaguggcuguggcggacccuggggcgcaacaagaagccccggcucugcacccgcgaggaguucacgaagaaggugcgcaccaacgccgccaugggcgcgguguucaccgaggagaaccagugggacuccgccaaggccgccgucgaggacgaggacuucuggaagcugguggaccgggagcgcgagcugcacaagcucgggaagugcggcagcugcguguacaacaugauggggaagcgggagaagaagcugggcgaguucggcaaggccaaggggagccgcgcgaucugguacauguggcugggcgcccgguaccucgaguucgaggcccugggguuccugaacgaggaccacugguucucccgcgagaacagcuacuccggcgucgagggggagggccuccacaagcugggcuacauccugcgggacaucagcaagauccccgggggcgccauguacgccgacgacaccgcggggugggacacgcgcaucaccgaggacgaccucuacaacgaggagaagaucacccagcagauggacccggagcaccggcagcuggccaacgccaucuucaagcugaccuaccagaacaagguggugaagguccagcgccccacccccacgggcaccgugauggacaucaucucccggaaggaccagcgcggcagcggccaggugggcaccuacgggcucaacaccuucacgaacauggaggcccagcugauccggcagauggagggcgaggggguccuguccaaggccgaccucgagaacccccaccucccggagaagaagaucacccaguggcuggagaccaagggcguggagcgccucaagcggauggcgaucagcggcgacgacugcguggucaagcccaucgacgaccgcuucgccaacgcccugcuggcccucaacgacauggggaaggugcggaaggacaucccccaguggcagcccuccaagggcuggcacgacuggcagcaggucccguucugcagccaccacuuccacgagcugaucaugaaggacgggcgcaagcuggucgugcccugccggccccaggacgagcucaucggccgcgcccggaucucccagggggcgggcuggagccugcgcgagaccgccugccugggcaaggccuacgcccagauguggucccucauguacuuccaccgccgggaccugcgccuggcgagcaacgccaucugcuccgccgugcccguccacugggugccgacgagccggaccaccugguccauccacgcccaccaccaguggaugaccacggaggacaugcucaccguguggaaccgcgucuggaucgaggacaaccccuggauggaggacaagacccccgugaccacgugggagaacgugcccuaccuggggaagcgggaggaccaguggugcggcagccugaucgggcucaccucccgcgccaccugggcgcagaacaucccgaccgccauccagcagguccggagccugaucggcaacgaggaguuccuggacuacaugcccagcaugaagcgcuuccggaaggaggaggaguccgagggggccaucugguga

SEQ ID NO: 10266 - RNA, 9873 nt, Artificial Sequence
  derived and/or modified CDS sequence (opt1) from DENV-3__FJ639816__SS-prME
accagccucugccucaugaugauccugcccgccacccuggccuuccaccucaccagccgggacggcgagccccggaugaucguggggaagaacgagcggggcaagagccugcuguucaagaccgcgagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgggacaagcggagcguggcccucgcgccccacgugggcauggggcuggacacccgcacccagaccuggaugagcgcggagggcgccuggcgccagguggagaaggucgagaccugggcccugcgccacccgggguucaccauccucgcccuguuccuggcgcacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacaucaccacggacagccgcugccccacccagggcgaggcggugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacacggugaucaucaccguccacaccggggaccagcaccaggugggcaacgagacccagggggucacggccgagaucacgccccaggccagcaccaccgaggccauccugcccgaguacggcacccuggggcucgagugcuccccgcgcacgggccuggacuucaacgagaugauccugcucaccaugaagaacaaggcguggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgccaugcacacggcgcucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgucccgugcaagauccccuucagcacggaggacgagcaggggaaggcccacaacggccgccugaucaccgcgaaccccguggugaccaagaaggaggagcccgucaacaucgaggccgagccgcccuucggcgagagcaacaucgugaucgggaucggcgacaacgcccugaagaucaacugguacaagaagggguccagcaucggcaagauguucgaggccaccgcgcgcggggcccgccggauggccauccugggcgacacggccugggacuucggcuccgucgggggcguccucaacagccuggggaagauggugcaccagaucuucggcuccgccuacaccgcgcuguucagcgggguguccugggucaugaagaucggcaucggcgugcuccugaccuggaucgggcugaacagcaagaacaccuccaugagcuucuccugcaucgccaucggcaucaucacgcucuaccugggggccgugguccaggccgacaugggcugcgugaucaacuggaaggggaaggagcugaagugcggcagcggcaucuucgugaccaacgagguccacaccuggaccgagcaguacaaguuccaggccgacucccccaagcgccucgcgacggccaucgccggggccugggagaacggcgugugcgggauccgcagcaccacccggauggagaaccugcuguggaagcagaucgccaacgagcucaacuacauccugugggagaacaacaucaagcugaccguggucgugggcgacaucaucggggugcucgagcagggcaagcgcacgcugacgccccagccgauggagcugaaguacuccuggaagaccuggggcaaggcgcggaucgucaccgccgagacgcagaacagcuccuucaucaucgacgggcccaacacccccgagugccccagcgccucccgcgccuggaacgugugggagguggaggacuacggcuucggggucuucaccaccaacaucuggcucaagcugcgggagguguacacccagcugugcgaccaccgccucaugagcgcggccgugaaggacgagcgggccguccacgccgacaugggcuacuggaucgagagccagaagaacggcuccuggaagcuggagaaggccagccugaucgaggugaagacgugcaccuggccgaagucccacacccucuggagcaacggggugcuggaguccgacaugaucauccccaagagccuggcgggccccaucucccagcacaacuaccgcccgggguaccacacccagacggccggccccuggcaccucgggaagcuggagcuggacuucaacuacugcgagggcaccaccgucgugaucaccgagaacugcggcacgcgggggcccagccuccgcaccaccaccguguccggcaagcugauccacgaguggugcugccggagcugcacgcugcccccgcuccgcuacaugggggaggacggcugcugguacgggauggagauccggcccaucuccgagaaggaggagaacauggucaagagccugguguccgccggcagcggcgagguggacaacuucaccauggggguccugugccucgccauccuguucgaggaggugaugcgcggcaaguucgggaagaagcacaugaucgccggcguguucuucaccuucguccugcuccuguccgggcagaucaccuggcgggacauggcgcacacgcugaucaugaucggcagcaacgccuccgaccgcaugggcaugggggugaccuaccucgcccugaucgccaccuucaagauccagcccuuccuggcccucggcuucuuccugcggaagcugaccagccgcgagaaccuccugcugggggugggccucgcgauggccacgacccugcagcugcccgaggacaucgagcagauggccaacggcaucgcccucgggcugauggcgcugaagcucaucacccaguucgagaccuaccagcuguggacggcccugaucagccugaccugcuccaacaccaucuucacccugacggucgccuggcggaccgccacccugauccucgccggcgugagccugcugccggucugccaguccagcuccaugcgcaagaccgacuggcuccccaugacgguggcggccaugggggugccgccccucccgcuguucaucuucagccucaaggacacccugaagcgccgguccuggccccugaacgagggcgucauggccguggggcucgugagcauccuggccuccagccugcuccgcaacgacguccccauggccggcccccugguggcgggcgggcugcucaucgccugcuacgugaucaccggcaccuccgccgaccugacggucgagaaggccgccgacgugaccugggaggaggaggcggagcagaccggggugagccacaaccugaugaucaccgucgacgacgacggcaccaugcggaucaaggacgacgagacggagaacauccucaccgugcugcugaagaccgcccuccugaucguguccgggaucuucccguacagcauccccgccacccugcucgucuggcacacguggcagaagcagacccagcgcuccggcgugcugugggacgugcccagcccgcccgagacccagaaggccgagcuggaggagggcgucuaccggaucaagcagcaggggaucuucggcaagacccaggugggggugggcguccagaaggaggggguguuccacacgauguggcacgugacccgcggcgccguccucaccuacaacggcaagcggcuggagcccaacugggcguccgugaagaaggaccugaucagcuacgggggcggguggcgccucuccgcccaguggcagaagggcgaggaggugcaggucaucgccguggagcccgggaagaaccccaagaacuuccagaccaugcccggcacguuccagaccaccaccggcgagaucggggccaucgcgcuggacuucaagcccggcacgagcgggagccccaucaucaaccgggagggcaagaucgugggccuguacgggaacggcgucgugaccaagaacgggggcuacguguccgggaucgcccagaccaacgccgagccggacggccccacccccgagcuggaggaggagauguucaagaagcgcaaccucacgaucauggaccugcaccccggcagcgggaagacccggaaguaccugccggccaucguccgcgaggccaucaagcggcgccuccggacccugauccuggcgcccacccgcgugguggccgccgagauggaggaggcccucaagggccugcccauccgguaccagacgaccgccaccaaguccgagcacaccgggcgcgagaucgucgaccugaugugccacgcgacguucaccaugcggcuccugagccccgugcgcgugccgaacuacaaccugaucaucauggacgaggcccacuucaccgaccccgccuccaucgccgcccggggcuacaucagcacccgcgucgggaugggcgaggcggccgccaucuucaugacggccacgccgcccggcaccgcggacgccuucccgcaguccaacgcccccauccaggacgaggagcgcgacauccccgagcggagcuggaacuccgggaacgaguggaucaccgacuucgccggcaagacggugugguucgugcccagcaucaaggccgggaacgacaucgcgaacugccuccgcaagaacggcaagaaggucauccagcugucccggaagaccuucgacaccgaguaccagaagaccaagcugaacgacugggacuucguggugacgaccgacaucagcgagaugggggccaacuucaaggccgaccgcgucaucgacccgcggcgcugccucaagcccgugauccugaccgacggccccgagcgggugauccuggccggccccaugccggucaccgccgcguccgccgcccagcgccgggggcgcgugggccggaacccccagaaggagaacgaccaguacaucuucaccgggcagccccucaacaacgacgaggaccacgcccacuggacggaggccaagaugcugcuggacaacaucaacacccccgagggcaucaucccggcccucuucgagcccgagcgcgagaaguccgccgccaucgacggggaguaccggcugaagggcgagucccgcaagaccuucguggagcugaugcggcgcggcgaccuccccgucuggcuggcccacaagguggcgagcgaggggaucaaguacaccgaccggaaguggugcuucgacggccagcgcaacaaccagauccuggaggagaacauggacgucgagaucuggacgaaggagggggagaagaagaagcuccggccccgcuggcuggacgcccgcaccuacuccgacccgcuggcccucaaggaguucaaggacuucgccgccggccgcaagagcaucgcgcuggaccuggugaccgagaucggccgcgugcccacccaccucgcccaccggacgcgcaacgcccuggacaaccuggucaugcuccacaccuccgagcacgggggcaaggccuaccggcacgccguggaggagcugcccgagaccauggagacccugcuccugcuggggcucaugauccugcugacgggcggggcgaugcuguuccugaucagcggcaagggcaucgggaagaccagcaucggccugaucugcgugaucgccuccagcgggaugcucuggauggccgagaucccgcugcaguggaucgccuccgccaucguccuggaguucuucaugauggugcuccugauccccgagcccgagaagcagcgcacgccccaggacaaccagcuggcguacguggucaucggcauccucacccuggccgccacgaucgccgccaacgagauggggcugcucgagaccaccaagcgggaccugggcaugagcaaggagccgggcguggugucccccaccagcuaccuggacgucgaccuccaccccgcguccgccuggacgcuguacgccguggccaccaccgugaucacccccaugcugcgccacacgaucgagaacagcaccgcgaacgucucccucgccgccaucgccaaccaggccguggugcugauggggcuggacaagggcuggccgaucagcaagauggaccucggggucccccugcuggcgcucggcugcuacucccaggugaacccccugacccugaccgccgccgugcuccugcugaucacgcacuacgccaucaucgggcccggccuccaggccaaggcgacccgggaggcccagaagcgcaccgccgccggcaucaugaagaacccgaccgucgacgggaucaugacgaucgaccuggaccccgugaucuacgacagcaaguucgagaagcagcugggccaggugaugcuccugguccugugcgccgugcagcuccugcugaugcggaccuccugggcgcucugcgaggcccugacccuggccaccgggcccaucacgacccucugggagggcagccccggcaaguucuggaacaccaccaucgccguguccauggcgaacaucuuccgcgggagcuaccuggccggcgccgggcuggccuucuccgucaugaaguccgugggcaccgggaagcggggcacgggcucccagggggagacccucggcgagaaguggaagaagaagcugaaccagcugagccgcaaggaguucgaccucuacaagaaguccgggaucaccgagguggaccggaccgaggccaaggagggccugaagcgcggggagaucacgcaccacgcggucucccggggcagcgccaagcugcagugguucguggagcgcaacauggugaucccggagggccgggucaucgaccucgggugcggccgcgggggcugguccuacuacugcgccgggcugaagaaggugaccgaggugcggggcuacaccaagggcgggcccggccacgaggagcccguccccaugagcaccuacggguggaacaucgugaagcugauguccggcaaggacguguucuaccucccgcccgagaagugcgacacgcugcugugcgacaucggggagagcucccccagccccaccgucgaggagucccgcaccauccgcgugcugaagaugguggagccguggcucaagaacaaccaguucugcaucaagguccugaaccccuacaugcccaccgugaucgagcaccuggagcggcuccagcgcaagcacggcggcaugcuggugcggaacccccugagccgcaacuccacgcacgagauguacuggaucagcaacgggaccggcaacaucgucgccuccgugaacauggugagccggcuccugcugaaccgcuucaccaugacccaccggcgcccgacgaucgagaaggacgucgaccucggggccggcacccggcacgugaacgcggagcccgagacccccaacauggacgugaucggcgagcgcaucaagcggaucaaggaggagcacaacuccaccuggcacuacgacgacgagaacccguacaagacgugggccuaccacgggagcuacgaggucaaggccaccggcuccgccagcuccaugaucaacgggguggucaagcugcugaccaagcccugggacguggugcccauggucacccagauggccaugacggacaccacccccuucggccagcagcgcguguucaaggagaagguggacacccggacgccgcgcagcaugcccgggacccggcgcgucaugggcaucaccgcggaguggcucuggcggacccugggccgcaacaagaagccccggcugugcacgcgcgaggaguucaccaagaaggugcgcaccaacgccgccaugggggccguguucaccgaggagaaccagugggacagcgcgaaggccgccgucgaggacgaggacuucuggaagcucguggaccgggagcgcgagcugcacaagcugggcaagugcggguccugcguguacaacaugaugggcaagcgggagaagaagcucggggaguucggcaaggccaagggcagccgcgccaucugguacauguggcugggggcgcgguaccuggaguucgaggcccucggcuuccugaacgaggaccacugguucucccgcgagaacagcuacuccggggucgagggcgaggggcugcacaagcucggcuacauccugcgggacaucagcaagauccccggcggggccauguacgccgacgacacggccggcugggacacccgcaucaccgaggacgaccugcacaacgaggagaagaucacccagcagauggacccggagcaccggcagcucgcgaacgccaucuucaagcugaccuaccagaacaagguggugaagguccagcgccccacgcccaccgggaccgugauggacaucaucucccggaaggaccagcgcggcagcggccagguggggaccuacggccugaacacguucaccaacauggaggcccagcucauccggcagauggagggggagggcguccuguccaaggccgaccuggagaacccccaccucccggagaagaagaucacccaguggcuggagaccaaggggguggagcgccugaagcggauggccaucagcggcgacgacugcguggucaagcccaucgacgaccgcuucgcgaacgcccuccuggcccugaacgacaugggcaaggugcggaaggacaucccccaguggcagcccuccaagggguggcacgacuggcagcaggucccguucugcagccaccacuuccacgagcucaucaugaaggacggccgcaagcuggucgugcccugccggccccaggacgagcugaucgggcgcgcccggaucucccagggcgccggguggagccuccgcgagacggcgugccugggcaaggccuacgcccagauguggucccugauguacuuccaccgccgggaccuccgccuggccagcaacgcgaucugcuccgccgugcccguccacugggugccgaccagccggaccaccugguccauccacgcccaccaccaguggaugacgaccgaggacaugcugaccguguggaaccgcgucuggaucgaggacaaccccuggauggaggacaagacccccgugacgaccugggagaacgugcccuaccucggcaagcgggaggaccaguggugcgggagccugaucggccugaccagccgcgccaccugggcccagaacaucccgacggcgauccagcagguccggucccucaucgggaacgaggaguuccuggacuacaugcccagcaugaagcgcuuccggaaggaggaggaguccgagggcgccaucugguga

SEQ ID NO: 10267 - RNA, 9873 nt, Artificial Sequence
  derived and/or modified CDS sequence (opt1) from DENV-3__FJ639817__SS-prME
accagccugugccucaugaugauccugcccgccgcccuggcguuccaccucaccagccgggacggggagccccggaugaucguggggaagaacgagcgcggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcggagcgucgcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacgugaccaccgacagccgcugccccacgcagggcgaggccguccugccggaggagcaggaccagaacuacgugugcaagcacaccuacguggaccggggguggggcaacgggugcggccucuucgggaagggcucccuggugaccugcgccaaguuccagugccuggagcccaucgagggcaagguggugcaguacgagaaccucaaguacaccgucaucaucacggugcacaccggggaccagcaccaggucggcaacgagacccagggggugaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggucaccuucaagaacgcccacgccaagaagcaggagguggugguccuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucgugcugaagaaggagguguccgagacccagcacgggaccauccucaucaaggucgaguacaagggcgaggacgugccgugcaagauccccuucagcaccgaggacgggcagggcaaggcgcacaacggccgccugaucacggccaaccccguggucaccaagaaggaggagcccgugaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgucggcggggugcucaacagccugggcaagauggugcaccagaucuucggguccgcguacacggcccuguucagcggcgucuccugggugaugaagaucggcaucggggugcuccugaccuggaucggccugaacagccgcaacaccuccaugagcuucuccugcaucgccaucgggaucaucacccucuaccugggcgccgucgugcaggccgacauggggugcgugaucaacuggaagggcaaggagcugaagugcggcagcgggaucuucgucacgaacgaggugcacaccuggaccgagcaguacaaguuccaggcggacucccccaagcgccucgccaccgccaucgccggcgccugggagaacggggugugcggcauccggagcacgacccgcauggagaaccugcuguggaagcagaucgcgaacgagcucaacuacauccugugggagaacaacaucaagcugaccgucguggugggggacaucaucggcguccucgagcagggcaagcggacccugacgccccagccgauggagcugaaguacuccuggaagaccugggggaaggccaagaucgugaccgccgagacccagaacagcuccuucaucaucgacggccccaacacgcccgagugccccagcgccucccgcgcguggaacgugugggaggucgaggacuacggguucggcguguucaccaccaacaucuggcucaagcugcgggagguguacacccagcugugcgaccaccgccucaugagcgccgccgucaaggacgagcgggccgugcacgccgacaugggcuacuggaucgagagccagaagaacggguccuggaagcuggagaaggcgagccugaucgaggugaagaccugcacguggccgaagucccacacccucuggagcaacggcguccuggaguccgacaugaucauccccaagagccuggccgggcccaucucccagcacaacuaccgcccgggcuaccacacccagaccgccgggcccuggcaccucggcaagcuggagcuggacuucaacuacugcgagggcacgaccguggugaucaccgagaacugcgggacccggggccccagccuccgcacgaccaccgucuccgggaagcugauccacgaguggugcugccggagcugcacccugcccccgcuccgcuacaugggcgaggacgggugcugguacggcauggagauccggcccaucuccgagaaggaggagaacauggucaagagccugguguccgccggcagcggggaggucgacaacuucacgaugggcgugcugugccucgccauccuguucgaggaggugaugcgcgggaaguucggcaagaagcacaugaucgcgggggucuucuucaccuucgugcugcuccuguccggccagaucaccuggcgggacauggcccacacccugaucaugaucggcagcaacgccuccgaccgcauggggaugggcgugacguaccucgcccugaucgccaccuucaagauccagcccuuccuggcgcucggguucuuccugcggaagcugaccagccgcgagaaccuccugcugggcgucggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccguggccuggcggacggccacccugauccucgcgggggucagccugcugccggugugccaguccagcuccaugcgcaagaccgacuggcuccccaugaccguggccgccaugggcgugccgccccucccgcuguucaucuucagccucaaggacacgcugaagcgccgguccuggccccugaacgagggggugauggccgugggccucgucagcauccuggccuccagccugcuccgcaacgacgugcccauggcgggcccccugguggccgggggccugcucaucgccugcuacgucaucaccgggaccuccgccgaccugaccguggagaaggccgcggacgugacgugggaggaggaggccgagcagaccggcgucagccacaaccugaugaucaccguggacgacgacgggaccaugcggaucaaggacgacgagaccgagaacauccucacggugcugcugaagaccgcccuccugaucgucuccggcaucuucccguacagcauccccgccacccugcucguguggcacaccuggcagaagcagacgcagcgcuccggcgugcugugggacguccccagcccgcccgagacccagaaggccgagcuggaggaggggguguaccggaucaagcagcagggcaucuucgggaagacccaggugggcgucggggugcagaaggagggcguguuccacaccauguggcacgucacgcgcggcgcggugcucaccuacaacgggaagcggcuggagcccaacugggccuccgugaagaaggaccugaucagcuacggcgggggcuggcgccucuccgcccaguggcagaagggggaggagguccaggugaucgccguggagcccggcaagaaccccaagaacuuccagaccaugcccggcaccuuccagacgaccaccggggagaucggcgcgaucgcccuggacuucaagcccgggaccagcggcagccccaucaucaaccgggagggcaaggucguggggcuguacggcaacgggguggucacgaagaacggcggguacguguccggcaucgcccagaccaacgccgagccggacggccccacccccgagcuggaggaggagauguucaagaagcgcaaccucaccaucauggaccugcaccccgggagcggcaagacgcggaaguaccugccggccaucgugcgcgaggcgaucaagcggcgccuccggacccugauccuggcccccacccgcgucguggccgccgagauggaggaggcccucaaggggcugcccauccgguaccagaccacggcgaccaaguccgagcacaccggccgcgagaucguggaccugaugugccacgccaccuucacgaugcggcuccugagccccguccgcgugccgaacuacaaccugaucaucauggacgaggcccacuucaccgaccccgccuccaucgccgcgcggggguacaucagcacccgcgugggcaugggcgaggccgccgccaucuucaugaccgcgacgccgcccgggaccgccgacgccuucccgcaguccaacgcccccauccaggacgaggagcgcgacauccccgagcggagcuggaacuccggcaacgaguggaucaccgacuucgccgggaagaccgucugguucgugcccagcaucaaggcgggcaacgacaucgccaacugccuccgcaagaacgggaagaaggugauccagcugucccggaagacguucgacaccgaguaccagaagaccaagcugaacgacugggacuucgucgugaccacggacaucagcgagaugggcgccaacuucaaggccgaccgcgugaucgacccgcggcgcugccucaagcccgucauccugaccgacggccccgagcgggugauccuggccgggcccaugccggugaccgcggccuccgccgcccagcgccggggccgcgucgggcggaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgcgagaaguccgccgccaucgacggcgaguaccggcugaagggcgagucccgcaagaccuucguggagcugaugcggcgcggggaccuccccgucuggcuggcgcacaagguggccagcgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcccgcacguacuccgacccgcuggcccucaaggaguucaaggacuucgccgcgggccgcaagagcaucgcccuggaccuggucaccgagaucgggcgcgugcccacccaccucgcccaccggacccgcaacgcccuggacaaccuggugaugcuccacacguccgagcacggcgggaaggccuaccggcacgcggucgaggagcugcccgagaccauggagacccugcuccugcugggccucaugauccugcugaccgggggcgccaugcuguuccugaucagcggcaaggggaucggcaagacgagcaucgggcugaucugcgugaucgccuccagcggcaugcucuggauggccgagaucccgcugcaguggaucgccuccgcgaucgugcuggaguucuucaugaugguccuccugauccccgagcccgagaagcagcgcacgccccaggacaaccagcuggccuacguggugaucgggauccucacccuggccgccaucaucgccgcgaacgagaugggccugcucgagaccacgaagcgggaccugggcaugagccgcgagccgggggucgugucccccaccagcuaccuggacguggaccuccaccccgccuccgccuggacccuguacgccgucgcgaccacggugaucacccccaugcugcggcacaccaucgagaacagcaccgccaacgugucccucgccgccaucgccaaccaggcggucgugcugaugggccuggacaagggguggccgaucagcaagauggaccucggcgugccccugcuggcccucgggugcuacucccaggucaacccccugacgcugaccgccgccgugcuccugcugaucacccacuacgccaucaucggccccggccuccaggcgaaggccacccgcgaggcccagaagcggacggccgccgggaucaugaagaacccgaccguggacggcaucaugaccaucgaccuggaccccgucaucuacgacagcaaguucgagaagcagcugggccaggugaugcuccuggugcugugcgcgguccagcuccugcugaugcgcaccuccugggcccucugcgaggcccugacgcuggccaccggccccaucaccacccucugggagggcagccccgggaaguucuggaacacgaccaucgcgguguccauggccaacaucuuccggggcagcuaccuggccggggccggccuggccuucuccaucaugaaguccguggggaccggcaagcgcggcaccgggucccagggcgagacccucggggagaaguggaagaagaagcugaaccagcugagccggaaggaguucgaccucuacaagaaguccggcaucacggaggucgaccgcaccgaggcgaaggaggggcugaagcggggcgagaucacccaccacgccgugucccgcggcagcgccaagcugcagugguucguggagcggaacauggucaucccggaggggcgcgugaucgaccucggcugcgggcggggcgggugguccuacuacugcgccggccugaagaaggugaccgagguccgcggcuacacgaagggcgggcccgggcacgaggagcccgugcccaugagcaccuacggcuggaacaucgugaagcugauguccgggaaggacgucuucuaccucccgcccgagaagugcgacacccugcugugcgacaucggcgagagcucccccagccccaccguggaggagucccgcacgauccgggugcugaagauggucgagccguggcucaagaacaaccaguucugcaucaaggugcugaaccccuacaugcccgccgugaucgagcaccuggagcgccuccagcggaagcacggcgggaugcugguccgcaacccccugagccggaacuccacccacgagauguacuggaucagcaacggcaccgggaacaucguggcguccgugaacauggucagccgccuccugcugaaccgguucaccaugacgcaccgccggccgaccaucgagaaggacguggaccucggcgccggcacccgccacgugaacgccgagcccgagacccccaacauggacgucaucggggagcggaucaagcgcaucaaggaggagcacaacuccacguggcacuacgacgacgagaacccguacaagaccugggccuaccacggcagcuacgaggugaaggccaccggguccgcgagcuccaugaucaacggcgucgugaagcugcugaccaagcccugggacgugguccccauggugacgcagauggccaugaccgacaccacccccuucgggcagcagcggguguucaaggagaaggucgacacgcgcaccccgcggagcaugcccggcacccgccgggugaugggcaucaccgccgaguggcucuggcgcacgcuggggcggaacaagaagccccgccugugcacccgcgaggaguucaccaagaaggugcggaccaacgccgcgaugggcgccgucuucacggaggagaaccagugggacagcgccaaggccgccguggaggacgaggacuucuggaagcucguggaccgcgagcgggagcugcacaagcuggggaagugcggcuccugcgucuacaacaugauggggaagcgcgagaagaagcucggcgaguucggcaaggcgaaggggagccgggccaucugguacauguggcugggcgcccgcuaccuggaguucgaggcccucggguuccugaacgaggaccacugguucucccgggagaacagcuacuccggcguggagggggagggccugcacaagcucggcuacauccugcgcgacaucagcaagauccccgggggcgccauguacgcggacgacaccgccgggugggacacccggaucaccgaggacgaccugcacaacgaggagaagaucacgcagcagauggacccggagcaccgccagcucgccaacgccaucuucaagcugaccuaccagaacaagguggucaaggugcagcggcccacccccaccggcaccgugauggacaucaucucccgcaaggaccagcggggcagcgggcaggucggcacguacgggcugaacaccuucaccaacauggaggcccagcucauccgccagauggagggcgagggggugcuguccaaggcggaccuggagaacccccaccucccggagaagaagaucacccaguggcuggagacgaagggcguggagcggcugaagcgcauggccaucagcggcgacgacugcgucgugaagcccaucgacgaccgguucgccaacgcccuccuggcccugaacgacauggggaaggugcgcaaggacaucccccaguggcagcccuccaagggcuggcacgacuggcagcaggucccguucugcagccaccacuuccacgagcucaucaugaaggacgggcggaagcugguggugcccugccgcccccaggacgagcugaucggccgggcgcgcaucucccagggggccggcuggagccuccgcgagaccgccugccugggcaaggccuacgcgcagauguggucccugauguacuuccaccggcgcgaccuccggcuggccagcaacgccaucugcuccgccguccccgugcacugggugccgaccagccgcaccacgugguccauccacgcccaccaccaguggaugaccaccgaggacaugcugaccgucuggaaccggguguggaucgaggacaaccccuggauggaggacaagacgcccgugaccaccugggagaacguccccuaccucgggaagcgcgaggaccaguggugcggcagccugaucgggcugaccagccgggcgacgugggcccagaacaucccgaccgccauccagcagguccgcucccucaucggcaacgaggaguuccuggacuacaugcccagcaugaagcgguuccgcaaggaggaggaguccgagggggccaucugguga

SEQ ID NO: 10268 - RNA, 9873 nt, Artificial Sequence
  derived and/or modified CDS sequence (opt1) from DENV-3__FJ639825__SS-prME
accagccugugccucaugaugauccugcccgccgcccuggcguuccaccucaccagccgggacggggagccgcggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggacuacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacacggggugcgugaucaacuggaagggcaaggagcugaagugcggcagcgggaucuucgugaccaacgagguccacaccuggaccgagcaguacaaguuccaggcggacucccccaagcgccucgccacggccaucgccggcgccugggagaacggggugugcggcauccgcagcaccacccggauggagaaccugcuguggaagcagaucgcgaacgagcucaacuacauccugugggagaacaacaucaagcugaccguggucgugggggacaucaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgccucccgggcguggaacgugugggagguggaggacuacggguucggcgucuucaccaccaacaucuggcucaagcugcgcgagguguacacccagcagugcgaccaccggcugaugagcgccgccgugaaggacgagcgcgccguccacgccgacaugggcuacuggaucgagagccagaagaacggguccuggaagcucgagaaggcgagccugaucgaggugaagacgugcaccuggccgaagucccacacccuguggagcaacggcgugcucgaguccgacaugaucauccccaagagccuggccgggcccaucucccagcacaacuaccggccgggcuaccacacccagacggccgggcccuggcaccugggcaagcucgagcuggacuucaacuacugcgagggcaccaccgucgugaucaccgagaacugcgggacgcgcggccccagccugcggaccaccaccguguccgggaagcucauccacgaguggugcugccgcagcugcacgcugcccccgcugcgguacaugggcgaggacgggugcugguacggcauggagauccgccccaucuccgagaaggaggagaacauggucaagagccucguguccgccggcagcggggagguggacaacuucaccaugggcguccugugccuggccauccucuucgaggaggugaugcgggggaaguucggcaagaagcacaugaucgcggggguguucuucaccuucguccugcugcucuccggccagaucaccuggcgcgacauggcccacacgcugaucaugaucggcagcaacgccuccgaccggauggggaugggcgugaccuaccuggcccucaucgccaccuucaagauccagcccuuccuggcgcugggguucuuccuccgcaagcugaccagccgggagaaccugcuccugggcgugggccuggccauggccacgacccuccagcugcccgaggacaucgagcagauggccaacgggaucgcgcugggccucauggcccugaagcugaucacccaguucgagaccuaccagcucuggacggcccugaucagccugaccugcuccaacaccaucuucacccucacggucgccuggcgcaccgccacccugauccuggcgggggugagccuccugccggucugccaguccagcuccaugcggaagaccgacuggcugcccaugacgguggccgccaugggcgugccgccccucccgcuguucaucuucagccugaaggacacccucaagcgccgcuccuggccccugaacgagggggucauggccgugggccuggugagcauccucgccuccagccugcugcggaacgacguccccauggcgggcccccucguggccgggggccugcugaucgccugcuacgugaucaccgggaccuccgccgaccucacggucgagaaggccgcggacgugaccugggaggaggaggccgagcagaccggcgugagccacaaccugaugaucaccgucgacgacgacgggaccaugcgcaucaaggacgacgagacggagaacauccugaccgugcuccugaagaccgcccugcucaucguguccggcaucuucccguacagcauccccgccacccugcuggucuggcacacguggcagaagcagacccagcgguccggcgugcucugggacgugcccagcccgcccgagacccagaaggccgagcuggaggagggggucuaccgcaucaagcagcagggcaucuucgggaagacccaggugggcguggggguccagaaggagggcguguuccacacgauguggcacgugacccggggcgcgguccugaccuacaacgggaagcgccucgagcccaacugggccuccgugaagaaggaccugaucagcuacggcgggggcuggcggcuguccgcccaguggcagaagggggaggaggugcaggucaucgccguggagcccggcaagaaccccaagaacuuccagaccaugcccggcacguuccagaccaccaccggggagaucggcgcgaucgcccucgacuucaagcccgggacgagcggcagccccaucaucaaccgcgagggcaagguggucgggcuguacggcaacgggguggugaccaagaacggcggguacgucuccggcaucgcccagaccaacgccgagccggacggccccacccccgagcuggaggaggagauguucaagaagcggaaccugacgaucauggaccuccaccccgggagcggcaagacccgcaaguaccugccggccaucgugcgggaggcgaucaagcgccggcugcgcacccucauccuggcccccacccggguggucgccgccgagauggaggaggcccugaaggggcuccccauccgcuaccagacgaccgcgaccaaguccgagcacaccggccgggagaucguggaccugaugugccacgccacguucaccaugcgccugcucagccccgugcgggucccgaacuacaaccugaucaucauggacgaggcccacuucaccgaccccgccuccaucgccgcgcgcggguacaucagcacccgggugggcaugggcgaggccgccgccaucuucaugacggcgacgccgcccgggaccgccgacgccuucccgcaguccaacgcccccauccaggacgaggagcgcgacauccccgagcgcagcuggaacuccggcaacgaguggaucaccgacuucgccgggaagacggugugguucguccccagcaucaaggcgggcaacgacaucgccaacugccugcggaagaacgggaagaaggugauccagcucucccgcaagaccuucgacaccgaguaccagaagaccaagcugaacgacugggacuucguggucacgaccgacaucagcgagaugggcgccaacuucaaggccgaccgggugaucgacccgcgccggugccugaagcccgugauccucaccgacggccccgagcgcgucauccuggccgggcccaugccggugaccgcggccuccgccgcccagcggcgcggccggguggggcgcaacccccagaaggagaacgaccaguacaucuucaccggccagccccugaacaacgacgaggaccacgcccacuggacggaggcgaagaugcuccuggacaacaucaacacccccgaggggaucaucccggcccuguucgagcccgagcgggagaaguccgccgccaucgacggcgaguaccgccucaagggcgagucccggaagaccuucgucgagcugaugcgccgcggggaccugcccguguggcucgcgcacaaggucgccagcgagggcaucaaguacaccgaccgcaaguggugcuucgacgggcagcggaacaaccagauccuggaggagaacauggacguggagaucuggacgaaggagggcgagaagaagaagcugcgcccccgguggcucgacgcccgcaccuacuccgacccgcuggcccugaaggaguucaaggacuucgccgcgggccgcaagagcaucgcccucgaccuggugaccgagaucgggcggguccccucccaccuggcccaccgcacccggaacgcccucgacaaccuggugaugcugcacacgagcgagcacggcgggaaggccuaccgccacgcgguggaggagcuccccgagaccauggagacccugcugcuccugggccugaugauccuccugaccgggggcgccaugcuguuccucaucagcggcaaggggaucggcaagacguccaucgggcugaucugcgucaucgccagcuccggcaugcuguggauggccgagaucccgcuccaguggaucgccagcgcgaucgugcuggaguucuucaugauggugcugcucauccccgagcccgagaagcagcggacgccccaggacaaccagcuggccuacgucgugaucgggauccugacccucgccgccaucaucgccgcgaacgagaugggccugcuggagaccacgaagcgcgaccucggcauguccaaggagccggggguggucagccccaccuccuaccuggacguggaccugcaccccgccagcgccuggacccucuacgccguggcgaccacggucaucacccccaugcugcggcacaccaucgagaacuccaccgccaacgugagccuggccgccaucgccaaccaggcggugguccucaugggccuggacaagggguggccgaucuccaagauggaccugggcgugccccuccuggcccuggggugcuacagccaggugaacccccucacgcugaccgccgccguccugcuccugaucacccacuacgccaucaucggccccggccugcaggcgaaggccacccgcgaggcccagaagcggacggccgccgggaucaugaagaacccgaccguggacggcaucaugaccaucgaccucgaccccgugaucuacgacuccaaguucgagaagcagcuggggcaggucaugcugcucgugcugugcgcggugcagcugcuccugaugcgcaccagcugggcccugugcgaggcccucacgcuggccaccggccccaucaccacccugugggagggcucccccgggaaguucuggaacacgaccaucgcggucagcauggccaacaucuuccggggcuccuaccucgccggggccggccuggccuucagcaucaugaaguccguggggaccggcaagcgcggcaccgggagccagggcgagacccugggggagaaguggaagaagaagcucaaccagcugagccggaaggaguucgaccuguacaagaaguccggcaucacggagguggaccgcaccgaggcgaaggaggggcucaagcggggcgagaucacccaccacgccgucagccgcggcuccgccaagcugcagugguucguggagcggaacauggugaucccggaggggcgcgucaucgaccugggcugcgggcggggcggguggagcuacuacugcgccggccucaagaaggugaccgaggugcgcggcuacacgaagggcgggcccgggcacgaggagcccguccccauguccaccuacggcuggaacaucgugaagcugaugagcgggaaggacguguucuaccugccgcccgagaagugcgacacccuccugugcgacaucggcgaguccagccccucccccaccgucgaggagagccggacgauccgcgugcugaagaugguggagccguggcugaagaacaaccaguucugcaucaagguccucaaccccuacaugcccaccgugaucgagcaccuggagcgccugcagcggaagcacggcgggaugcucgugcgcaacccccugucccggaacagcacccacgagauguacuggaucuccaacggcaccgggaacaucgucgccagcgugaacauggugucccgccugcuccugaaccgguucacgaugacccaccgccggccgaccaucgagaaggacgucgaccugggcgcgggcacccgccacgugaacgccgagcccgagacgcccaacauggacgugaucggggagcggaucaagcgcaucaaggaggagcacaacagcaccuggcacuacgacgacgagaacccguacaagaccugggccuaccacggcuccuacgaggucaaggccaccgggagcgccuccagcaugaucaacggcguggucaagcuccugacgaagcccugggacguggugcccauggucacccagauggcgaugaccgacaccacgcccuucgggcagcagcggguguucaaggagaagguggacacccgcaccccgcggagcaugcccggcacccgccgggucaugggcaucacggccgaguggcuguggcgcacccucgggcggaacaagaagccccgccugugcacccgggaggaguucaccaagaaggugcgcacgaacgccgccaugggcgcgguguucaccgaggagaaccagugggacuccgccaaggccgccgucgaggacgaggacuucuggaagcugguggaccgcgagcgggagcuccacaagcuggggaagugcggcagcugcguguacaacaugauggggaagcgcgagaagaagcugggcgaguucggcaaggccaaggggucccgggcgaucugguacauguggcucggcgcccgcuaccuggaguucgaggcccugggguuccucaacgaggaccacugguucagccgggagaacuccuacagcggcgucgagggggagggccugcacaagcugggcuacauccuccgcgacaucuccaagauccccgggggcgccauguacgccgacgacaccgcggggugggacacccggaucacggaggacgaccugcacaacgaggagaagaucacccagcagauggacccggagcacaagcagcuggccaacgccaucuucaagcucaccuaccagaacaagguggugaagguccagcgccccacccccaccggcacggugauggacaucaucagccggaaggaccagcgcggcuccggccaggugggcaccuacgggcugaacaccuucaccaacauggaggcccagcugauccggcagauggagggcgaggggguccucagcaaggccgaccuggagaacccccaccuccccgagaagaagaucacgcaguggcuggagaccaagggcguggagcgccugaagcggauggcgaucuccggcgacgacugcguggucaagcccaucgacgaccgcuucgccaacgcccugcucgcccugaacgacauggggaaggugcggaaggacaucccccaguggcagcccagcaagggcuggcacgacuggcagcaggucccguucugcucccaccacuuccacgagcugaucaugaaggacgggcgcaagcucgucgugcccugccggccccaggacgagcugaucggccgcgcccggaucagccagggggcgggcuggucccugcgcgagaccgccugccucggcaaggccuacgcccagauguggagccugauguacuuccaccggcgcgaccugcgccucgcguccaacgccaucugcagcgccgugcccguccacugggugccgaccucccggacgaccuggagcauccacgcccaccaccaguggaugaccaccgaggacaugcugacgguguggaaccgcgucuggaucgaggacaaccccuggauggaggacaagacccccgugaccaccugggagaacgugcccuaccuggggaagcgggaggaccaguggugcggcagccucaucgggcugacgucccgcgccaccugggcgcagaacaucccgaccgccauccagcagguccggagccugaucggcaacgaggaguuccucgacuacaugcccuccaugaagcgcuuccggaaggaggaggagagcgagggggccaucugguga

SEQ ID NO: 10269 - RNA, 9873 nt, Artificial Sequence
  derived and/or modified CDS sequence (opt1) from DENV-3__FJ639826__SS-prME
accagccucugccucaugaugauccugcccgcggcccuggcguuccaccucaccagccgggacggcgagccgcggaugaucguggggaagaacgagcggggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacacggggugcgugaucaacuggaagggcaaggagcugaagugcggcagcgggaucuucgugaccaacgagguccacaccuggaccgagcaguacaaguuccaggcggacucccccaagcgccucgccacggccaucgccggcgccugggagaacggggugugcggcauccgcagcaccacccggauggagaaccugcuguggaagcagaucgcgaacgagcucaacuacauccugugggagaacaacaucaagcugaccguggucgugggggacaucaucggcgugcucgagcagggcaagcgcacgcugacgccccagccgauggagcugaaguacuccuggaagaccugggggaaggcccggaucgucaccgccgagacgcagaacagcuccuucaucaucgacggccccaacacccccgagugccccaacaccagccgcgccuggaacgugugggagguggaggacuacggguucggcgucuucaccaccaacaucuggcucaagcugcgggagguguacacgcagcugugcgaccaccgccucauguccgcggccgugaaggacgagcgggccguccacgccgacaugggcuacuggaucgagagccagaagaacgggagcuggaagcuggagaaggccucccugaucgaggugaagaccugcaccuggcccaagagccacacccucugguccaacggcgugcuggagagcgacaugaucauccccaagucccuggcggggcccaucagccagcacaacuaccgcccgggcuaccacacgcagaccgccgggcccuggcaccucggcaagcuggagcuggacuucaacuacugcgagggcaccaccgucgugaucacggagaacugcgggacccggggccccucccuccgcaccaccacggugagcgggaagcugauccacgaguggugcugccgguccugcacccugcccccgcuccgcuacaugggcgaggacgggugcugguacggcauggagauccggcccaucagcgagaaggaggagaacauggucaagucccuggugagcgccggcuccggggagguggacaacuucaccaugggcguccugugccucgccauccuguucgaggaggugaugcgcgggaaguucggcaagaagcacaugaucgccgggguguucuucaccuucguccugcuccugagcggccagaucacguggcgggacauggcgcacacccugaucaugaucggcuccaacgccaccgaccgcauggggaugggcgugaccuaccucgcccugaucgccacguucaagauccagcccuuccuggcccucggguucuuccugcggaagcugaccagccgcgagaaccuccugcugggcgugggccucgcgauggccaccacccugcagcugcccgaggacaucgagcagauggccaacgggaucgcccucggccugauggcgcugaagcucaucacgcaguucgagaccuaccagcuguggaccgcccugaucucccugaccugcagcaacacgaucuucacccugaccgucgccuggcggaccgccacgcugauccucgccggggugagccugcugccggucugccaguccagcuccaugcgcaagaccgacuggcuccccaugaccguggcggccaugggcgugccgccccucccgcuguucaucuucagccucaaggacacccugaagcgccgguccuggccccugaacgagggggucauggccgugggccucgugagcauccuggccuccagccugcuccgcaacgacguccccauggccggcccccugguggccggcgggcugcucaucgccugcuacgugaucacggggaccuccgccgaccugaccgucgagaaggccgccgacgugaccugggaggaggaggcggagcagaccggggugagccacaaccugaugaucacggucgacgacgacgggaccaugcggaucaaggacgacgagaccgagaacauccucaccgugcugcugaagacggcccuccugaucguguccggcaucuucccguacagcauccccgccacccugcucgucuggcacaccuggcagaagcagacccagcgcuccggcgugcugugggacgugcccagcccgcccgagacgcagaaggccgagcuggaggagggggucuaccggaucaagcagcagggcaucuucgggaagacccaggugggcguggggguccagaaggagggcguguuccacaccauguggcacgugacccgcggcgccguccucacguacaacgggaagcggcuggagcccaacugggcguccgugaagaaggaccugaucagcuacggcgggggcuggcgccucuccgcccaguggcagaagggggaggaggugcaggucaucgccguggagcccggcaagaaccccaagaacuuccagaccaugcccggcaccuuccagaccacgaccggggagaucggcgccaucgcgcuggacuucaagcccgggaccagcggcucccccaucaucaaccgggagggcaagguggucgggcuguacggcaacgggguggugaccaagaacggcggguacgucagcggcaucgcccagacgaacgccgagccggacggccccacccccgagcuggaggaggagauguucaagaagcgcaaccucaccaucauggaccugcaccccgggagcggcaagacccggaaguaccugccggccaucgugcgcgaggccaucaagcggcgccuccggacgcugauccuggcgcccacccgcguggucgccgccgagauggaggaggcccucaaggggcugcccauccgguaccagaccaccgccacgaaguccgagcacaccggccgcgagaucguggaccugaugugccacgcgaccuucaccaugcggcuccugagccccgugcgcgucccgaacuacaaccugaucaucauggacgaggcccacuucacggaccccgccuccaucgccgcccggggguacaucagcacccgcgugggcaugggcgaggcggccgccaucuucaugaccgccacgccgcccgggacggcggacgccuucccgcaguccaacgcccccauccaggacgaggagcgcgacauccccgagcggagcuggaacuccggcaacgaguggaucaccgacuucaccgggaagaccgugugguucguccccagcaucaaggccggcaacgacaucgccaacugccuccgcaagaacgggaagaaggugauccagcugucccggaagacguucgacaccgaguaccagaagaccaagcugaacgacugggacuucguggucaccaccgacaucagcgagaugggcgcgaacuucaaggccgaccgcgugaucgacccgcggcgcugccucaagcccgugauccugacggacggccccgagcgggucauccuggccgggcccaugccggugaccgccgccuccgcggcccagcgccggggccgcguggggcggaacccccagaaggagaacgaccaguacaucuucaccggccagccccucaacaacgacgaggaccacgcccacuggaccgaggccaagaugcugcuggacaacaucaacacgcccgaggggaucaucccggcccucuucgagcccgagcgcgagaaguccgcggccaucgacggcgaguaccggcugaagggcgagucccgcaagaccuucgucgagcugaugcggcgcggggaccuccccguguggcuggcccacaaggucgccagcgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcgcgcacguacuccgacccgcuggcccucaaggaguucaaggacuucgccgccggccgcaagagcaucgcccuggaccuggugaccgagaucgggcgcguccccacccaccucgcgcaccggacccgcaacgcccuggacaaccuggugaugcuccacacguccgagcacggcgggaaggccuaccggcacgccguggaggagcugcccgagaccauggagacccugcuccugcugggccucaugauccugcugaccgggggcgccaugcuguuccugaucagcggcaaggggaucggcaagacguccaucgggcugaucugcgucaucgcgagcagcggcaugcucuggauggccgagaucccgcugcaguggaucgccuccgccaucgugcuggaguucuucaugauggugcuccugauccccgagcccgagaagcagcgcacgccccaggacaaccagcuggccuacgucgugaucgggauccucacccuggcggccaucaucgccgccaacgagaugggccugcucgagaccacgaagcgggaccugggcaugagcaaggagccggggguggucucccccaccagcuaccuggacguggaccuccaccccgccuccgcguggacccuguacgccguggccaccacggucaucacccccaugcugcgccacaccaucgagaacagcaccgccaacgugucccucgcggccaucgccaaccaggccgugguccugaugggccuggacaagggguggccgaucagcaagauggaccucggcgugccccugcuggcccucgggugcuacucccaggugaacccccugacgcugaccgcggccguccuccugcugaucacccacuacgccaucaucggccccggccuccaggccaaggccacccgggaggcgcagaagcgcacggccgccgggaucaugaagaacccgaccguggacggcaucaugaccaucgaccuggaccccgugaucuacgacagcaaguucgagaagcagcuggggcaggucaugcuccuggugcugugcgccgugcagcuccugcugaugcggaccuccugggcccucugcgaggcgcugacgcuggccaccggccccaucaccacccucugggagggcagccccgggaaguucuggaacaccacgaucgccgucuccauggccaacaucuuccgcggcagcuaccuggcgggggccggccuggccuucuccaucaugaaguccguggggaccggcaagcggggcaccgggucccagggcgagacccucggggagaaguggaagaagaagcugaaccagcugagccgcaaggaguucgaccucuacaagaaguccggcaucacggagguggaccggaccgaggccaaggaggggcugaagcgcggcgagaucacccaccacgccgucagccggggcagcgcgaagcugcagugguucguggagcgcaacauggugaucccggaggggcgggucaucgaccucggcugcgggcgcggcgggugguccuacuacugcgccggccugaagaaggugaccgaggugcggggcuacacgaagggcggccccgggcacgaggagcccguccccaugagcaccuacggcuggaacaucgugaagcugauguccgggaaggacguguucuaccucccgcccgagaagugcgacacccugcugugcgacaucggcgagagcucccccagccccaccgucgaggagucccgcacgauccgcgugcugaagaugguggagccguggcucaagaacaaccaguucugcaucaagguccugaaccccuacaugcccgccgugaucgagcaccuggagcggcuccagcgcaagcacggcgggaugcuggugcggaacccccugagccgcaacuccacccacgagauguacuggaucagcaacggcaccgggaacaucgucgccuccgugaacauggugagccggcuccugcugaaccgcuucaccaugacgcaccggcgcccgaccaucgagaaggacgucgaccucggcgccggcacccggcacgugaacgcggagcccgagacccccaacauggacgugaucggggagcgcaucaagcggaucaaggaggagcacaacuccacguggcacuacgacgacgagaacccguacaagaccugggccuaccacggcagcuacgaggucaaggccaccggguccgccagcuccaugaucaacggcguggucaagcugcugaccaagcccugggacguggugcccauggucacgcagauggccaugaccgacaccacccccuucgggcagcagcgcguguucaaggagaagguggacacgcggaccccgcgcagcaugcccggcacccggcgcgucauggagaucaccgcggaguggcucuggcggacgcugggccgcaacaagaagccccggcugugcacccgcgaggaguucaccaagaaggugcgcaccaacgccgccaugggggccguguucacggaggagaaccagugggacuccgcgaaggccgccgucgaggacgaggacuucuggaagcucguggaccgggagcgcgagcugcacaagcugggcaagugcgggagcugcguguacaacaugaugggcaagcgggagaagaagcucggggaguucggcaaggccaagggcagccgcgccaucugguacauguggcugggggcgcgguaccuggaguucgaggcccucggcuuccugaacgaggaccacugguucucccgcgagaacagcuacuccggggucgagggcgaggggcugcacaagcucggcuacauccugcgggacaucagcaagauccccggcggggccauguacgccgacgacaccgccggcugggacacccgcaucaccgaggacgaccugcacaacgaggagaagaucacccagcagauggacccggagcaccggcagcucgcgaacgccaucuucaagcugacguaccagaacaagguggugaagguccagcgccccacccccaccgggaccgugauggacaucaucucccggaaggaccagcgcggcagcggccagguggggacguacggccugaacaccuucaccaacauggaggcccagcucauccggcagauggagggggagggcguccuguccaaggccgaccuggagaacccccaccucccggagaagaagaucacccaguggcuggagacgaaggggguggagcgccugaagcggauggccaucagcggcgacgacugcguggucaagcccaucgacgaccgcuucgcgaacgcccuccuggcccugaacgacaugggcaaggugcggaaggacaucccccaguggcagcccuccaagggguggcacgacuggcagcaggucccguucugcagccaccacuuccacgagcucaucaugaaggacggccgcaagcuggucgugcccugccggccccaggacgagcugaucgggcgcgcccggaucucccagggcgccggguggagccuccgcgagaccgcgugccugggcaaggccuacgcccagauguggucccugauguacuuccaccgccgggaccuccgccuggccagcaacgcgaucugcuccgccgugcccguccacugggugccgaccagccggaccacgugguccauccacgcccaccaccaguggaugaccaccgaggacaugcugaccguguggaaccgcgucuggaucgaggacaaccccuggauggaggacaagacgcccgugaccaccugggagaacgugcccuaccucggcaagcgggaggaccaguggugcgggagccugaucggccugaccucccgcgccacgugggcccagaacaucccgaccgcgauccagcagguccggagccucaucgggaacgaggaguuccuggacuacaugcccagcaugaagcgcuuccggaaggaggaggaguccgagggcgccaucugguga

SEQ ID NO: 10270 - RNA, 9873 nt, Artificial Sequence
  derived and/or modified CDS sequence (opt1) from DENV-3__FJ810416__SS-prME
accagccugugccucaugaugauccugcccgccgcccuggcguuccaccucaccagccgggacggggagccccggaugaucguggggaagaacgagcggggcaagagccugcuguucaagacggccuccgggaucaacaugugcacccucaucgccauggaccugggggagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaaguccgagcacaccggccgggagaucguggaccugaugugccacgccaccuucacgaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucguccccagcaucaaggcgggcaacgacaucgccaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccugaugaccgagaucgggcgggugcccucccaccucgcccaccgcacccggaacgcccuggacaaccuggucaugcuccacaccagcgagcacggcgggaaggccuaccgccacgcgguggaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucguccuggaguucuucaugauggugcuccugauccccgagcccgagaagcagcggacgccccaggacaaccagcuggccuacguggucaucgggauccucacccuggccgccaucaucgccgcgaacgagaugggccugcucgagaccaccaagcgcgaccugggcauguccaaggagccggggguggugagccccacguccuaccuggacgucgaccuccaccccgccagcgccuggacccuguacgccguggcgaccaccgugaucacgcccaugcugcggcacaccaucgagaacuccaccgccaacgucagccucgccgccaucgccaaccaggcgguggugcugaugggccuggacaagggguggccgaucuccaagauggaccucggcgucccccugcuggcccucgggugcuacagccaggugaacccccugacccugacggccgccgugcuccugcugaucacccacuacgccaucaucggccccggccuccaggcgaaggccacccgcgaggcccagaagcggaccgccgccgggaucaugaagaacccgacggucgacggcaucaugaccaucgaccuggaccccgugaucuacgacuccaaguucgagaagcagcugggccaggugaugcuccugguccugugcgcggugcagcuccugcugaugcgcaccagcugggcccucugcgaggcccugacccuggccacgggccccaucaccacccucugggagggcucccccgggaaguucuggaacaccacgaucgcggugagcauggccaacaucuuccggggcuccuaccuggccggggccggccuggccuucagcaucaugaaguccgucgggaccggcaagcgcggcaccgggagccagggcgagacccucggggagaaguggaagaagaagcugaaccagcugagccggaaggaguucgaccucuacaagaaguccggcaucaccgagguggaccgcacggaggcgaaggaggggcugaagcggggcgagaucacccaccacgccgugagccgcggcuccgccaagcugcagugguucgucgagcggaacauggugaucccggaggggcgcgugaucgaccucggcugcgggcggggcggguggagcuacuacugcgccggccugaagaaggucaccgaggugcgcggcuacaccaagggcgggcccgggcacgaggagcccgugcccauguccacguacggcuggaacaucgucaagcugaugagcgggaaggacguguucuaccucccgcccgagaagugcgacacccugcugugcgacaucggcgaguccagccccucccccaccguggaggagagccggaccauccgcguccugaagaugguggagccguggcucaagaacaaccaguucugcaucaaggugcugaaccccuacaugcccacggucguggagcaccuggagcgccuccagcggaagcacggcgggaugcuggugcgcaacccccugucccggaacagcacccacgagauguacuggaucuccaacggcaccgggaacaucgucgccagcgugaacauggugucccgccuccugcugaaccgguucaccaugacgcaccgccggccgaccaucgagaaggacgucgaccucggcgcgggcacccgccacgugaacgccgagcccgagacccccaacauggacgugaucggggagcggaucaagcgcaucaaggaggagcacaacagcacguggcacuacgacgacgagaacccguacaagaccugggccuaccacggcuccuacgaggucaaggccaccgggagcgccuccagcaugaucaacggcguggucaagcugcugaccaagcccugggacguggugcccauggucacgcagauggcgaugaccgacaccacccccuucgggcagcagcggguguucaaggagaagguggacacgcgcaccccgcggagcaugcccggcacccgccgggucaugggcaucaccgccgaguggcucuggcgcacgcuggggcggaacaagaagccccgccugugcacccgggaggaguucaccaagaaggugcgcaccaacgccgccaugggcgcgguguucacggaggagaaccagugggacuccgccaaggccgccgucgaggacgaggacuucuggaagcucguggaccgcgagcgggagcugcacaagcuggggaagugcggcagcugcguguacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcgucgagggggagggccugcacaagcucggcuacauccugcgcgacaucuccaagauccccgggggcgccauguacgccgacgacaccgcggggugggacacccggaucaccgaggacgaccugcacaacgaggagaagaucacgcagcagauggacccggagcaccgccagcucgccaacgccaucuucaagcugaccuaccagaacaagguggugaagguccagcggcccacccccaccggcaccgugauggacaucaucagccgcaaggaccagcggggcuccggccaggugggcacguacgggcugaacaccuucaccaacauggaggcccagcucauccgccagauggagggcgaggggguccugagcaaggccgaccuggagaacccccggcucccggagaagaagaucacccaguggcuggagacgaagggcguggagcgccugaagcggauggcgaucuccggcgacgacugcguggucaagcccaucgacgaccgcuucgccaacgcccuccuggcccugaacgacauggggaaggugcggaaggacaucccccaguggcagcccagcaagggcuggcacgacuggcagcaggucccguucugcucccaccacuuccacgagcucaucaugaaggacgggcgcaagcuggucgugcccugccggccccaggacgagcugaucggccgcgcccggaucagccagggggcgggcuggucccuccgcgagaccgccugccugggcaaggccuacgcccagauguggagccugauguacuuccaccgccgggaccuccgccuggcguccaacgccaucugcagcgccgugcccguccacugggugccgaccucccggaccacguggagcauccacgcccaccaccaguggaugaccaccgaggacaugcugaccguguggaaccgcgucuggaucgaggacaaccccuggauggaggacaagacgcccaucaccaccugggagaacgugcccuaccucgggaagcgggaggaccaguggugcggcagccugaucgggcugaccucccgcgccacgugggcgcagaacaucccgaccgccauccagcagguccggagccucaucggcaacgaggaguuccuggacuacaugcccuccaugaagcgcuuccggaaggaggaggagagcgagggggccaucugguga

SEQ ID NO: 10271 - RNA, 9873 nt, Artificial Sequence
  derived and/or modified CDS sequence (opt1) from DENV-3__GQ252678__SS-prME
accagccugugccucaugaugauccugcccgccgcccuggcguuccaccucaccagccgggacggggagccccggaugaucguggggaagaacgagcggggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcggagcgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucacccacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaaguccgagcacaccggccgggagaucguggaccugaugugccacgccaccuucacgaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucguccccagcaucaaggcgggcaacgacaucgccaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggugaccgagaucgggcggguccccacccaccucgcccaccgcacccggaacgcccuggacaaccuggugaugcuccacacguccgagcacggcgggaaggccuaccgccacgcgguggaggagcugcccgagaccauggagacccugcuccugcugggccucaugauccugcugaccgggggcgccaugcuguuccugaucagcggcaaggggaucggcaagacgagcaucgggcugaucugcgucaucgccuccagcggcaugcucuggauggccgagaucccgcugcaguggaucgccuccgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccacgaagcgcgaccugggcaugagcaaggagccggggguggucucccccaccagcuaccuggacguggaccuccaccccgccuccgccuggacccuguacgccguggcgaccacggucaucacccccaugcugcggcacaccaucgagaacagcaccgccaacgugucccucgccgccaucgccaaccaggcggugguccugaugggccuggacaagggguggccgaucagcaagauggaccucggcgugccccugcuggcccucgggugcuacucccaggugaacccccugacgcugaccgccgccguccuccugcugaucacccacuacgccaucaucggccccggccuccaggcgaaggccacccgcgaggcccagaagcggacggccgccgggaucaugaagaacccgaccguggacggcaucaugaccaucgaccuggaccccgugaucuacgacagcaaguucgagaagcagcuggggcaggucaugcuccuggugcugugcgcggugcagcuccugcugaugcgcaccuccugggcccucugcgaggcccugacgcuggccaccggccccaucaccacccucugggagggcagccccgggaaguucuggaacacgaccaucgcggucuccauggccaacaucuuccggggcagcuaccuggccggggccggccuggccuucuccaucaugaaguccguggggaccggcaagcgcggcaccgggucccagggcgagacccucggggagaaguggaagaagaagcugaaccagcugagccggaaggaguucgaccucuacaagaaguccggcaucacggagguggaccgcaccgaggcgaaggaggggcugaagcggggcgagaucacccaccacgccgucucccgcggcagcgccaagcugcagugguucguggagcggaacauggugaucccggaggggcgcgucaucgaccucggcugcgggcggggcgggugguccuacuacugcgccggccugaagaaggugaccgaggugcgcggcuacacgaagggcgggcccgggcacgaggagcccguccccaugagcaccuacggcuggaacaucgugaagcugauguccgggaaggacguguucuaccucccgcccgagaagugcgacacccugcugugcgacaucggcgagagcucccccagccccaccgucgaggagucccggacgauccgcgugcugaagaugguggagccguggcucaagaacaaccaguucugcaucaagguccugaaccccuacaugcccaccgugaucgagcaccuggagcgccuccagcggaagcacggcgggaugcuggugcgcaacccccugagccggaacuccacccacgagauguacuggaucagcaacggcaccgggaacaucgucgccuccgugaacauggugagccgccuccugcugaaccgguucacgaugacccaccgccggccgaccaucgagaaggacgucgaccucggcgcgggcacccgccacgugaacgccgagcccgagacgcccaacauggacgugaucggggagcggaucaagcgcaucaaggaggagcacaacuccaccuggcacuacgacgacgagaacccguacaagaccugggccuaccacggcagcuacgaggucaaggccaccggguccgccagcuccaugaucaacggcguggucaagcugcugacgaagcccugggacguggugcccauggucacccagauggcgaugaccgacaccacgcccuucgggcagcagcggguguucaaggagaagguggacacccgcaccccgcggagcaugcccggcacccgccgggucaugggcaucacggccgaguggcucuggcgcacccuggggcggaacaagaagccccgccugugcacccgggaggaguucaccaagaaggugcgcacgaacgccgccaugggcgcgguguucaccgaggagaaccagugggacagcgccaaggccgccgucgaggacgaggacuucuggaagcucguggaccgcgagcgggagcugcacaagcuggggaagugcggcuccugcguguacaacaugauggggaagcgcgagaagaagcucggcgaguucggcaaggccaaggggagccgggcgaucugguacauguggcugggcgcccgcuaccuggaguucgaggcccucggguuccugaacgaggaccacugguucucccgggagaacagcuacuccggcgucgagggggagggccugcacaagcucggcuacauccugcgcgacaucagcaagauccccgggggcgccauguacgccgacgacaccgcggggugggacacccggaucacggaggacgaccugcacaacgaggagaagaucacccagcagauggacccggagcaccgccagcucgccaacgccaucuucaagcugaccuaccagaacaagguggugaagguccagcggcccacccccaccggcacggugauggacaucaucucccgcaaggaccagcggggcagcggccaggugggcaccuacgggcugaacaccuucaccaacauggaggcccagcucauccgccagauggagggcgaggggguccuguccaaggccgaccuggagaacccccaccucccggagaagaagaucacgcaguggcuggagaccaagggcguggagcggcugaagcgcauggcgaucagcggcgacgacugcguggucaagcccaucgacgaccgguucgccaacgcccuccuggcccugaacgacauggggaaggugcgcaaggacaucccccaguggcagcccuccaagggcuggcacgacuggcagcaggucccguucugcagccaccacuuccacgagcucaucaugaaggacgggcggaagcuggucgugcccugccgcccccaggacgagcugaucggccgggcccgcaucucccagggggcgggcuggagccuccgggagaccgccugccugggcaaggccuacgcccagauguggucccugauguacuuccaccgccgcgaccuccggcuggcgagcaacgccaucugcuccgccgugcccguccacugggugccgaccagccgcacgaccugguccauccacgcccaccaccaguggaugaccaccgaggacaugcugacgguguggaaccgggucuggaucgaggacaaccccuggauggaggacaagacccccgugaccaccugggagaacgugcccuaccucgggaagcgcgaggaccaguggugcggcagccugaucgggcugacgagccgggccaccugggcgcagaacaucuccaccgccauccagcagguccgcagccucaucggcaacgaggaguuccuggacuacaugccguccaugaagcgguuccgcaaggaggaggagagcgagggggccaucugguga

SEQ ID NO: 10272 - RNA, 9873 nt, Artificial Sequence
  derived and/or modified CDS sequence (opt1) from DENV-3__FJ850098__SS-prME
accagccugugccucaugaugauccugcccgccgcccuggcguuccaccucaccagccgggacggggagccccggaugaucguggggaagaacgagcgcggcaagagccugcuguucaagacggccagcgggaucaacaugugcacccucaucgccauggaccugggggagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaagguggagacgugggcccugcgccaccccggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugcccgaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggaccccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacgugaucggcguccucgagcagggcaagcgcacccugacgcugcagcccauggagcucaaguacuccuggaagaccugggggaaggccaagaucgugaccgccgagacccagaacagcuccuucaucaucgacggcccgaacacgcccgagugccccagcgccucccgggcguggaacgugugggaggucgaggacuacggguucggcguguucaccaccaacaucuggcugaagcugcgcgagguguacacccagcucugcgaccaccggcugaugagcgccgccgucaaggacgagcgcgccgugcacgccgacaugggcuacuggaucgagagccagaagaacggguccuggaagcuggagaaggcgagccucaucgaggugaagaccugcacguggcccaagucccacacccuguggagcaacggcguccuggaguccgacaugaucauccccaagagccucgccgggcccaucucccagcacaacuaccggcccggcuaccacacccagaccgccgggccguggcaccugggcaagcuggagcucgacuucaacuacugcgagggcacgaccguggugaucaccgagaacugcgggacccgcggccccagccugcggacgaccaccgucuccgggaagcugauccacgaguggugcugccgcagcugcacccugccgccccuccgguacaugggcgaggacgggugcugguacggcauggagauccgcccgaucuccgagaaggaggagaacauggucaagagccugguguccgccggcagcggggaggucgacaacuucacgaugggcgugcucugccuggccauccuguucgaggaggugaugcgggggaaguucggcaagaagcacaugaucgcgggggucuucuucaccuucgugcuccugcuguccggccagaucaccuggcgcgacauggcccacacccucaucaugaucggcagcaacgccuccgaccggauggggaugggcgugacguaccuggcccugaucgccaccuucaagauccagcccuuccucgcgcugggguucuuccugcgcaagcucaccagccgggagaaccugcugcucggcgucggccuggccauggccaccacgcugcagcuccccgaggacaucgagcagauggccaacgggaucgcgcugggccugauggcccucaagcugaucacccaguucgagaccuaccagcuguggaccgcccucaucagccugacgugcuccaacaccaucuucacccugaccguggccuggcgcacggccacccucauccuggcgggggucagccugcuccccgugugccaguccagcuccaugcggaagaccgacuggcugccgaugaccguggccgccaugggcgugccgccccugccccucuucaucuucagccugaaggacacgcugaagcgccgcuccuggccgcucaacgagggggugauggccgugggccuggucagcauccuggccuccagccuccugcggaacgacgugcccauggcgggcccccugguggccgggggccuccugaucgccugcuacgucaucaccgggaccuccgccgaccugaccguggagaaggccgcggacgugacgugggaggaggaggccgagcagaccggcgucagccacaaccucaugaucaccguggacgacgacgggaccaugcgcaucaaggacgacgagaccgagaacauccugacggugcugcucaagaccgcccugcugaucgucuccggcaucuuccccuacagcaucccggccacccuccugguguggcacaccuggcagaagcagacgcagcgguccggcgugcugugggacguccccuccccgcccgagacccagaaggccgagcucgaggaggggguguaccgcaucaagcagcagggcaucuucgggaagacccaggugggcgucggggugcagaaggagggcguguuccacaccauguggcacgucacgcggggcgcggugcugaccuacaacgggaagcgccuggagccgaacugggccuccgugaagaaggaccucaucagcuacggcgggggcuggcggcuguccgcccaguggcagaagggggaggagguccaggugaucgccguggagcccggcaagaaccccaagaacuuccagaccaugcccggcaccuuccagacgaccaccggggagaucggcgcgaucgcccuggacuucaagccggggaccagcggcagccccaucaucaaccgcgagggcaaggucguggggcuguacggcaacgggguggucacgaagaacggcggguacguguccggcaucgcccagaccaacgccgagcccgacggcccgacccccgagcucgaggaggagauguucaagaagcggaaccugaccaucauggaccugcaccccgggagcggcaagacgcgcaaguaccuccccgccaucgugcgggaggcgaucaagcgccggcugcgcacccugauccucgccccgacccgggucguggccgccgagauggaggaggcccugaaggggcugcccauccgcuaccagaccacggcgaccaaguccgagcacaccggccgggagaucguggaccucaugugccacgccaccuucacgaugcgccugcugagccccguccgggugcccaacuacaaccucaucaucauggacgaggcccacuucaccgacccggccuccaucgccgcgcgcggguacaucagcacccgggugggcaugggcgaggccgccgccaucuucaugaccgcgacgccgcccgggaccgccgacgccuucccccaguccaacgccccgauccaggacgaggagcgcgacauccccgagcgcagcuggaacuccggcaacgaguggaucaccgacuucgccgggaagaccgucugguucgugcccagcaucaaggcgggcaacgacaucgccaacugccugcggaagaacgggaagaaggugauccagcugucccgcaagacguucgacaccgaguaccagaagaccaagcucaacgacugggacuucgucgugaccacggacaucagcgagaugggcgccaacuucaaggccgaccgggugaucgacccccgccggugccugaagccggucauccugaccgacggccccgagcgcgugauccucgccgggcccaugcccgugaccgcggccuccgccgcccagcggcgcggccgggucgggcgcaacccgcagaaggagaacgaccaguacaucuucaccggccagccccugaacaacgacgaggaccacgcccacuggaccgaggcgaagaugcugcucgacaacaucaacacgcccgaggggaucauccccgcccuguucgagccggagcgggagaaguccgccgccaucgacggcgaguaccgccugaagggcgagucccggaagaccuucguggagcucaugcgccgcggggaccugcccgucuggcuggcgcacaagguggccagcgagggcaucaaguacaccgaccgcaaguggugcuucgacgggcagcggaacaaccagauccucgaggagaacauggacguggagaucuggaccaaggagggcgagaagaagaagcugcgcccccgguggcuggacgcccgcacguacuccgacccccucgcccugaaggaguucaaggacuucgccgcgggccgcaagagcaucgcccuggaccucgucaccgagaucgggcgggugccgucccaccuggcccaccgcacccggaacgcccuggacaaccucgugaugcugcacaccagcgagcacggcgggaaggccuaccgccacgcggucgaggagcugcccgagacgauggagacccuccugcugcucggccugaugauccugcucaccgggggcgccaugcuguuccugaucagcggcaaggggaucggcaagaccuccaucgggcucaucugcgugaucgccagcuccggcaugcuguggauggccgagaucccccugcaguggaucgccagcgcgaucgugcucgaguucuucaugaugguccugcugaucccggagcccgagaagcagcggacgccccaggacaaccagcucgccuacguggugaucgggauccugacccuggccgccaucaucgccgcgaacgagaugggccuccuggagaccaccaagcgcgaccugggcauguccaaggagcccggggucgugagcccgacguccuaccucgacguggaccugcaccccgccagcgccuggacccuguacgccgucgcgaccaccgugaucacgcccaugcuccggcacaccaucgagaacuccaccgccaacgugagccuggccgccaucgccaaccaggcggucgugcugaugggccucgacaagggguggcccaucuccaagauggaccugggcgugccgcugcucgcccuggggugcuacagccaggucaacccccugacccucacggccgccgugcugcugcucaucacccacuacgccaucaucggccccggccugcaggcgaaggccacccgcgaggcccagaagcggaccgccgccgggaucaugaagaaccccacgguggacggcaucaugaccaucgaccuggacccggucaucuacgacuccaaguucgagaagcagcucggccaggugaugcugcuggugcucugcgcgguccagcugcugcucaugcgcaccagcugggcccugugcgaggcccugacccucgccacgggccccaucaccacccugugggagggcucccccgggaaguucuggaacaccacgaucgcggugagcauggccaacaucuuccggggcuccuaccuggccggggccggccucgccuucagcaucaugaaguccguggggaccggcaagcgcggcaccgggagccagggcgagacccugggggagaaguggaagaagaagcugaaccagcucagccggaaggaguucgaccuguacaagaaguccggcaucaccgaggucgaccgcacggaggcgaaggaggggcugaagcggggcgagaucacccaccacgccgugagccgcggcuccgccaagcuccagugguucguggagcggaacauggucauccccgaggggcgcgugaucgaccugggcugcgggcggggcggguggagcuacuacugcgccggccugaagaaggugaccgagguccgcggcuacaccaagggcgggccggggcacgaggagcccgugcccauguccacguacggcuggaacaucgugaagcucaugagcgggaaggacgucuucuaccugcccccggagaagugcgacacccugcugugcgacaucggcgaguccagccccucccccaccguggaggagagccggaccauccgcgugcucaagauggucgagcccuggcugaagaacaaccaguucugcaucaaggugcugaacccguacaugcccacgguggucgagcaccucgagcgccugcagcggaagcacggcgggaugcuggugcgcaacccccucucccggaacagcacccacgagauguacuggaucuccaacggcaccgggaacaucguggccagcgucaacauggugucccgccugcugcucaaccgguucaccaugacgcaccgccggcccaccaucgagaaggacguggaccugggcgcgggcacccgccacgucaacgccgagccggagacccccaacauggacgugaucggggagcggaucaagcgcaucaaggaggagcacaacagcacguggcacuacgacgacgagaaccccuacaagaccugggccuaccacggcuccuacgaggucaaggccaccgggagcgccuccagcaugaucaacggcguggugaagcugcucaccaagccgugggacgucgugcccauggugacgcagauggcgaugaccgacaccacccccuucgggcagcagcgggucuucaaggagaagguggacacgcgcacgccccggagcaugccgggcacccgccgggugaugggcaucaccgccgaguggcuguggcgcacccuggggcggaacaagaagccccgccucugcacccgggaggaguucaccaagaagguccgcaccaacgccgccaugggcgcgguguucacggaggagaaccagugggacuccgccaaggccgccguggaggacgaggacuucuggaagcuggucgaccgcgagcgggagcugcacaagcucgggaagugcggcagcugcguguacaacaugauggggaagcgcgagaagaagcugggcgaguucggcaaggccaaggggucccgggcgaucugguacauguggcugggcgcccgcuaccucgaguucgaggcccugggguuccugaacgaggaccacugguucagccgggagaacuccuacagcggcguggagggggagggccuccacaagcugggcuacauccugcgcgacaucuccaagauccccgggggcgccauguacgccgacgacaccgcggggugggacacccggaucaccgaggacgaccuccacaacgaggagaagaucacgcagcagauggaccccgagcaccgccagcuggccaacgccaucuucaagcugaccuaccagaacaaggucgugaaggugcagcggccgacccccaccggcaccgucauggacaucaucagccgcaaggaccagcggggcuccggccaggugggcacguacgggcucaacaccuucaccaacauggaggcccagcugauccgccagauggagggcgagggggugcugagcaaggccgaccucgagaacccccggcugcccgagaagaagaucacccaguggcuggagacgaagggcgucgagcgccucaagcggauggcgaucuccggcgacgacugcguggugaagccgaucgacgaccgcuucgccaacgcccugcuggcccucaacgacauggggaagguccggaaggacaucccccaguggcagcccagcaagggcuggcacgacuggcagcagguccccuucugcucccaccacuuccacgagcugaucaugaaggacgggcgcaagcugguggucccgugccggccccaggacgagcucaucggccgcgcccggaucagccagggggcgggcuggucccugcgcgagaccgccugccugggcaaggccuacgcccagauguggagccucauguacuuccaccgccgggaccugcgccuggcguccaacgccaucugcagcgccgugcccgugcacuggguccccaccucccggaccacguggagcauccacgcccaccaccaguggaugaccaccgaggacaugcucaccguguggaaccgcguguggaucgaggacaacccguggauggaggacaagacgcccgucaccaccugggagaacgugcccuaccuggggaagcgggaggaccaguggugcggcagccugaucgggcucaccucccgcgccacgugggcgcagaacauccccaccgccauccagcagguccggagccugaucggcaacgaggaguuccuggacuacaugccguccaugaagcgcuuccggaaggaggaggagagcgagggggccaucugguga

SEQ ID NO: 10273 - RNA, 9873 nt, Artificial Sequence
  derived and/or modified CDS sequence (opt1) from DENV-3__KF955479__SS-prME
accagccugugccucaugaugauccugcccgccgcccuggcguuccaccucaccagccgggacggggagccgcggaugaucguggggaagaacgagcggggcaagagccugcuguucaagacggccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagcuucaucgaggugaagaccugcacguggccgaagucccacacccuguggagcaacggcgugcucgaguccgacaugaucauccccaagagccuggccgggcccaucucccagcacaacuaccggccgggcuaccacacccagaccgccgggcccuggcaccugggcaagcucgagcuggacuucaacuacugcgagggcacgaccgucgugaucaccgagaacugcgggacccgcggccccagccugcggacgaccaccguguccgggaagcucauccacgaguggugcugccgcagcugcacccugcccccgcugcgguacaugggcgaggacgggugcugguacggcauggagauccgccccaucuccgagaaggaggagaacauggucaagagccucguguccgccggcagcggggagguggacaacuucacgaugggcguccugugccuggccauccucuucgaggaggugaugcgggggaaguucggcaagaagcacaugaucgcggggguguucuucaccuucguccugcugcucuccggccagaucaccuggcgcgacauggcccacacccugaucaugaucggcagcaacgccuccgaccggauggggaugggcgugacguaccuggcccucaucgccaccuucaagauccagcccuuccuggcgcugggguucuuccuccgcaagcugaccagccgggagaaccugcuccugggcgugggccuggccauggccaccacgcuccagcugcccgaggacaucgagcagauggccaacgggaucgcgcugggccucauggcccugaagcugaucacccaguucgagaccuaccagcucuggaccgcccugaucagccugacgugcuccaacaccaucuucacccucaccgucgccuggcgcacggccacccugauccuggcgggggugagccuccugccggucugccaguccagcuccaugcggaagaccgacuggcugcccaugaccguggccgccaugggcgugccgccccucccgcuguucaucuucagccugaaggacacgcucaagcgccgcuccuggccccugaacgagggggucauggccgugggccuggugagcauccucgccuccagccugcugcggaacgacguccccauggcgggcccccucguggccgggggccugcugaucgccugcuacgugaucaccgggaccuccgccgaccucaccgucgagaaggccgcggacgugacgugggaggaggaggccgagcagaccggcgugagccacaaccugaugaucaccgucgacgacgacgggaccaugcgcaucaaggacgacgagaccgagaacauccugacggugcuccugaagaccgcccugcucaucguguccggcaucuucccguacagcauccccgccacccugcuggucuggcacaccuggcagaagcagacgcagcgguccggcgugcucugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccugaccuacaacgggaagcgccucgagcccaacugggccuccgugaagaaggaccugaucagcuacggcgggggcuggcggcuguccgcccaguggcagaagggggaggaggugcaggucaucgccguggagcccggcaagaaccccaagaacuuccagaccaugcccggcaccuuccagacgaccaccggggagaucggcgcgaucgcccucgacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccugaccaucauggaccuccaccccgggagcggcaagacgcgcaaguaccugccggccaucgugcgggaggcgaucaagcgccggcugcgcacccucauccuggcccccacccggguggucgccgccgagauggaggaggcccugaaggggcuccccauccgcuaccagaccacggcgaccaaguccgagcacaccggccgggagaucguggaccugaugugccacgccaccuucacgaugcgccugcucagccccgugcgggucccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucguccccagcaucaaggcgggcaacgacaucgccaacugccugcggaagaacgggaagaaggugauccagcucucccgcaagacguucgacaccgaguaccagaagaccaagcugaacgacugggacuucguggucaccacggacaucagcgagaugggcgccaacuucaaggccgaccgggugaucgacccgcgccggugccugaagcccgugauccucaccgacggccccgagcgcgucauccuggccgggcccaugccggugaccgcggccuccgccgcccagcggcgcggccggguggggcgcaacccccagaaggagaacgaccaguacaucuucaccggccagccccugaacaacgacgaggaccacgcccacuggaccgaggcgaagaugcuccuggacaacaucaacacgcccgaggggaucaucccggcccuguucgagcccgagcgggagaaguccgccgccaucgacggcgaguaccgccucaagggcgagucccggaagaccuucgucgagcugaugcgccgcggggaccugcccguguggcucgcgcacaaggucgccagcgagggcaucaaguacaccgaccgcaaguggugcuucgacgggcagcggaacaaccagauccuggaggagaacauggacguggagaucuggaccaaggagggcgagaagaagaagcugcgcccccgguggcucgacgcccgcacguacuccgacccgcuggcccugaaggaguucaaggacuucgccgcgggccgcaagagcaucgcccucgaccuggugaccgagaucgggcggguccccucccaccuggcccaccgcacccggaacgcccucgacaaccuggugaugcugcacaccagcgagcacggcgggaaggccuaccgccacgcgguggaggagcuccccgagacgauggagacccugcugcuccugggccugaugauccuccugaccgggggcgccaugcuguuccucaucagcggcaaggggaucggcaagaccuccaucgggcugaucugcgucaucgccagcuccggcaugcuguggauggccgagaucccgcuccaguggaucgccagcgcgaucgugcuggaguucuucaugauggugcugcucauccccgagcccgagaagcagcggacgccccaggacaaccagcuggccuacgucgugaucgggauccugacccucgccgccaucaucgccgcgaacgagaugggccugcuggagaccaccaagcgcgaccucggcauguccaaggagccggggguggucagccccacguccuaccuggacguggaccugcaccccgccagcgccuggacccucuacgccguggcgaccaccgucaucacgcccaugcugcggcacaccaucgagaacuccaccgccaacgugagccuggccgccaucgccaaccaggcggugguccucaugggccuggacaagggguggccgaucuccaagauggaccugggcgugccccuccuggcccuggggugcuacagccaggugaacccccucacccugacggccgccguccugcuccugaucacccacuacgccaucaucggccccggccugcaggcgaaggccacccgcgaggcccagaagcggaccgccgccgggaucaugaagaacccgacgguggacggcaucaugaccaucgaccucgaccccgugaucuacgacuccaaguucgagaagcagcuggggcaggucaugcugcucgugcugugcgcggugcagcugcuccugaugcgcaccagcugggcccugugcgaggcccucacccuggccacgggccccaucaccacccugugggagggcucccccgggaaguucuggaacaccacgaucgcggucagcauggccaacaucuuccggggcuccuaccucgccggggccggccuggccuucagcaucaugaaguccguggggaccggcaagcgcggcaccgggagccagggcgagacccugggggagaaguggaagaagaagcucaaccagcugagccggaaggaguucgaccuguacaagaaguccggcaucaccgagguggaccgcacggaggcgaaggaggggcucaagcggggcgagaucacccaccacgccgucagccgcggcuccgccaagcugcagugguucguggagcggaacauggugaucccggaggggcgcgucaucgaccugggcugcgggcggggcggguggagcuacuacugcgccggccucaagaaggugaccgaggugcgcggcuacaccaagggcgggcccgggcacgaggagcccguccccauguccacguacggcuggaacaucgugaagcugaugagcgggaaggacguguucuaccugccgcccgagaagugcgacacccuccugugcgacaucggcgaguccagccccucccccaccgucgaggagagccggaccauccgcgugcugaagaugguggagccguggcugaagaacaaccaguucugcaucaagguccucaaccccuacaugcccacggugaucgagcaccuggagcgccugcagcggaagcacggcgggaugcucgugcgcaacccccugucccggaacagcacccacgagauguacuggaucuccaacggcaccgggaacaucgucgccagcgugaacauggugucccgccugcuccugaaccgguucaccaugacgcaccgccggccgaccaucgagaaggacgucgaccugggcgcgggcacccgccacgugaacgccgagcccgagacccccaacauggacgugaucggggagcggaucaagcgcaucaaggaggagcacaacagcacguggcacuacgacgacgagaacccguacaagaccugggccuaccacggcuccuacgaggucaaggccaccgggagcgccuccagcaugaucaacggcguggucaagcuccugaccaagcccugggacguggugcccaucgucacgcagauggcgaugaccgacaccacccccuucgggcagcagcggguguucaaggagaagguggacacgcgcaccccgcggagcaugcccggcacccgccgggucaugggcaucaccgccgaguggcuguggcgcacgcucgggcggaacaagaagccccgccugugcacccgggaggaguucaccaagaaggugcgcaccaacgccgccaugggcgcgguguucacggaggagaaccagugggacuccgccaaggccgccgucgaggacgaggacuucuggaagcugguggaccgcgagcgggagcuccacaagcuggggaagugcggcagcugcguguacaacaugauggggaagcgcgagaagaagcugggcgaguucggcaaggccaaggggucccgggcgaucugguacauguggcucggcgcccgcuaccuggaguucgaggcccugggguuccucaacgaggaccacugguucagccgggagaacuccuacagcggcgucgagggggagggccugcacaagcugggcuacauccuccgcgacaucuccaagauccccgggggcgccauguacgccgacgacaccgcggggugggacacccggaucaccgaggacgaccugcacaacgaggagaagaucacgcagcagauggacccggagcaccgccagcuggccaacgccaucuucaagcucaccuaccagaacaagguggugaagguccagcggcccacccccaccggcaccgugauggacaucaucagccgcaaggaccagcggggcuccggccaggugggcacguacgggcugaacaccuucaccaacauggaggcccagcugauccgccagauggagggcgaggggguccucagcaaggccgaccuggagaacccccaccuccccgagaagaagaucacccaguggcuggagacgaagggcguggagcggcugaagcgcauggcgaucuccggcgacgacugcguggucaagcccaucgacgaccgguucgccaacgcccugcucgcccugaacgacauggggaaggugcgcaaggacaucccccaguggcagcccagcaagggcuggcacgacuggcagcaggucccguucugcucccaccacuuccacgagcugaucaugaaggacgggcggaagcucgucgugcccugccgcccccaggacgagcugaucggccgggcccgcaucagccagggggcgggcuggucccugcgggagaccgccugccucggcaaggccuacgcccagauguggagccugauguacuuccaccgccgcgaccugcggcucgcguccaacgccaucugcagcgccgugcccguccacugggugccgaccucccgcaccacguggagcauccacgcccaccaccaguggaugaccaccgaggacaugcugaccguguggaaccgggucuggaucgaggacaaccccuggauggaggacaagacgcccgugaccaccugggagaacgugcccuaccuggggaagcgcgaggaccaguggugcggcagccucaucgggcugaccucccgggccacgugggcgcagaacaucccgaccgccauccagcagguccgcagccugaucggcaacgaggaguuccucgacuacaugcccuccaugaagcgguuccgcaaggaggaggagagcgagggggccaucugguga

SEQ ID NO: 10274 - RNA, 9873 nt, Artificial Sequence
  derived and/or modified CDS sequence (opt1) from DENV-3__FJ850109__SS-prME
accagccugugccucaugaugauccugcccgccgcccuggcguuccaccucaccucccgggacggcgagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaccggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggcgacccuccggaagcugugcaucgagggcaagaucaccaacaucaccacggacagccgcugccccacccagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacacggugaucaucaccguccacaccggggaccagcaccaggugggcaacgagacccagggggucacggccgagaucacgccccaggccagcaccaccgaggcgauccugcccgaguacggcacccuggggcucgagugcuccccgcgcacgggccuggacuucaacgagaugauccugcucaccaugaagaacaaggccuggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgucccgugcaagauccccuucagcacggaggacgggcagggcaaggcgcacaacggccgccugaucaccgccaaccccguggugaccaagaaggaggagcccgucaacaucgaggccgagccgcccuucggggagagcaacaucgugaucggcaucggggacaacucccugaagaucaacugguacaagaagggcagcuccaucgggaagauguucgaggccaccgcgcggggcgcccgccggauggccauccugggcgacacggccugggacuucgggagcgugggcgggguccucaacucccugggcaagauggugcaccagaucuucgggagcgccuacaccgcgcuguucuccggcgugagcugggucaugaagaucggcaucggggugcuccugaccuggaucggccugaacuccaagaacaccagcauguccuucagcugcaucgccaucgggaucaucacgcucuaccugggcgccgugguccaggccgacaccgggugcgugaucaacuggaagggcaaggagcugaagugcggcuccgggaucuucgugaccaacgagguccacaccuggacggagcaguacaaguuccaggccgacagccccaagcgccucgcgaccgccaucgccggcgccugggagaacggggugugcggcauccgcuccaccacccggauggagaaccugcuguggaagcagaucgccaacgagcucaacuacauccugugggagaacaacaucaagcugacgguggucgugggggacaucaucggcgugcucgagcagggcaagcgcacccugacgccccagccgauggagcugaaguacagcuggaagaccugggggaaggcgcggaucgucacggccgagacccagaacuccagcuucaucaucgacggccccaacacccccgagugccccaacaccucccgcgccuggaacgugugggagguggaggacuacggguucggcgucuucaccacgaacaucuggcucaagcugcgggagguguacacccagcugugcgaccaccgccucaugagcgccgcggugaaggacgagcgggccguccacgccgacaugggcuacuggaucgagagccagaagaacggguccuggaagcuggagaaggccagccugaucgaggugaagaccugcaccuggccgaagucccacacgcucuggagcaacggcgugcuggaguccgacaugaucauccccaagagccuggccgggcccaucucccagcacaacuaccgcccgggcuaccacacccagaccgcggggcccuggcaccucggcaagcuggagcuggacuucaacuacugcgagggcaccacggucgugaucaccgagaacugcgggacccggggccccagccuccgcaccacgaccguguccgggaagcugauccacgaguggugcugccggagcugcacccugcccccgcuccgcuacaugggcgaggacgggugcugguacggcauggagauccggcccaucuccgagaaggaggagaacauggucaagagccugguguccgccggcagcggggagguggacaacuucaccaugggcguccugugccucgccauccuguucgaggaggugaugcgcgggaaguucggcaagaagcacaugaucgccgggguguucuucacguucguccugcuccuguccggccagaucaccuggcgggacauggcccacacccugaucaugaucggcagcaacgcgaccgaccgcauggggaugggcgugacguaccucgcccugaucgccaccuucaagauccagcccuuccuggcccucggguucuuccugcggaagcugaccucccgcgagaaccuccugcugggcgugggccucgccauggcgaccacgcugcagcugcccgaggacaucgagcagauggccaacgggaucgcccucggccugauggcccugaagcucaucacccaguucgagaccuaccagcuguggaccgcgcugaucagccucacgugcagcaacaccaucuucacccugaccgucgccuggcggacggccacccugauccucgccggggugucccugcugccggucugccagagcuccagcaugcgcaagaccgacuggcuccccaugaccguggccgcgaugggcgugccgccccucccgcuguucaucuucucccucaaggacacgcugaagcgccggagcuggccccugaacgagggggucauggccgugggccucguguccauccuggccagcucccugcuccgcaacgacguccccauggccggcccccugguggccgggggccugcucaucgcgugcuacgugaucaccgggaccagcgccgaccugaccgucgagaaggccgccgacgugaccugggaggaggaggccgagcagacgggcgugucccacaaccugaugaucaccgucgacgacgacgggaccaugcggaucaaggacgacgagaccgagaacauccucacggugcugcugaagaccgcgcuccugaucgugagcggcaucuucccguacuccauccccgccacccugcucgucuggcacaccuggcagaagcagacgcagcgcagcggcgugcugugggacgugcccagcccgcccgagacccagaaggccgagcuggaggagggggucuaccggaucaagcagcagggcaucuucgggaagacccaggugggcguggggguccagaaggagggcguguuccacaccauguggcacgugacgcgcggcgccguccucaccuacaacgggaagcggcuggagcccaacugggccagcgugaagaaggaccugaucuccuacggcgggggcuggcgccucagcgcgcaguggcagaagggggaggaggugcaggucaucgccguggagcccggcaagaaccccaagaacuuccagaccaugcccggcaccuuccagacgaccaccggggagaucggcgccaucgcccuggacuucaagcccgggaccuccggcagccccaucaucaaccgggagggcaagguggucgggcuguacggcaacgggguggugacgaagaacggcggguacgucagcggcaucgcgcagaccaacgccgagccggacggccccacccccgagcuggaggaggagauguucaagaagcgcaaccucaccaucauggaccugcaccccggguccggcaagacgcggaaguaccugccggccaucgugcgcgaggccaucaagcggcgccuccggacccugauccuggcccccacccgcguggucgcggccgagauggaggaggcccucaaggggcugcccauccgguaccagaccacggccaccaagagcgagcacaccggccgcgagaucguggaccugaugugccacgccaccuucacgaugcggcuccugucccccgugcgcgucccgaacuacaaccugaucaucauggacgaggcgcacuucaccgaccccgccagcaucgccgcccggggguacaucuccacccgcgugggcaugggcgaggccgcggccaucuucaugaccgccacgccgcccgggaccgccgacgcguucccgcagagcaacgcccccauccaggacgaggagcgcgacauccccgagcgguccuggaacagcggcaacgaguggaucaccgacuucgccgggaagaccgugugguucguccccuccaucaaggccggcaacgacaucgccaacugccuccgcaagaacgggaagaaggugauccagcugagccggaagacguucgacaccgaguaccagaagaccaagcugaacgacugggacuucguggucaccaccgacaucuccgagaugggcgcgaacuucaaggccgaccgcgugaucgacccgcggcgcugccucaagcccgugauccugacggacggccccgagcgggucauccuggccgggcccaugccggugaccgccgccagcgcggcccagcgccggggccgcguggggcggaacccccagaaggagaacgaccaguacaucuucaccggccagccccucaacaacgacgaggaccacgcccacuggaccgaggccaagaugcugcuggacaacaucaacacgcccgaggggaucaucccggcccucuucgagcccgagcgcgagaaguccgcggccaucgacggcgaguaccggcugaagggcgagagccgcaagaccuucgucgagcugaugcggcgcggggaccuccccguguggcuggcccacaaggucgccuccgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcgcgcacguacagcgacccgcuggcccucaaggaguucaaggacuucgccgccggccggaaguccaucgcccuggaccuggugaccgagaucgggcgcguccccacccaccucgcgcaccggacccgcaacgcccuggacaaccuggugaugcuccacacgagcgagcacggcgggaaggccuaccggcacgccguggaggagcugcccgagaccauggagacccugcuccugcugggccucaugauccugcugaccgggggcgccaugcuguuccugaucuccggcaaggggaucggcaagacgagcaucgggcugaucugcgucaucgcgagcuccggcaugcucuggauggccgagaucccgcugcaguggaucgccagcgccaucgugcuggaguucuucaugauggugcuccugauccccgagcccgagaagcagcgcacgccccaggacaaccagcuggccuacgucgugaucgggauccucacccuggcggccaucaucgccgccaacgagaugggccugcucgagaccacgaagcgggaccugggcauguccaaggagccggggguggucagccccaccuccuaccuggacguggaccuccaccccgccagcgcguggacccuguacgccguggccaccacggucaucacccccaugcugcgccacaccaucgagaacuccaccgccaacgugagccucgcggccaucgccaaccaggccgugguccugaugggccuggacaagggguggccgaucuccaagauggaccucggcgugccccugcuggcccucgggugcuacagccaggugaacccccugacgcugaccgcggccguccuccugcugaucacccacuacgccaucaucggccccggccuccaggccaaggccacccgggaggcgcagaagcgcacggccgccgggaucaugaagaacccgaccguggacggcaucaugaccaucgaccuggaccccgugaucuacgacuccaaguucgagaagcagcuggggcaggucaugcuccuggugcugugcgccgugcagcuccugcugaugcggaccagcugggcccucugcgaggcgcugacgcuggccaccggccccaucaccacccucugggagggcucccccgggaaguucuggaacaccacgaucgccgucagcauggccaacaucuuccgcggcuccuaccuggcgggggccggccuggccuucagcaucaugaaguccguggggaccggcaagcggggcaccgggagccagggcgagacccucggggagaaguggaagaagaagcugaaccagcugucccgcaaggaguucgaccucuacaagaaguccggcaucacggagguggaccggaccgaggccaaggaggggcugaagcgcggcgagaucacccaccacgccgucagccggggcuccgcgaagcugcagugguucguggagcgcaacauggugaucccggaggggcgggucaucgaccucggcugcgggcgcggcggguggagcuacuacugcgccggccugaagaaggugaccgaggugcggggcuacacgaagggcgggcccgggcacgaggagcccguccccauguccaccuacggcuggaacaucgugaagcugaugagcgggaaggacguguucuaccucccgcccgagaagugcgacacccugcugugcgacaucggcgaguccagccccucccccaccgucgaggagagccgcacgauccgcgugcugaagaugguggagccguggcucaagaacaaccaguucugcaucaagguccugaaccccuacaugcccgccgugaucgagcaccuggagcggcuccagcgcaagcacggcgggaugcuggugcggaacccccugucccgcaacagcacccacgagauguacuggaucuccaacggcaccgggaacaucgucgccagcgugaacauggugucccggcuccugcugaaccgcuucaccaugacgcaccggcgcccgaccaucgagaaggacgucgaccucggcgccggcacccggcacgugaacgcggagcccgagacccccaacauggacgugaucggggagcgcaucaagcggaucaaggaggagcacaacagcacguggcacuacgacgacgagaacccguacaagaccugggccuaccacggcuccuacgaggucaaggccaccgggagcgccuccagcaugaucaacggcguggucaagcugcugaccaagcccugggacguggugcccauggucauccagauggccaugacggacaccacccccuucgggcagcagcgcguguucaaggagaagguggacacccggacgccgcgcuccaugcccggcacccggcgcgucauggagaucaccgcggaguggcucuggcggacccugggccgcaacaagaagccccggcugugcacgcgcgaggaguucaccaagaaggugcgcaccaacgccgccaugggggccguguucaccgaggagaaccagugggacagcgcgaaggccgccgucgaggacgaggacuucuggaagcucguggaccgggagcgcgagcugcacaagcugggcaagugcgggagcugcguguacaacaugaugggcaagcgggagaagaagcucggggaguucggcaaggccaagggcucccgcgccaucugguacauguggcugggggcgcgguaccuggaguucgaggcccucggcuuccugaacgaggaccacugguucagccgcgagaacuccuacagcggggucgagggcgaggggcugcacaagcucggcuacauccugcgggacaucuccaagauccccggcggggccauguacgccgacgacacggccggcugggacacccgcaucaccgaggacgaccugcacaacgaggagaagaucacccagcagauggacccggagcaccggcagcucgcgaacgccaucuucaagcugaccuaccagaacaagguggugaagguccagcgccccacgcccaccgggaccgugauggacaucaucagccggaaggaccagcgcggcuccggccagguggggaccuacggccugaacacguucaccaacauggaggcccagcucauccggcagauggagggggagggcguccugagcaaggccgaccuggagaacccccaccucccggagaagaagaucacccaguggcuggagaccaaggggguggagcgccugaagcggauggccaucuccggcgacgacugcguggucaagcccaucgacgaccgcuucgcgaacgcccuccuggcccugaacgacaugggcaaggugcggaaggacaucccccaguggcagcccagcaagggguggcacgacuggcagcaggucccguucugcucccaccacuuccacgagcucaucaugaaggacggccgcaagcuggucgugcccugccggccccaggacgagcugaucgggcgcgcccggaucagccagggcgccggguggucccuccgcgagacggcgugccugggcaaggccuacgcccagauguggagccugauguacuuccaccgccgggaccuccgccuggccuccaacgcgaucugcagcgccgugcccguccacugggugccgaccucccggaccaccuggagcauccacgcccaccaccaguggaugacgaccgaggacaugcugaccguguggaaccgcgucuggaucgaggacaaccccuggauggaggacaagacccccgugacgaccugggagaacgugcccuaccucggcaagcgggaggaccaguggugcgggucccugaucggccugaccagccgcgccaccugggcccagaacaucccgacggcgauccagcagguccggagccucaucgggaacgaggaguuccuggacuacaugcccuccaugaagcgcuuccggaaggaggaggagagcgagggcgccaucugguga

SEQ ID NO: 10275 - RNA, 9873 nt, Artificial Sequence
  derived and/or modified CDS sequence (opt1) from DENV-3__GQ868586__SS-prME
accagccugugccucaugaugauccugcccgccgcccuggcguuccaccucaccagccgggacggcgagccgcggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggacuacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacacggggugcgugaucaacuggaagggcaaggagcugaagugcggcagcgggaucuucgugaccaacgagguccacaccuggaccgagcaguacaaguuccaggcggacucccccaagcgccucgccacggccaucgccggcgccugggagaacggggugugcggcauccgcagcaccacccggauggagaaccugcuguggaagcagaucgcgaacgagcucaacuacauccugugggagaacaacaucaagcugaccguggucgugggggacaucaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgccucccgggcguggaacgugugggagguggaggacuacggguucggcgucuucaccaccaacaucuggcucaagcugcgcgagguguacacccagcagugcgaccaccggcugaugagcgccgccgugaaggacgagcgcgccguccacgccgacaugggcuacuggaucgagagccagaagaacggguccuggaagcucgagaaggcgagccugaucgaggugaagacgugcaccuggccgaagucccacacccuguggagcaacggcgugcucgaguccgacaugaucauccccaagagccuggccgggcccaucucccagcacaacuaccggccgggcuaccacacccagacggccgggcccuggcaccugggcaagcucgagcuggacuucaacuacugcgagggcaccaccgucgugaucaccgagaacugcgggacgcgcggccccagccugcggaccaccaccguguccgggaagcucauccacgaguggugcugccgcagcugcacgcugcccccgcugcgguacaugggcgaggacgggugcugguacggcauggagauccgccccaucuccgagaaggaggagaacauggucaagagccucguguccgccggcagcggggagguggacaacuucaccaugggcguccugugccuggccauccucuucgaggaggugaugcgggggaaguucggcaagaagcacaugaucgcggggguguucuucaccuucguccugcugcucuccggccagaucaccuggcgcgacauggcccacacgcugaucaugaucggcagcaacgccuccgaccggauggggaugggcgugaccuaccuggcccucaucgccaccuucaagauccagcccuuccuggcgcugggguucuuccuccgcaagcugaccagccgggagaaccugcuccugggcgugggccuggccauggccacgacccuccagcugcccgaggacaucgagcagauggccaacgggaucgcgcugggccucauggcccugaagcugaucacccaguucgagaccuaccagcucuggacggcccugaucagccugaccugcuccaacaccaucuucacccucacggucgccuggcgcaccgccacccugauccuggcgggggugagccuccugccggucugccaguccagcuccaugcggaagaccgacuggcugcccaugacgguggccgccaugggcgugccgccccucccgcuguucaucuucagccugaaggacacccucaagcgccgcuccuggccccugaacgagggggucauggccgugggccuggugagcauccucgccuccagccugcugcggaacgacguccccauggcgggcccccucguggccgggggccugcugaucgccugcuacgugaucaccgggaccuccgccgaccucacggucgagaaggccgcggacgugaccugggaggaggaggccgagcagaccggcgugagccacaaccugaugaucaccgucgacgacgacgggaccaugcgcaucaaggacgacgagacggagaacauccugaccgugcuccugaagaccgcccugcucaucguguccggcaucuucccguacagcauccccgccacccugcuggucuggcacacguggcagaagcagacccagcgguccggcgugcucugggacgugcccagcccgcccgagacccagaaggccgagcuggaggagggggucuaccgcaucaagcagcagggcaucuucgggaagacccaggugggcguggggguccagaaggagggcguguuccacacgauguggcacgugacccggggcgcgguccugaccuacaacgggaagcgccucgagcccaacugggccuccgugaagaaggaccugaucagcuacggcgggggcuggcggcuguccgcccaguggcagaagggggaggaggugcaggucaucgccguggagcccggcaagaaccccaagaacuuccagaccaugcccggcacguuccagaccaccaccggggagaucggcgcgaucgcccucgacuucaagcccgggacgagcggcagccccaucaucaaccgcgagggcaagguggucgggcuguacggcaacgggguggugaccaagaacggcggguacgucuccggcaucgcccagaccaacgccgagccggacggccccacccccgagcuggaggaggagauguucaagaagcggaaccugacgaucauggaccuccaccccgggagcggcaagacccgcaaguaccugccggccaucgugcgggaggcgaucaagcgccggcugcgcacccucauccuggcccccacccggguggucgccgccgagauggaggaggcccugaaggggcuccccauccgcuaccagacgaccgcgaccaaguccgagcacaccggccgggagaucguggaccugaugugccacgccacguucaccaugcgccugcucagccccgugcgggucccgaacuacaaccugaucaucauggacgaggcccacuucaccgaccccgccuccaucgccgcgcgcggguacaucagcacccgggugggcaugggcgaggccgccgccaucuucaugacggcgacgccgcccgggaccgccgacgccuucccgcaguccaacgcccccauccaggacgaggagcgcgacauccccgagcgcagcuggaacuccggcaacgaguggaucaccgacuucgccgggaagacggugugguucguccccagcaucaaggcgggcaacgacaucgccaacugccugcggaagaacgggaagaaggugauccagcucucccgcaagaccuucgacaccgaguaccagaagaccaagcugaacgacugggacuucguggucacgaccgacaucagcgagaugggcgccaacuucaaggccgaccgggugaucgacccgcgccggugccugaagcccgugauccucaccgacggccccgagcgcgucauccuggccgggcccaugccggugaccgcggccuccgccgcccagcggcgcggccggguggggcgcaacccccagaaggagaacgaccaguacaucuucaccggccagccccugaacaacgacgaggaccacgcccacuggacggaggcgaagaugcuccuggacaacaucaacacccccgaggggaucaucccggcccuguucgagcccgagcgggagaaguccgccgccaucgacggcgaguaccgccucaagggcgagucccggaagaccuucgucgagcugaugcgccgcggggaccugcccguguggcucgcgcacaaggucgccagcgagggcaucaaguacaccgaccgcaaguggugcuucgacgggcagcggaacaaccagauccuggaggagaacauggacguggagaucuggacgaaggagggcgagaagaagaagcugcgcccccgguggcucgacgcccgcaccuacuccgacccgcuggcccugaaggaguucaaggacuucgccgcgggccgcaagagcaucgcccucgaccuggugaccgagaucgggcggguccccucccaccuggcccaccgcacccggaacgcccucgacaaccuggugaugcugcacacgagcgagcacggcgggaaggccuaccgccacgcgguggaggagcuccccgagaccauggagacccugcugcuccugggccugaugauccuccugaccgggggcgccaugcuguuccucaucagcggcaaggggaucggcaagacguccaucgggcugaucugcgucaucgccagcuccggcaugcuguggauggccgagaucccgcuccaguggaucgccagcgcgaucgugcuggaguucuucaugauggugcugcucauccccgagcccgagaagcagcggacgccccaggacaaccagcuggccuacgucgugaucgggauccugacccucgccgccaucaucgccgcgaacgagaugggccugcuggagaccacgaagcgcgaccucggcauguccaaggagccggggguggucagccccaccuccuaccuggacguggaccugcaccccgccagcgccuggacccucuacgccguggcgaccacggucaucacccccaugcugcggcacaccaucgagaacuccaccgccaacgugagccuggccgccaucgccaaccaggcggugguccucaugggccuggacaagggguggccgaucuccaagauggaccugggcgugccccuccuggcccuggggugcuacagccaggugaacccccucacgcugaccgccgccguccugcuccugaucacccacuacgccaucaucggccccggccugcaggcgaaggccacccgcgaggcccagaagcggacggccgccgggaucaugaagaacccgaccguggacggcaucaugaccaucgaccucgaccccgugaucuacgacuccaaguucgagaagcagcuggggcaggucaugcugcucgugcugugcgcggugcagcugcuccugaugcgcaccagcugggcccugugcgaggcccucacgcuggccaccggccccaucaccacccugugggagggcucccccgggaaguucuggaacacgaccaucgcggucagcauggccaacaucuuccggggcuccuaccucgccggggccggccuggccuucagcaucaugaaguccguggggaccggcaagcgcggcaccgggagccagggcgagacccugggggagaaguggaagaagaagcucaaccagcugagccggaaggaguucgaccuguacaagaaguccggcaucacggagguggaccgcaccgaggcgaaggaggggcucaagcggggcgaggucacccaccacgccgugagccgcggcuccgccaagcugcagugguucguggagcggaacauggucaucccggaggggcgcgugaucgaccugggcugcgggcggggcggguggagcuacuacugcgccggccucaagaaggugaccgagguccgcggcuacacgaagggcgggcccgggcacgaggagcccgugcccauguccaccuacggcuggaacaucgugaagcugaugagcgggaaggacgucuucuaccugccgcccgagaagugcgacacccuccugugcgacaucggcgaguccagccccucccccaccguggaggagagccggacgauccgcgugcugaagauggucgagccguggcugaagaacaaccaguucugcaucaaggugcucaaccccuacaugcccaccgugaucgagcaccuggagcgccugcagcggaagcacggcgggaugcucguccgcaacccccugucccggaacagcacccacgagauguacuggaucuccaacggcaccgggaacaucguggccagcgugaacauggucucccgccugcuccugaaccgguucacgaugacccaccgccggccgaccaucgagaaggacguggaccugggcgcgggcacccgccacgugaacgccgagcccgagacgcccaacauggacgucaucggggagcggaucaagcgcaucaaggaggagcacaacagcaccuggcacuacgacgacgagaacccguacaagaccugggccuaccacggcuccuacgaggugaaggccaccgggagcgccuccagcaugaucaacggcgucgugaagcuccugacgaagcccugggacgugguccccauggugacccagauggcgaugaccgacaccacgcccuucgggcagcagcggguguucaaggagaaggucgacacccgcaccccgcggagcaugcccggcacccgccgggugaugggcaucacggccgaguggcuguggcgcacccucgggcggaacaagaagccccgccugugcacccgggaggaguucaccaagaaggugcgcacgaacgccgccaugggcgcggucuucaccgaggagaaccagugggacuccgccaaggccgccguggaggacgaggacuucuggaagcugguggagcgcgagcgggagcuccacaagcuggggaagugcggcagcugcgucuacaacaugauggggaagcgcgagaagaagcugggcgaguucggcaaggccaaggggucccgggcgaucugguacauguggcucggcgcccgcuaccuggaguucgaggcccugggguuccucaacgaggaccacugguucagccgggagaacuccuacagcggcguggagggggagggccugcacaagcugggcuacauccuccgcgacaucuccaagauccccgggggcgccauguacgccgacgacaccgcggggugggacacccggaucacggaggacgaccugcacaacgaggagaagaucacccagcagauggacccggagcacaagcagcuggccaacgccaucuucaagcucaccuaccagaacaagguggucaaggugcagcgccccacccccaccggcacggugauggacaucaucagccggaaggaccagcgcggcuccgggcaggucggcaccuacgggcugaacaccuucaccaacauggaggcccagcugauccggcagauggagggcgagggggugcucagcaaggccgaccuggagaacccccaccuccccgagaagaagaucacgcaguggcuggagaccaagggcguggagcgccugaagcggauggcgaucuccggcgacgacugcgucgugaagcccaucgacgaccgcuucgccaacgcccugcucgcccugaacgacauggggaaggugcggaaggacaucccccaguggcagcccagcaagggcuggcacgacuggcagcaggucccguucugcucccaccacuuccacgagcugaucaugaaggacgggcgcaagcucguggugcccugccggccccaggacgagcugaucggccgcgcccggaucagccagggggcgggcuggucccugcgcgagaccgccugccucgccaaggccuacgcgcagauguggagccugauguacuuccaccggcgcgaccugcgccucgccuccaacgccaucugcagcgccguccccgugcacugggugccgaccucccggacgaccuggagcauccacgcccaccaccaguggaugaccaccgaggacaugcugacggucuggaaccgcguguggaucgaggacaaccccuggauggaggacaagacccccgugaccaccugggagaacguccccuaccugggcaagcgggaggaccaguggugcgggagccucaucggccugacgucccgcgcgaccugggcccagaacaucccgaccgccauccagcagguccggagccugaucgggaacgaggaguuccucgacuacaugcccuccaugaagcgcuuccggaaggaggaggagagcgagggcgccaucugguga

SEQ ID NO: 10276 - RNA, 9873 nt, Artificial Sequence
  derived and/or modified CDS sequence (opt1) from DENV-3__FJ850110__SS-prME
accagccucugccucaugaugauccugcccgcggcgcuggcguuccaccucaccagccgggacggcgagccgcggaugaucguggggaagaacgagcgcggcaagagccugcuguucaagacggccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacacggggugcgugaucaacuggaagggcaaggagcugaagugcggcagcgggaucuucgugaccaacgagguccacaccuggaccgagcaguacaaguuccaggcggacucccccaagcgccucgccacggccaucgccggcgccugggagaacggggugugcggcauccgcagcaccacccggauggagaaccugcuguggaagcagaucgcgaacgagcucaacuacauccugugggagaacaacaucaagcugaccguggucgugggggacaucaucggcgugcucgagcagggcaagcgcacgcugacgccccagccgauggagcugaaguacuccuggaagaccugggggaaggcccggaucgucaccgccgagacgcagaacagcuccuucaucaucgacggccccaacacccccgagugccccaacaccagccgcgccuggaacgugugggagguggaggacuacggguucggcgucuucaccaccaacaucuggcucaagcugcgggagguguacacgcagcugugcgaccaccgccucauguccgcggccgugaaggacgagcgggccguccacgccgacaugggcuacuggaucgagagccagaagaacgggagcuggaagcuggagaaggccucccugaucgaggugaagaccugcaccuggcccaagucccacacccucugguccaacggcgugcuggagagcgacaugaucauccccaagucccuggcggggcccaucagccagcacaacuaccgcccgggcuaccacacgcagaccgccgggcccuggcaccucggcaagcuggagcuggacuucaacuacugcgagggcaccaccgucgugaucacggagaacugcgggacccggggccccucccuccgcaccaccacggugagcgggaagcugauccacgaguggugcugccgguccugcacccugcccccgcuccgcuacaugggcgaggacgggugcugguacggcauggagauccggcccaucaacgagaaggaggagaacauggucaagagccugguguccgccggcagcggggagguggacaacuucaccaugggcguccugugccucgccauccuguucgaggaggugaugcgcgggaaguucggcaagaagcacaugaucgccgggguguucuucaccuucguccugcuccuguccggccagaucacguggcgggacauggcgcacacccugaucaugaucggcagcaacgccaccgaccgcauggggaugggcgugaccuaccucgcccugaucgccacguucaagauccagcccuuccuggcccucggguucuuccugcggaagcugaccucccgcgagaaccuccugcugggcgugggccucgcgauggccaccacccugcagcugcccgaggacaucgagcagauggccaacgggaucgcccucggccugauggcgcugaagcucaucacgcaguucgagaccuaccagcuguggaccgcccugaucagccugaccugcuccaacacgaucuucacccugaccgucgccuggcggaccgccacgcugauccucgccggggugagccugcugccggucugccagagcuccagcaugcgcaagaccgacuggcuccccaugaccguggcggccaugggcgugccgccccucccgcuguucaucuucucccucaaggacacccugaagcgccggagcuggccccugaacgagggggucauggccgugggccucguguccauccuggccagcucccugcuccgcaacgacguccccauggccggcccccugguggccggcgggcugcucaucgccugcuacgugaucacggggaccagcgccgaccugaccgucgagaaggccgccgacgugaccugggaggaggaggcggagcagaccggggugucccacaaccugaugaucacggucgacgacgacgggaccaugcggaucaaggacgacgagaccgagaacauccucaccgugcugcugaagacggcccuccugaucgugagcggcaucuucccguacuccauccccgccacccugcucgucuggcacaccuggcagaagcagacccagcgcagcggcgugcugugggacgugcccagcccgcccgagacgcagaaggccgagcuggaggagggggucuaccggaucaagcagcagggcaucuucgggaagacccaggugggcguggggguccagaaggagggcguguuccacaccauguggcacgugacccgcggcgccguccucacguacaacgggaagcggcuggagcccaacugggcgagcgugaagaaggaccugaucuccuacggcgggggcuggcgccucagcgcccaguggcagaagggggaggaggugcaggucaucgccguggagcccggcaagaaccccaagaacuuccagaccaugcccggcaccuuccagaccacgaccggggagaucggcgccaucgcgcuggacuucaagcccgggaccuccggcagccccaucaucaaccgggagggcaagguggucgggcuguacggcaacgggguggugaccaagaacggcggguacgucuccggcaucgcccagacgaacgccgagccggacggccccacccccgagcuggaggaggagauguucaagaagcgcaaccucaccaucauggaccugcaccccgggagcggcaagacccggaaguaccugccggccaucgugcgcgaggccaucaagcggcgccuccggacgcugauccuggcgcccacccgcguggucgccgccgagauggaggaggcccucaaggggcugcccauccgguaccagaccaccgccaccaagagcgagcacaccggccgcgagaucguggaccugaugugccacgcgaccuucaccaugcggcuccugucccccgugcgcgucccgaacuacaaccugaucaucauggacgaggcccacuucacggaccccgccagcaucgccgcccggggguacaucuccacccgcgugggcaugggcgaggcggccgccaucuucaugaccgccacgccgcccgggacggcggacgccuucccgcagagcaacgcccccauccaggacgaggagcgcgacauccccgagcgguccuggaacagcggcaacgaguggaucaccgacuucgccgggaagaccgugugguucguccccuccaucaaggccggcaacgacaucgcgaacugccuccgcaagaacgggaagaaggugauccagcugagccggaagaccuucgacacggaguaccagaagaccaagcugaacgacugggacuucguggucaccaccgacaucuccgagaugggcgccaacuucaaggccgaccgcgugaucgacccgcggcgcugccucaagcccgugauccugaccgacggccccgagcgggucauccuggccgggcccaugccggugacggccgcgagcgccgcccagcgccggggccgcguggggcggaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgcgagaaguccgccgccaucgacggcgaguaccggcugaagggcgagagccgcaagacguucgucgagcugaugcggcgcggggaccuccccguguggcuggcccacaaggucgcguccgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcccgcaccuacagcgacccgcuggcccucaaggaguucaaggacuucgccgccggccggaaguccaucgcgcuggaccuggugacggagaucgggcgcguccccacccaccucgcccaccggacccgcaacgcccuggacaaccuggugaugcuccacaccagcgagcacggcgggaaggccuaccggcacgccguggaggagcugcccgagacgauggagacccugcuccugcugggccucaugauccugcugaccgggggcgcgaugcuguuccugaucuccggcaaggggaucggcaagaccagcaucgggcugaucugcgucaucgccuccagcggcaugcucuggauggccgagaucccgcugcaguggaucgccagcgccaucgugcuggaguucuucaugauggugcuccugauccccgagcccgagaagcagcgcacgccccaggacaaccagcuggcguacgucgugaucgggauccucacccuggccgccaucaucgccgccaacgagaugggccugcucgagaccaccaagcgggaccugggcauguccaaggagccggggguggucagccccacguccuaccuggacguggaccuccaccccgcgagcgccuggacccuguacgccguggccaccaccgucaucacgcccaugcugcgccacaccaucgagaacuccaccgcgaacgugagccucgccgccaucgccaaccaggccgugguccugaugggccuggacaagggguggccgaucuccaagauggaccucggcgugccccugcuggcgcucgggugcuacagccaggugaacccccugacccugacggccgccguccuccugcugaucacccacuacgccaucaucggccccggccuccaggccaaggcgacccgggaggcccagaagcgcaccgccgccgggaucaugaagaacccgacgguggacggcaucaugaccaucgaccuggaccccgugaucuacgacuccaaguucgagaagcagcuggggcaggucaugcuccuggugcugugcgccgugcagcuccugcugaugcggaccagcugggcgcucugcgaggcccugacccuggccacgggccccaucaccacccucugggagggcucccccgggaaguucuggaacaccaccaucgccgucagcauggcgaacaucuuccgcggcuccuaccuggccggggccggccuggccuucagcaucaugaaguccguggggacgggcaagcggggcaccgggagccagggcgagacccucggggagaaguggaagaagaagcugaaccagcugucccgcaaggaguucgaccucuacaagaaguccggcaucaccgagguggaccggacggaggccaaggaggggcugaagcgcggcgagaucacccaccacgcggucucccggggcagcgccaagcugcagugguucguggagcgcaacauggugaucccggaggggcgggucaucgaccucggcugcgggcgcggcggguggagcuacuacugcgccggccugaagaaggugaccgaggugcggggcuacaccaagggcggccccgggcacgaggagcccguccccauguccacguacggcuggaacaucgugaagcugaugagcgggaaggacguguucuaccucccgcccgagaagugcgacacccugcugugcgacaucggcgaguccagccccucccccaccgucgaggagagccgcaccauccgcgugcugaagaugguggagccguggcucaagaacaaccaguucugcaucaagguccugaaccccuacaugcccgccgugaucgagcaccuggagcggcuccagcgcaagcacggcgggaugcuggugcggaacccccugucccgcaacagcacgcacgagauguacuggaucuccaacggcaccgggaacaucgucgccagcgugaacauggugucccggcuccugcugaaccgcuucaccaugacccaccggcgcccgacgaucgagaaggacgucgaccucggcgcgggcacccggcacgugaacgccgagcccgagacccccaacauggacgugaucggggagcgcaucaagcggaucaaggaggagcacaacagcaccuggcacuacgacgacgagaacccguacaagacgugggccuaccacggcuccuacgaggucaaggccaccgggagcgccuccagcaugaucaacggcguggucaagcugcugaccaagcccugggacguggugcccauggucacccagauggcgaugacggacaccacccccuucgggcagcagcgcguguucaaggagaagguggacacccggacgccgcgcuccaugcccggcacccggcgcgucauggagaucaccgccgaguggcucuggcggacccugggccgcaacaagaagccccggcugugcacgcgcgaggaguucaccaagaaggugcgcaccaacgccgccaugggggcgguguucaccgaggagaaccagugggacagcgccaaggccgccgucgaggacgaggacuucuggaagcucguggaccgggagcgcgagcugcacaagcugggcaagugcggguccugcguguacaacaugaugggcaagcgggagaagaagcucggggaguucggcaaggccaagggcagccgcgcgaucugguacauguggcugggggcccgguaccuggaguucgaggcccucggcuuccugaacgaggaccacugguucagccgcgagaacuccuacagcggggucgagggcgaggggcugcacaagcucggcuacauccugcgggacaucuccaagauccccggcggggccauguacgccgacgacacggcgggcugggacacccgcaucaccgaggacgaccugcacaacgaggagaagaucacccagcagauggacccggagcaccggcagcucgccaacgccaucuucaagcugaccuaccagaacaagguggugaagguccagcgccccacgcccaccgggaccgugauggacaucaucagccggaaggaccagcgcggcuccggccagguggggaccuacggccugaacacguucaccaacauggaggcccagcucauccggcagauggagggggagggcguccugagcaaggccgaccuggagaacccccaccucccggagaagaagaucacccaguggcuggagaccaaggggguggagcgccugaagcggauggcgaucuccggcgacgacugcguggucaagcccaucgacgaccgcuucgccaacgcccuccuggcccugaacgacaugggcaaggugcggaaggacaucccccaguggcagcccagcaagggguggcacgacuggcagcaggucccguucugcucccaccacuuccacgagcucaucaugaaggacggccgcaagcuggucgugcccugccggccccaggacgagcugaucgggcgcgcccggaucagccagggcgcgggguggucccuccgcgagacggccugccugggcaaggccuacgcccagauguggagccugauguacuuccaccgccgggaccuccgccuggcguccaacgccaucugcagcgccgugcccguccacugggugccgaccucccggaccaccuggagcauccacgcccaccaccaguggaugacgaccgaggacaugcugaccguguggaaccgcgucuggaucgaggacaaccccuggauggaggacaagacccccgugacgaccugggagaacgugcccuaccucggcaagcgggaggaccaguggugcgggucccugaucggccugaccagccgcgccaccugggcgcagaacaucccgacggccauccagcagguccggucccucaucgggaacgaggaguuccuggacuacaugcccagcaugaagcgcuuccggaaggaggaggagagcgagggcgccaucugguga

SEQ ID NO: 10277 - RNA, 9873 nt, Artificial Sequence
  derived and/or modified CDS sequence (opt1) from DENV-3__FJ850111__SS-prME
accagccucugccucaugaugauccugcccgccgcccuggcguuccaccucaccagccgggacggcgagccccggaugaucguggggaagaacgagcgcggcaagagccugcuguucaagacggccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacucccugaagaucaacugguacaagaagggcagcuccaucgggaagauguucgaggccaccgcgcggggcgcccgccggauggccauccugggcgacaccgccugggacuucgggagcgugggcgggguccucaacucccugggcaagauggugcaccagaucuucgggagcgccuacacggcgcuguucuccggcgugagcugggucaugaagaucggcaucggggugcuccugaccuggaucggccugaacuccaagaacaccagcauguccuucagcugcaucgccaucgggaucaucacccucuaccugggcgccgugguccaggccgacacggggugcgugaucaacuggaagggcaaggagcugaagugcggcuccgggaucuucgugaccaacgagguccacaccuggaccgagcaguacaaguuccaggccgacagccccaagcgccucgcgacggccaucgccggcgccugggagaacggggugugcggcauccgcuccaccacccggauggagaaccugcuguggaagcagaucgccaacgagcucaacuacauccugugggagaacaacaucaagcugaccguggucgugggggacaucaucggcgugcucgagcagggcaagcgcacgcugacgccccagccgauggagcugaaguacagcuggaagaccugggggaaggcgcggaucgucaccgccgagacgcagaacuccagcuucaucaucgacggccccaacacccccgagugccccaacaccucccgcgccuggaacgugugggagguggaggacuacggguucggcgucuucaccaccaacaucuggcucaagcugcgggagguguacacgcagcugugcgaccaccgccucaugagcgccgcggugaaggacgagcgggccguccacgccgacaugggcuacuggaucgagagccagaagaacggguccuggaagcuggagaaggccagccugaucgaggugaagaccugcaccuggccgaagucccacacccucuggagcaacggcgugcuggaguccgacaugaucauccccaagagccuggccgggcccaucucccagcacaacuaccgcccgggcuaccacacgcagaccgcggggcccuggcaccucggcaagcuggagcuggacuucaacuacugcgagggcaccaccgucgugaucacggagaacugcgggacccggggccccagccuccgcaccaccacgguguccgggaagcugauccacgaguggugcugccggagcugcacccugcccccgcuccgcuacaugggcgaggacgggugcugguacggcauggagauccggcccaucuccgagaaggaggagaacauggucaagagccugguguccgccggcagcggggagguggacaacuucaccaugggcguccugugccucgccauccuguucgaggaggugaugcgcgggaaguucggcaagaagcacaugaucgccgggguguucuucaccuucguccugcuccuguccggccagaucacguggcgggacauggcccacacccugaucaugaucggcagcaacgcgaccgaccgcauggggaugggcgugaccuaccucgcccugaucgccacguucaagauccagcccuuccuggcccucggguucuuccugcggaagcugaccucccgcgagaaccuccugcugggcgugggccucgccauggcgaccacccugcagcugcccgaggacaucgagcagauggccaacgggaucgcccucggccugauggcccugaagcucaucacgcaguucgagaccuaccagcuguggaccgcgcugaucagccugaccugcagcaacacgaucuucacccugaccgucgccuggcggaccgccacgcugauccucgccggggugucccugcugccggucugccagagcuccagcaugcgcaagaccgacuggcuccccaugaccguggccgcgaugggcgugccgccccucccgcuguucaucuucucccucaaggacacccugaagcgccggagcuggccccugaacgagggggucauggccgugggccucguguccauccuggccagcucccugcuccgcaacgacguccccauggccggcccccugguggccgggggccugcucaucgcgugcuacgugaucacggggaccagcgccgaccugaccgucgagaaggccgccgacgugaccugggaggaggaggccgagcagaccggcgugucccacaaccugaugaucacggucgacgacgacgggaccaugcggaucaaggacgacgagaccgagaacauccucaccgugcugcugaagacggcgcuccugaucgugagcggcaucuucccguacuccauccccgccacccugcucgucuggcacaccuggcagaagcagacccagcgcagcggcgugcugugggacgugcccagcccgcccgagacgcagaaggccgagcuggaggagggggucuaccggaucaagcagcagggcaucuucgggaagacccaggugggcguggggguccagaaggagggcguguuccacaccauguggcacgugacccgcggcgccguccucacguacaacgggaagcggcuggagcccaacugggccagcgugaagaaggaccugaucuccuacggcgggggcuggcgccucagcgcgcaguggcagaagggggaggaggugcaggucaucgccguggagcccggcaagaaccccaagaacuuccagaccaugcccggcaccuuccagaccacgaccggggagaucggcgccaucgcccuggacuucaagcccgggaccuccggcagccccaucaucaaccgggagggcaagguggucgggcuguacggcaacgggguggugaccaagaacggcggguacgucagcggcaucgcgcagacgaacgccgagccggacggccccacccccgagcuggaggaggagauguucaagaagcgcaaccucaccaucauggaccugcaccccggguccggcaagacccggaaguaccugccggccaucgugcgcgaggccaucaagcggcgccuccggacgcugauccuggcccccacccgcguggucgcggccgagauggaggaggcccucaaggggcugcccauccgguaccagaccaccgccaccaaguccgagcacaccggccgcgagaucguggaccugaugugccacgccaccuucaccaugcggcuccugucccccgugcgcgucccgaacuacaaccugaucaucauggacgaggcgcacuucacggaccccgccagcaucgccgcccggggguacaucuccacccgcgugggcaugggcgaggccgcggccaucuucaugaccgccacgccgcccgggacggccgacgcguucccgcagagcaacgcccccauccaggacgaggagcgcgacauccccgagcgguccuggaacagcggcaacgaguggaucaccgacuucgccgggaagaccgugugguucguccccuccaucaaggccggcaacgacaucgccaacugccuccgcaagaacgggaagaaggugauccagcugagccggaagaccuucgacacggaguaccagaagaccaagcugaacgacugggacuucguggucaccaccgacaucuccgagaugggcgcgaacuucaaggccgaccgcgugaucgacccgcggcgcugccucaagcccgugauccugaccgacggccccgagcgggucauccuggccgggcccaugccggugacggccgccagcgcggcccagcgccggggccgcguggggcggaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgcgagaaguccgcggccaucgacggcgaguaccggcugaagggcgagagccgcaagacguucgucgagcugaugcggcgcggggaccuccccguguggcuggcccacaaggucgccuccgagggcaucaaguacaccgaccggaaguggugcuucgacgggcagcgcaacaaccagauccuggaggagaacauggacguggagaucuggaccaaggagggcgagaagaagaagcuccggccccgcuggcuggacgcgcgcaccuacagcgacccgcuggcccucaaggaguucaaggacuucgccgccggccggaaguccaucgcccuggaccuggugacggagaucgggcgcguccccacccaccucgcgcaccggacccgcaacgcccuggacaaccuggugaugcuccacaccagcgagcacggcgggaaggccuaccggcacgccguggaggagcugcccgagacgauggagacccugcuccugcugggccucaugauccugcugaccgggggcgccaugcuguuccugaucuccggcaaggggaucggcaagaccagcaucgggcugaucugcgucaucgcgagcuccggcaugcucuggauggccgagaucccgcugcaguggaucgccagcgccaucgugcuggaguucuucaugauggugcuccugauccccgagcccgagaagcagcgcacgccccaggacaaccagcuggccuacgucgugaucgggauccucacccuggcggccaucaucgccgccaacgagaugggccugcucgagaccaccaagcgggaccugggcauguccaaggagccggggguggucagccccacguccuaccuggacguggaccuccaccccgccagcgcguggacccuguacgccguggccaccaccgucaucacgcccaugcugcgccacaccaucgagaacuccaccgccaacgugagccucgcggccaucgccaaccaggccgugguccugaugggccuggacaagggguggccgaucuccaagauggaccucggcgugccccugcuggcccucgggugcuacagccaggugaacccccugacccugacggcggccguccuccugcugaucacccacuacgccaucaucggccccggccuccaggccaaggccacccgggaggcgcagaagcgcaccgccgccgggaucaugaagaacccgacgguggacggcaucaugaccaucgaccuggaccccgugaucuacgacuccaaguucgagaagcagcuggggcaggucaugcuccuggugcugugcgccgugcagcuccugcugaugcggaccagcugggcccucugcgaggcgcugacccuggccacgggccccaucaccacccucugggagggcucccccgggaaguucuggaacaccaccaucgccgucagcauggccaacaucuuccgcggcuccuaccuggcgggggccggccuggccuucagcaucaugaaguccguggggacgggcaagcggggcaccgggagccagggcgagacccucggggagaaguggaagaagaagcugaaccagcugucccgcaaggaguucgaccucuacaagaaguccggcaucaccgagguggaccggacggaggccaaggaggggcugaagcgcggcgagaucacccaccacgccgucagccggggcuccgcgaagcugcagugguucguggagcgcaacauggugaucccggaggggcgggucaucgaccucggcugcgggcgcggcggguggagcuacuacugcgccggccugaagaaggugaccgaggugcggggcuacaccaagggcgggcccgggcacgaggagcccguccccauguccacguacggcuggaacaucgugaagcugaugagcgggaaggacguguucuaccucccgcccgagaagugcgacacccugcugugcgacaucggcgaguccagccccucccccaccgucgaggagagccgcaccauccgcgugcugaagaugguggagccguggcucaagaacaaccaguucugcaucaagguccugaaccccuacaugcccgccgugaucgagcaccuggagcggcuccagcgcaagcacggcgggaugcuggugcggaacccccugucccgcaacagcacgcacgagauguacuggaucuccaacggcaccgggaacaucgucgccagcgugaacauggugucccggcuccugcugaaccgcuucaccaugacccaccggcgcccgacgaucgagaaggacgucgaccucggcgccggcacccggcacgugaacgcggagcccgagacccccaacauggacgugaucggggagcgcaucaagcggaucaaggaggagcacaacagcaccuggcacuacgacgacgagaacccguacaagacgugggccuaccacggcuccuacgaggucaaggccaccgggagcgccuccagcaugaucaacggcguggucaagcugcugaccaagcccugggacguggugcccauggucauccagauggccaugaccgacacgacccccuucgggcagcagcgcguguucaaggagaagguggacacccggaccccgcgcuccaugcccggcacgcggcgcgucauggagaucaccgcggaguggcucuggcggacccugggccgcaacaagaagccccggcugugcacccgcgaggaguucacgaagaaggugcgcaccaacgccgccaugggggccguguucaccgaggagaaccagugggacagcgcgaaggccgccgucgaggacgaggacuucuggaagcucguggaccgggagcgcgagcugcacaagcugggcaagugcgggagcugcguguacaacaugaugggcaagcgggagaagaagcucggggaguucggcaaggccaagggcucccgcgccaucugguacauguggcugggggcgcgguaccuggaguucgaggcccucggcuuccugaacgaggaccacugguucagccgcgagaacuccuacagcggggucgagggcgaggggcugcacaagcucggcuacauccugcgggacaucuccaagauccccggcggggccauguacgccgacgacaccgccggcugggacacgcgcaucaccgaggacgaccugcacaacgaggagaagaucacccagcagauggacccggagcaccggcagcucgcgaacgccaucuucaagcugaccuaccagaacaagguggugaagguccagcgccccacccccacggggaccgugauggacaucaucagccggaaggaccagcgcggcuccggccagguggggaccuacggccugaacaccuucacgaacauggaggcccagcucauccggcagauggagggggagggcguccugagcaaggccgaccuggagaacccccaccucccggagaagaagaucacccaguggcuggagaccaaggggguggagcgccugaagcggauggccaucuccggcgacgacugcguggucaagcccaucgacgaccgcuucgcgaacgcccuccuggcccugaacgacaugggcaaggugcggaaggacaucccccaguggcagcccagcaagggguggcacgacuggcagcaggucccguucugcucccaccacuuccacgagcucaucaugaaggacggccgcaagcuggucgugcccugccggccccaggacgagcugaucgggcgcgcccggaucagccagggcgccggguggucccuccgcgagaccgcgugccugggcaaggccuacgcccagauguggagccugauguacuuccaccgccgggaccuccgccuggccuccaacgcgaucugcagcgccgugcccguccacugggugccgacgucccggaccaccuggagcauccacgcccaccaccaguggaugaccacggaggacaugcugaccguguggaaccgcgucuggaucgaggacaaccccuggauggaggacaagacccccgugaccacgugggagaacgugcccuaccucggcaagcgggaggaccaguggugcgggucccugaucggccugaccagccgcgccaccugggcccagaacaucccgaccgcgauccagcagguccggagccucaucgggaacgaggaguuccuggacuacaugcccuccaugaagcgcuuccggaaggaggaggagagcgagggcgccaucugguga

SEQ ID NO: 10278 - RNA, 9873 nt, Artificial Sequence
  derived and/or modified CDS sequence (opt1) from DENV-3__KF955486__SS-prME
accagccucugccucaugaugauccugcccgccgcccuggcguuccaccucaccagccgggacggcgagccccggaugaucguggggaagaacgagcgcggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcggagcgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucacgcugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggcgacccuccggaagcugugcaucgagggcaagaucaccaacaucaccacggacagccgcugccccacccagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacacggugaucaucaccguccacaccggggaccagcaccaggugggcaacgagacccagggggucacggccgagaucacgccccaggccagcaccaccgaggcgauccugcccgaguacggcacccuggggcucgagugcuccccgcgcacgggccuggacuucaacgagaugauccugcucaccaugaagaacaaggccuggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgucccgugcaagauccccuucagcacggaggacgggcagggcaaggcgcacaacggccgccugaucaccgccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacacggccugggacuucggguccgugggcgggguccucaacagccugggcaagauggugcaccagaucuucggguccgcguacaccgcccuguucagcggcguguccugggucaugaagaucggcaucggggugcuccugaccuggaucggccugaacagcaagaacaccuccaugagcuucuccugcaucgccaucgggaucaucacgcucuaccugggcgccgugguccaggccgacauggggugcgugaucaacuggaagggcaaggagcugaagugcggcagcgggaucuucgugaccaacgagguccacaccuggaccgagcaguacaaguuccaggcggacucccccaagcgccucgccacggccaucgccggcgccugggagaacggggugugcggcauccgcagcaccacccggauggagaaccugcuguggaagcagaucgcgaacgagcucaacuacauccugugggagaacaacaucaagcugaccguggucgugggggacaucaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagacgugcaccuggccgaagucccacacccucuggagcaacggcgugcuggaguccgacaugaucauccccaagagccuggccgggcccaucucccagcacaacuaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcggggagguggacaacuucaccaugggcguccugugccucgccauccuguucgaggaggugaugcgggggaaguucggcaagaagcacaugaucgcggggguguucuucaccuucguccugcuccuguccggccagaucaccuggcgcgacauggcccacacgcugaucaugaucggcagcaacgccuccgaccggauggggaugggcgugaccuaccucgcccugaucgccaccuucaagauccagcccuuccuggcgcucggguucuuccugcgcaagcugaccagccgggagaaccuccugcugggcgugggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccaucuucacccugacggucgccuggcgcaccgccacccugauccucgcgggggugagccugcugccggucugccaguccagcuccaugcggaagaccgacuggcuccccaugacgguggccgccaugggcgugccgccccucccgcuguucaucuucagccucaaggacacccugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugacggucgagaaggccgcggacgugaccugggaggaggaggccgagcagaccggcgugagccacaaccugaugaucaccgucgacgacgacgggaccaugcgcaucaaggacgacgagacggagaacauccucaccgugcugcugaagaccgcccuccugaucguguccggcaucuucccguacagcauccccgccacccugcucgucuggcacacguggcagaagcagacccagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacacgauguggcacgugacccggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcacguuccagaccaccaccggggagaucggcgcgaucgcccuggacuucaagcccgggacgagcggcagccccaucaucaaccgcgagggcaagguggucgggcuguacggcaacgggguggugaccaagaacggcggguacgucuccggcaucgcccagaccaacgccgagccggacggccccacccccgagcuggaggaggagauguucaagaagcggaaccucacgaucauggaccugcaccccgggagcggcaagacccgcaaguaccugccggccaucgugcgggaggcgaucaagcgccggcuccgcacccugauccuggcccccacccggguggucgccgccgagauggaggaggcccucaaggggcugcccauccgcuaccagacgaccgcgaccaaguccgagcacaccggccgggagaucguggaccugaugugccacgccacguucaccaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugacggcgacgccgcccgggaccgccgacgccuucccgcaguccaacgcccccauccaggacgaggagaaggacauccccgagcgcagcuggaacuccggcaacgaguggaucaccgacuucgccgggaagacggugugguucguccccagcaucaaggcgggcaacgacaucgccaacugccuccgcaagaacgggaagaaggugauccagcugucccggaagaccuucgacaccgaguaccagaagaccaagcugaacgacugggacuucguggucacgaccgacaucagcgagaugggcgccaacuucaaggccgaccgcgugaucgacccgcggcgcugccucaagcccgugauccugaccgacggccccgagcgggucauccuggccgggcccaugccggugaccgcggccuccgccgcccagcgccggggccgcguggggcggaacccccagaaggagaacgaccaguacaucuucaccggccagccccucaacaacgacgaggaccacgcccacuggacggaggcgaagaugcugcuggacaacaucaacacccccgaggggaucaucccggcccucuucgagcccgagcgcgagaaguccgccgccaucgacggcgaguaccggcugaagggcgagucccgcaagaccuucgucgagcugaugcggcgcggggaccuccccguguggcuggcgcacaaggucgccagcgagggcaucaaguacaccgaccggaaguggugcuucgacgggcagcgcaacaaccagauccuggaggagaacauggacguggagaucuggacgaaggagggcgagaagaagaagcuccggccccgcuggcuggacgcccggaccuacuccgacccgcuggcccucaaggaguucaaggacuucgccgcgggccgcaagagcaucgcccuggaccuggugaccgagaucgggcgcguccccacccaccucgcccaccggacgcgcaacgcccuggacaaccuggugaugcuccacaccuccgagcacggcgggaaggccuaccggcacgcgguggaggagcugcccgagaccauggagacccugcuccugcugggccucaugauccugcugaccggcggggccaugcuguuccugaucagcgggaaggggaucggcaagaccagcaucgggcugaucugcgucaucgccuccagcggcaugcucuggauggccgagaucccgcugcaguggaucgccuccgcgaucgugcuggaguucuucaugauggugcuccugauccccgagcccgagaagcagcgcacgccccaggacaaccagcuggccuacgucgugaucgggauccucacccuggccgccaucaucgccgcgaacgagaugggccugcucgagacgaccaagcgggaccugggcaugagcaaggagccggggguggucucccccaccagcuaccuggacguggaccuccaccccgccuccgccuggacccuguacgccguggcgacgaccgucaucacccccaugcugcgccacaccaucgagaacagcacggccaacgugucccucgccgccaucgccaaccaggcggugguccugaugggccuggacaagggguggccgaucagcaagauggaccucggcgugccccugcuggcccucgggugcuacucccaggugaacccccugacccugaccgccgccguccuccugcugaucacccacuacgccaucaucggccccggccuccaggcgaaggccacgcgggaggcccagaagcgcaccgccgccgggaucaugaagaacccgaccguggacggcaucaugaccaucgaccuggaccccgugaucuacgacagcaaguucgagaagcagcuggggcaggucaugcuccuggugcugugcgcggugcagcuccugcugaugcggacguccugggcccucugcgaggcccugacccuggccaccggccccaucaccacgcucugggagggcagccccgggaaguucuggaacaccaccaucgcggucuccauggccaacaucuuccgcggcagcuaccuggccggggccggccuggccuucuccaucaugaaguccguggggaccggcaagcggggcaccgggucccagggcgagacgcucggggagaaguggaagaagaagcugaaccagcugagccgcaaggaguucgaccucuacaagaaguccggcaucaccgagguggaccggaccgaggcgaaggaggggcugaagcgcggcgagaucacccaccacgccgucucccggggcagcgccaagcugcagugguucguggagcgcaacauggugaucccggaggggcgggucaucgaccucggcugcgggcgcggcgggugguccuacuacugcgccggccugaagaaggugacggaggugcggggcuacaccaagggcgggcccgggcacgaggagcccguccccaugagcaccuacggcuggaacaucgugaagcugauguccgggaaggacguguucuaccucccgcccgagaagugcgacacccugcugugcgacaucggcgagagcucccccagccccacggucgaggagucccgcaccauccgggugcugaagaugguggagccguggcucaagaacaaccaguucugcaucaagguccugaaccccuacaugcccaccgugaucgagcaccuggagcgccuccagcgcaagcacggcgggaugcuggugcggaacccccugagccgcaacuccacccacgagauguacuggaucagcaacggcacggggaacaucgucgccuccgugaacauggugagccggcuccugcugaaccgcuucaccaugacccaccggcgcccgaccaucgagaaggacgucgaccucggcgcgggcacgcggcacgugaacgccgagcccgagacccccaacauggacgugaucggggagcgcaucaagcggaucaaggaggagcacaacuccaccuggcacuacgacgacgagaacccguacaagaccugggccuaccacggcagcuacgaggucaaggccacgggguccgccagcuccaugaucaacggcguggucaagcugcugaccaagcccugggacguggugcccauggucacccagauggcgaugaccgacacgacccccuucgggcagcagcgcguguucaaggagaagguggacacccggaccccgcgcagcaugcccggcacgcggcgcgucaugggcaucaccgccgaguggcucuggcggacccuggggcgcaacaagaagccccggcugugcacccgcgaggaguucacgaagaaggugcggaccaacgccgccaugggcgcgguguucaccgaggagaaccagugggacagcgccaaggccgccgucgaggacgaggacuucuggaagcucguggaccgcgagcgcgagcugcacaagcuggggaagugcggcuccugcguguacaacaugauggggaagcgggagaagaagcucggcgaguucggcaaggccaaggggagccgcgcgaucugguacauguggcugggcgcccgguaccuggaguucgaggcccucggguuccugaacgaggaccacugguucucccgcgagaacagcuacuccggcgucgagggggagggccugcacaagcucggcuacauccugcgggacaucagcaagauccccgggggcgccauguacgccgacgacaccgcggggugggacacgcgcaucaccgaggacgaccugcacaacgaggagaagaucacccagcagauggacccggagcaccggcagcucgccaacgccaucuucaagcugaccuaccagaacaagguggugaagguccagcgccccacccccacgggcaccgugauggacaucaucucccggaaggaccagcgcggcagcggccaggugggcaccuacgggcugaacaccuucacgaacauggaggcccagcucauccggcagauggagggcgaggggguccuguccaaggccgaccuggagaacccccaccucccggagaagaagaucacccaguggcuggagaccaagggcguggagcgccugaagcggauggcgaucagcggcgacgacugcguggucaagcccaucgacgaccgcuucgccaacgcccuccuggcccugaacgacauggggaaggugcggaaggacaucccccaguggcagcccuccaagggcuggcacgacuggcagcaggucccguucugcagccaccacuuccacgagcucaucaugaaggacgggcgcaagcuggucgugcccugccggccccaggacgagcugaucggccgcgcccggaucucccagggggcgggcuggagccuccgcgagaccgccugccugggcaaggccuacgcccagauguggucccugauguacuuccaccggcgcgaccuccgccuggcgagcaacgccaucugcuccgccgugcccguccacugggugccgacgagccggaccaccugguccauccacgcccaccaccaguggaugaccacggaggacaugcugaccguguggaaccgcgucuggaucgaggacaaccccuggauggaggacaagacccccgugaccacgugggagaacgugcccuaccucgggaagcgggaggaccaguggugcggcagccugaucgggcugaccagccgcgccaccugggcgcagaacaucccgaccgccauccagcagguccggucccucaucggcaacgaggaguuccuggacuacaugcccagcaugaagcgcuuccggaaggaggaggaguccgagggggccaucugguga

SEQ ID NO: 10279 - RNA, 9873 nt, Artificial Sequence
  derived and/or modified CDS sequence (opt1) from DENV-3__FJ898468__SS-prME
accagccugugccucaugaugauccugcccgccgcccuggcguuccaccucaccagccgggacggggagccccggaugaucguggggaagaacgagcgcggcaagagccugcuguucaagacggccuccgggaucaacaugugcacccucaucgccauggaccugggggagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacgugaucggcguccucgagcagggcaagcgcacccugacgccccagccgauggagcugaaguacuccuggaagaccugggggaaggccaagaucgugaccgccgagacccagaacagcuccuucaucaucgacggccccaacacgcccgagugccccagcgccucccgggcguggaacgugugggaggucgaggacuacggguucggcguguucaccaccaacaucuggcucaagcugcgcgagguguacacccagcugugcgaccaccggcucaugagcgccgccgucaaggacgagcgcgccgugcacgccgacaugggcuacuggaucgagagccagaagaacggguccuggaagcuggagaaggcgagccugaucgaggugaagaccugcacguggccgaagucccacacccucuggagcaacggcguccuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccguggugaucaccgagaacugcgggacccgcggccccagccuccggacgaccaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggaggucgacaacuucacgaugggcgugcugugccucgccauccuguucgaggaggugaugcgggggaaguucggcaagaagcacaugaucgcgggggucuucuucaccuucgugcugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgucggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccguggccuggcgcacggccacccugauccucgcgggggucagccugcugccggugugccaguccagcuccaugcggaagaccgacuggcuccccaugaccguggccgccaugggcgugccgccccucccgcuguucaucuucagccucaaggacacgcugaagcgccgcuccuggccccugaacgagggggugauggccgugggccucgucagcauccuggccuccagccugcuccggaacgacgugcccauggcgggcccccugguggccgggggccugcucaucgccugcuacgucaucaccgggaccuccgccgaccugaccguggagaaggccgcggacgugacgugggaggaggaggccgagcagaccggcgucagccacaaccugaugaucaccguggacgacgacgggaccaugcgcaucaaggacgacgagaccgagaacauccucacggugcugcugaagaccgcccuccugaucgucuccggcaucuucccguacagcauccccgccacccugcucguguggcacaccuggcagaagcagacgcagcgguccggcgugcugugggacguccccagcccgcccgagacccagaaggccgagcuggaggaggggguguaccgcaucaagcagcagggcaucuucgggaagacccaggugggcgucggggugcagaaggagggcguguuccacaccauguggcacgucacgcggggcgcggugcucaccuacaacgggaagcgccuggagcccaacugggccuccgugaagaaggaccugaucagcuacggcgggggcuggcggcucuccgcccaguggcagaagggggaggagguccaggugaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaaggucguggggcuguacggcaacgggguggucacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccgggucguggccgccgagauggaggaggcccucaaggggcugcccauccgcuaccagaccacggcgaccaaguccgagcacaccggccgggagaucguggaccugaugugccacgccaccuucacgaugcgccuccugagccccguccgggugccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgucugguucgugcccagcaucaaggcgggcaacgacaucgccaacugccuccggaagaacgggaagaaggugauccagcugucccgcaagacguucgacaccgaguaccagaagaccaagcugaacgacugggacuucgucgugaccacggacaucagcgagaugggcgccaacuucaaggccgaccgggugaucgacccgcgccggugccucaagcccgucauccugaccgacggccccgagcgcgugauccuggccgggcccaugccggugaccgcggccuccgccgcccagcggcgcggccgggucgggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcgcacaagguggccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggucaccgagaucgggcgggugcccucccaccucgcccaccgcacccggaacgcccuggacaaccuggugaugcuccacaccagcgagcacggcgggaaggccuaccgccacgcggucgaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggccgagaucccgcugcaguggaucgccagcgcgaucgugcuggaguucuucaugaugguccuccugauccccgagcccgagaagcagcggacgccccaggacaaccagcuggccuacguggugaucgggauccucacccuggccgccaucaucgccgcgaacgagaugggccugcucgagaccaccaagcgcgaccugggcauguccaaggagccgggggucgugagccccacguccuaccuggacguggaccuccaccccgccagcgccuggacccuguacgccgucgcgaccaccgugaucacgcccaugcugcggcacaccaucgagaacuccaccgccaacgugagccucgccgccaucgccaaccaggcggucgugcugaugggccuggacaagggguggccgaucuccaagauggaccucggcgugccccugcuggcccucgggugcuacagccaggucaacccccugacccugacggccgccgugcuccugcugaucacccacuacgccaucaucggccccggccuccaggcgaaggccacccgcgaggcccagaagcggaccgccgccgggaucaugaagaacccgacgguggacggcaucaugaccaucgaccuggaccccgucaucuacgacuccaaguucgagaagcagcugggccaggugaugcuccuggugcugugcgcgguccagcuccugcugaugcgcaccagcugggcccucugcgaggcccugacccuggccacgggccccaucaccacccucugggagggcucccccgggaaguucuggaacaccacgaucgcggugagcauggccaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggaguucgaccucuacaagaaguccggcaucaccgaggucgaccgcacggaggcgaaggaggggcugaagcggggcgagaucacccaccacgccgugagccgcggcuccgccaagcugcagugguucguggagcggaacauggucaucccggaggggcgcgugaucgaccucggcugcgggcggggcggguggagcuacuacugcgccggccugaagaaggugaccgagguccgcggcuacaccaagggcgggcccgggcacgaggagcccgugcccauguccacguacggcuggaacaucgugaagcugaugagcgggaaggacgucuucuaccucccgcccgagaagugcgacacccugcugugcgacaucggcgaguccagccccucccccaccguggaggagagccggaccauccgcgugcugaagauggucgagccguggcucaagaacaaccaguucugcaucaaggugcugaaccccuacaugcccacgguggucgagcaccuggagcgccuccagcggaagcacggcgggaugcuggugcgcaacccccugucccggaacagcacccacgagauguacuggaucuccaacggcaccgggaacaucguggccagcgucaacauggugucccgccuccugcugaaccgguucaccaugacgcaccgccggccgaccaucgagaaggacguggaccucggcgcgggcacccgccacgucaacgccgagcccgagacccccaacauggacgugaucggggagcggaucaagcgcaucaaggaggagcacaacagcacguggcacuacgacgacgagaacccguacaagaccugggccuaccacggcuccuacgaggucaaggccaccgggagcgccuccagcaugaucaacggcguggugaagcugcugaccaagcccugggacgucgugcccauggugacgcagauggcgaugaccgacaccacccccuucgggcagcagcgggucuucaaggagaagguggacacgcgcaccccgcggagcaugcccggcacccgccgggugaugggcaucaccgccgaguggcucuggcgcacgcuggggcggaacaagaagccccgccugugcacccgggaggaguucaccaagaagguccgcaccaacgccgccaugggcgcgguguucacggaggagaaccagugggacuccgccaaggccgccguggaggacgaggacuucuggaagcucgucgaccgcgagcgggagcugcacaagcuggggaagugcggcagcugcguguacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgccgacgacaccgcggggugggacacccggaucaccgaggacgaccugcacaacgaggagaagaucacgcagcagauggacccggagcaccgccagcucgccaacgccaucuucaagcugaccuaccagaacaaggucgugaaggugcagcggcccacccccaccggcaccgucauggacaucaucagccgcaaggaccagcggggcuccggccaggugggcacguacgggcugaacaccuucaccaacauggaggcccagcucauccgccagauggagggcgagggggugcugagcaaggccgaccuggagaacccccggcucccggagaagaagaucacccaguggcuggagacgaagggcgucgagcgccugaagcggauggcgaucuccggcgacgacugcguggugaagcccaucgacgaccgcuucgccaacgcccuccuggcccugaacgacauggggaagguccggaaggacaucccccaguggcagcccagcaagggcuggcacgacuggcagcaggucccguucugcucccaccacuuccacgagcucaucaugaaggacgggcgcaagcuggugguccccugccggccccaggacgagcugaucggccgcgcccggaucagccagggggcgggcuggucccuccgcgagaccgccugccugggcaaggccuacgcccagauguggagccugauguacuuccaccgccgggaccuccgccuggcguccaacgccaucugcagcgccgugcccgugcacugggucccgaccucccggaccacguggagcauccacgcccaccaccaguggaugaccaccgaggacaugcugaccguguggaaccgcguguggaucgaggacaaccccuggauggaggacaagacgcccgucaccaccugggagaacgugcccuaccucgggaagcgggaggaccaguggugcggcagccugaucgggcugaccucccgcgccacgugggcgcagaacaucccgaccgccauccagcagguccggagccucaucggcaacgaggaguuccuggacuacaugcccuccaugaagcgcuuccggaaggaggaggagagcgagggggccaucugguga

SEQ ID NO: 10280 - RNA, 9873 nt, Artificial Sequence
  derived and/or modified CDS sequence (opt1) from DENV-3__FJ898469__SS-prME
accagccugugccucaugaugauccugcccgccgcccuggcguuccaccucaccagccgggacggggagccgcggaugaucguggggaagaacgagcggggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcggagcgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaaguccgagcacaccggccgggagaucguggaccugaugugccacgccaccuucacgaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucguccccagcaucaaggcgggcaacgacaucgccaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggugaccgagaucgggcggguccccacccaccucgcccaccgcacccggaacgcccuggacaaccuggugaugcuccacacguccgagcacggcgggaaggccuaccgccacgcgguggaggagcugcccgagaccauggagacccugcuccugcugggccucaugauccugcugaccgggggcgccaugcuguuccugaucagcggcaaggggaucggcaagacgagcaucgggcugaucugcgucaucgccuccagcggcaugcucuggauggccgagaucccgcugcaguggaucgccuccgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccacgaagcgcgaccugggcaugagcaaggagccggggguggucucccccaccagcuaccuggacguggaccuccaccccgccuccgccuggacccuguacgccguggcgaccacggucaucacccccaugcugcggcacaccaucgagaacagcaccgccaacgugucccucgccgccaucgccaaccaggcggugguccugaugggccuggacaagggguggccgaucagcaagauggaccucggcgugccccugcuggcccucgggugcuacucccaggugaacccccugacgcugaccgccgccguccuccugcugaucacccacuacgccaucaucggccccggccuccaggcgaaggccacccgcgaggcccagaagcggacggccgccgggaucaugaagaacccgaccguggacggcaucaugaccaucgaccuggaccccgugaucuacgacagcaaguucgagaagcagcuggggcaggucaugcuccuggugcugugcgcggugcagcuccugcugaugcgcaccuccugggcccucugcgaggcccugacgcuggccaccggccccaucaccacccucugggagggcagccccgggaaguucuggaacacgaccaucgcggucuccauggccaacaucuuccggggcagcuaccuggccggggccggccuggccuucuccaucaugaaguccguggggaccggcaagcgcggcaccgggcuccagggcgagacccugggggagaaguggaagaagaagcugaaccagcucucccggaaggaguucgaccuguacaagaaguccggcaucacggagguggaccgcaccgaggcgaaggaggggcugaagcggggcgagaucacccaccacgccgucagccgcggcuccgccaagcuccagugguucguggagcggaacauggugaucccggaggggcgcgucaucgaccugggcugcgggcggggcggguggagcuacuacugcgccggccugaagaaggugaccgaggugcgcggcuacacgaagggcgggcccgggcacgaggagcccguccccauguccaccuacggcuggaacaucgugaagcucaugagcgggaaggacguguucuaccugccgcccgagaagugcgacacccugcugugcgacaucggcgaguccagccccucccccaccgucgaggagagccggacgauccgcgugcucaagaugguggagccguggcugaagaacaaccaguucugcaucaagguccugaaccccuacaugcccaccgugaucgagcaccucgagcgccugcagcggaagcacggcgggaugcuggugcgcaacccccucucccggaacagcacccacgagauguacuggaucuccaacggcaccgggaacaucgucgccagcgugaacauggugucccgccugcugcucaaccgguucacgaugacccaccgccggccgaccaucgagaaggacgucgaccugggcgcgggcacccgccacgugaacgccgagcccgagacgcccaacauggacgugaucggggagcggaucaagcgcaucaaggaggagcacaacagcaccuggcacuacgacgacgagaacccguacaagaccugggccuaccacggcuccuacgaggucaaggccaccgggagcgccuccagcaugaucaacggcguggucaagcugcucacgaagcccugggacguggugcccauggucacccagauggcgaugaccgacaccacgcccuucgggcagcagcggguguucaaggagaagguggacacccgcaccccgcgguccaugcccggcacccgccgggucaugggcaucacggccgaguggcuguggcgcacccuggggcggaacaagaagccccgccucugcacccgggaggaguucaccaagaaggugcgcacgaacgccgccaugggcgcgguguucaccgaggagaaccagugggacagcgccaaggccgccgucgaggacgaggacuucuggaagcugguggaccgcgagcgggagcugcacaagcucgggaagugcggcagcugcguguacaacaugauggggaagcgcgagaagaagcugggcgaguucggcaaggccaaggggucccgggcgaucugguacauguggcugggcgcccgcuaccucgaguucgaggcccugggguuccugaacgaggaccacugguucagccgggagaacuccuacagcggcgucgagggggagggccuccacaagcugggcuacauccugcgcgacaucuccaagauccccgggggcgccauguacgccgacgacaccgcggggugggacacccggaucacggaggacgaccuccacaacgaggagaagaucacccagcagauggacccggagcaccgccagcuggccaacgccaucuucaagcugaccuaccagaacaagguggugaagguccagcggcccacccccaccggcacggugauggacaucaucagccgcaaggaccagcggggcuccggccaggugggcaccuacgggcucaacaccuucaccaacauggaggcccagcugauccgccagauggagggcgaggggguccugagcaaggccgaccucgagaacccccaccuccccgagaagaagaucacgcaguggcuggagaccaagggcguggagcggcugaagcgcauggcgaucuccggcgacgacugcguggucaagcccaucgacgaccgguucgccaacgcccugcuggcccucaacgacauggggaaggugcgcaaggacaucccccaguggcagcccagcaagggcuggcacgacuggcagcaggucccguucugcucccaccacuuccacgagcugaucaugaaggacgggcggaagcuggucgugcccugccgcccccaggacgagcucaucggccgggcccgcaucagccagggggcgggcuggucccugcgggagaccgccugccugggcaaggccuacgcccagauguggagccucauguacuuccaccgccgcgaccugcggcuggcguccaacgccaucugcagcgccgugcccguccacugggugccgaccucccgcacgaccuggagcauccacgcccaccaccaguggaugaccaccgaggacaugcucacgguguggaaccgggucuggaucgaggacaaccccuggauggaggacaagacccccgugaccaccugggagaacgugcccuaccuggggaagcgcgaggaccaguggugcggcucccugaucgggcucacgagccgggccaccugggcgcagaacaucccgaccgccauccagcagguccgcagccugaucggcaacgaggaguuccuggacuacaugcccuccaugaagcgguuccgcaaggaggaggagagcgagggggccaucugguga

SEQ ID NO: 10281 - RNA, 9873 nt, Artificial Sequence
  derived and/or modified CDS sequence (opt1) from DENV-3__FJ898470__SS-prME
accagccugugccucaugaugauccugcccgccgcccuggcguuccaccucaccagccgggacggggagccccggaugaucguggggaagaacgagcggggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcggagcgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaaguccgagcacaccggccgggagaucguggaccugaugugccacgccaccuucacgaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucguccccagcaucaaggcgggcaacgacaucgccaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggugaccgagaucgggcggguccccacccaccucgcccaccgcacccggaacgcccuggacaaccuggugaugcuccacacguccgagcacggcgggaaggccuaccgccacgcgguggaggagcugcccgagaccauggagacccugcuccugcugggccucaugauccugcugaccgggggcgccaugcuguuccugaucagcggcaaggggaucggcaagacgagcaucgggcugaucugcgucaucgccuccagcggcaugcucuggauggccgagaucccgcugcaguggaucgccuccgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccacgaagcgcgaccugggcaugagcaaggagccggggguggucucccccaccagcuaccuggacguggaccuccaccccgccuccgccuggacccuguacgccguggcgaccacggucaucacccccaugcugcggcacaccaucgagaacagcaccgccaacgugucccucgccgccaucgccaaccaggcggugguccugaugggccuggacaagggguggccgaucagcaagauggaccucggcgugccccugcuggcccucgggugcuacucccaggugaacccccugacgcugaccgccgccguccuccugcugaucacccacuacgccaucaucggccccggccuccaggcgaaggccacccgcgaggcccagaagcggacggccgccgggaucaugaagaacccgaccguggacggcaucaugaccaucgaccuggaccccgugaucuacgacagcaaguucgagaagcagcuggggcaggucaugcuccuggugcugugcgcggugcagcuccugcugaugcgcaccuccugggcccucugcgaggcccugacgcuggccaccggccccaucaccacccucugggagggcagccccgggaaguucuggaacacgaccaucgcggucuccauggccaacaucuuccggggcagcuaccuggccggggccggccuggccuucuccaucaugaaguccguggggaccggcaagcgcggcaccgggucccagggcgagacccucggggagaaguggaagaagaagcugaaccagcugagccggaaggaguucgaccucuacaagaaguccggcaucacggagguggaccgcaccgaggcgaaggaggggcugaagcggggcgagaucacccaccacgccgucucccgcggcagcgccaagcugcagugguucguggagcggaacauggugaucccggaggggcgcgucaucgaccucggcugcgggcggggcgggugguccuacuacugcgccggccugaagaaggugaccgaggugcgcggcuacacgaagggcgggcccgggcacgaggagcccguccccaugagcaccuacggcuggaacaucgugaagcugauguccgggaaggacguguucuaccucccgcccgagaagugcgacacccugcugugcgacaucggcgagagcucccccagccccaccgucgaggagucccggacgauccgcgugcugaagaugguggagccguggcucaagaacaaccaguucugcaucaagguccugaaccccuacaugcccaccgugaucgagcaccuggagcgccuccagcggaagcacggcgggaugcuggugcgcaacccccugagccggaacuccacccacgagauguacuggaucagcaacggcaccgggaacaucgucgccuccgugaacauggugagccgccuccugcugaaccgguucacgaugacccaccgccggccgaccaucgagaaggacgucgaccucggcgcgggcacccgccacgugaacgccgagcccgagacgcccaacauggacgugaucggggagcggaucaagcgcaucaaggaggagcacaacuccaccuggcacuacgacgacgagaacccguacaagaccugggccuaccacggcagcuacgaggucaaggccaccggguccgccagcuccaugaucaacggcguggucaagcugcugacgaagcccugggacguggugcccauggucacccagauggcgaugaccgacaccacgcccuucgggcagcagcggguguucaaggagaagguggacacccgcaccccgcggagcaugcccggcacccgccgggucaugggcaucacggccgaguggcucuggcgcacccuggggcggaacaagaagccccgccugugcacccgggaggaguucaccaagaaggugcgcacgaacgccgccaugggcgcgguguucaccgaggagaaccagugggacagcgccaaggccgccgucgaggacgaggacuucuggaagcucguggaccgcgagcgggagcugcacaagcuggggaagugcggcuccugcguguacaacaugauggggaagcgcgagaagaagcucggcgaguucggcaaggccaaggggagccgggcgaucugguacauguggcugggcgcccgcuaccuggaguucgaggcccucggguuccugaacgaggaccacugguucucccgggagaacagcuacuccggcgucgagggggagggccugcacaagcucggcuacauccugcgcgacaucagcaagauccccgggggcgccauguacgccgacgacaccgcggggugggacacccggaucacggaggacgaccugcacaacgaggagaagaucacccagcagauggacccggagcaccgccagcucgccaacgccaucuucaagcugaccuaccagaacaagguggugaagguccagcggcccacccccgccggcaccgugauggacaucaucucccgcaaggaccagcggggcagcggccaggugggcacguacgggcugaacaccuucaccaacauggaggcccagcucauccgccagauggagggcgaggggguccuguccaaggcggaccuggagaacccccaccucccggagaagaagaucacccaguggcuggagacgaagggcguggagcggcugaagcgcauggccaucagcggcgacgacugcguggucaagcccaucgacgaccgguucgccaacgcccuccuggcccugaacgacauggggaaggugcgcaaggacaucccccaguggcagcccuccaagggcuggcacgacuggcagcaggucccguucugcagccaccacuuccacgagcucaucaugaaggacgggcggaagcuggucgugcccugccgcccccaggacgagcugaucggccgggcgcgcaucucccagggggccggcuggagccuccgggagaccgccugccugggcaaggccuacgcgcagauguggucccugauguacuuccaccgccgcgaccuccggcuggccagcaacgccaucugcuccgccgugcccguccacugggugccgaccagccgcaccacgugguccauccacgcccaccaccaguggaugaccaccgaggacaugcugaccguguggaaccgggucuggaucgaggacaaccccuggauggaggacaagacgcccgugaccaccugggagaacgugcccuaccucgggaagcgcgaggaccaguggugcggcagccugaucgggcugaccagccgggcgacgugggcccagaacaucccgaccgccauccagcagguccgcucccucaucggcaacgaggaguuccuggacuacaugcccagcaugaagcgguuccgcaaggaggaggaguccgagggggccaucugguga

SEQ ID NO: 10282 - RNA, 9873 nt, Artificial Sequence
  derived and/or modified CDS sequence (opt1) from DENV-3__FJ898471__SS-prME
accagccucugccucaugaugauccugcccgcggcgcuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaagguggagaccugggcccugcgccacccgggguucaccauccucgcgcuguuccuggcccacuacaucggcaccucccucauccagaagguggugaucuucauccugcugaugcucgugacccccagcaugacgaugcggugcgugggggugggcaaccgcgacuucgucgagggccuguccggggccaccuggguggacgugguccuggagcacggcgggugcgugaccaccauggccaagaacaagcccacgcucgacaucgagcugcagaagaccgaggccacccagcuggcgacccuccggaagcugugcaucgagggcaagaucacgaacaucaccaccgacagccgcugccccacccagggcgaggccgugcugccggaggagcaggaccagaacuacgucugcaagcacacguacguggaccggggguggggcaacgggugcggccucuucgggaagggcucccuggugaccugcgccaaguuccagugccuggagcccaucgagggcaaggucgugcaguacgagaaccucaaguacaccgugaucaucaccguccacacgggggaccagcaccaggugggcaacgagacccagggggucaccgccgagaucacgccccaggccagcacgaccgaggcgauccugcccgaguacggcacccuggggcucgagugcuccccgcgcaccggccuggacuucaacgagaugauccugcucaccaugaagaacaaggccuggauggugcaccggcagugguucuucgaccugccccugcccuggacgagcggcgccaccaccgagacccccacguggaaccgcaaggagcuccuggugaccuucaagaacgcccacgccaagaagcaggaggucguggugcuggggucccaggagggcgcgaugcacaccgcccucaccggggccacggagauccagaacagcggcgggaccuccaucuucgccggccaccugaagugccggcugaagauggacaagcucgagcugaagggcaugagcuacgccaugugcaccaacaccuucguccugaagaaggagguguccgagacgcagcacgggaccauccucaucaagguggaguacaagggcgaggacgucccgugcaagauccccuucagcaccgaggacgggcagggcaaggcgcacaacggccgccugaucaccgccaaccccguggugacgaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacaccgcccuguucagcggcguguccugggucaugaagaucggcaucggggugcuccugacguggaucggccugaacagcaagaacaccuccaugagcuucuccugcaucgugaucgggaucaucacccucuaccugggcgccgucgugcaggccgacauggggugcgugaucaacuggaagggcaaggagcugaagugcggcagcgggaucuucgucaccaacgaggugcacacguggaccgagcaguacaaguuccaggccgacucccccaagcgccucgcgaccgccaucgccggcgccugggagaacggggugugcggcauccgcagcaccacgcggauggagaaccugcuguggaagcagaucgccaacgagcucaacuacauccugugggagaacaacaucaagcugaccgucguggugggggacaucaucggcguccucgagcagggcaagcgcacccugacgccccagccgauggagcugaaguacuccuggaagacgugggggaaggcgaagaucgugaccgccgagacccagaacagcuccuucaucaucgacggccccaacacccccgagugccccagcgccucccgggccuggaacgugugggaggucgaggacuacggguucggcguguucacgaccaacaucuggcucaagcugcgcgagguguacacccagcugugcgaccaccggcucaugagcgcggccgucaaggacgagcgcgccgugcacgccgacaugggcuacuggaucgagagccagaagaacggguccuggaagcuggagaaggccagccugaucgaggugaagaccugcaccuggccgaagucccacacgcucuggagcaacggcguccuggaguccgacaugaucauccccaagagccuggcggggcccaucucccagcacaacuaccggccgggcuaccacacccagaccgccgggcccuggcaccucggcaagcuggagcuggacuucaacuacugcgagggcaccacgguggugaucaccgagaacugcgggacccgcggccccagccuccggaccacgaccgucuccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggaggucgacaacuucaccaugggcgugcugugccucgccauccuguucgaggaggugaugcgggggaaguucggcaagaagcacaugaucgccggggucuucuucacguucgugcugcuccuguccggccagaucaccuggcgcgacauggcgcacacccugaucaugaucggcagcaacgccuccgaccggauggggaugggcgugaccuaccucgcccugaucgccacguucaagauccagcccuuccuggcccucggguucuuccugcgcaagcugaccagccgggagaaccuccugcugggcgucggccucgcgauggccaccacccugcagcugcccgaggacaucgagcagauggccaacgggaucgcccucggccugauggcgcugaagcucaucacgcaguucgagaccuaccagcuguggaccgcccuggugagccugaccugcuccaacacgaucuucacccugaccgucgccuggcgcaccgccacgcugauccucgccggggugagccugcugccggugugccaguccagcuccaugcggaagaccgacuggcuccccaugaccgucgcggccaugggcgugccgccccucccgcuguucaucuucagccucaaggacacccugaagcgccgcuccuggccccugaacgagggggugauggccgucggccucgugagcauccuggccuccagccugcuccggaacgacgugcccauggccggcccccuggucgccggcgggcugcucaucgccugcuacgugaucacggggaccuccgccgaccugaccguggagaaggccgccgacgucaccugggaggaggaggcggagcagacgggggugagccacaaccugaugaucaccguggacgacgacgggaccaugcgcaucaaggacgacgagaccgagaacauccucaccguccugcugaagacggcccuccugaucguguccggcaucuucccguacagcauccccgccacccugcucguguggcacaccuggcagaagcagacccagcgguccggcguccugugggacgugcccagcccgcccgagacgcagaaggccgagcuggaggaggggguguaccgcaucaagcagcagggcaucuucgggaagacccaggucggcgugggggugcagaaggagggcgucuuccacaccauguggcacgugacccggggcgccgugcucacguacaacgggaagcgccuggagcccaacugggcguccgucaagaaggaccugaucagcuacggcgggggcuggcggcucuccgcccaguggcagaagggggaggagguccaggugaucgccgucgagcccggcaagaaccccaagaacuuccagaccaugcccggcaccuuccagaccacgaccggggagaucggcgccaucgcgcuggacuucaagcccgggaccagcggcagccccaucaucaaccgcgagggcaaggugguggggcuguacggcaacggggucgugaccaagaacggcggguacguguccggcaucgcccagacgaacgccgagccggacggccccacccccgagcuggaggaggagauguucaagaagcggaaccucaccaucauggaccugcaccccgggagcggcaagacccgcaaguaccugccggccaucguccgggaggccaucaagcgccggcuccgcacgcugauccuggcgcccacccgggugguggccgccgagauggaggaggcccucaaggggcugcccauccgcuaccagaccaccgccacgaaguccgagcacaccggccgggagaucgucgaccugaugugccacgcgaccuucaccaugcgccuccugagccccgugcgggugccgaacuacaaccugaucaucauggacgaggcccacuucacggaccccgccuccaucgccgcccgcggguacaucagcacccgggucggcaugggcgaggcggccgccaucuucaugaccgccacgccgcccgggacggcggacgccuucccgcaguccaacgcccccauccaggacgaggagcgcgacauccccgagcgcagcuggaacuccggcaacgaguggaucaccgacuucgccgggaagaccgugugguucgugcccagcaucaaggccggcaacgacaucgcgaacugccuccggaagaacgggaagaaggucauccagcugucccgcaagaccuucgacacggaguaccagaagaccaagcugaacgacugggacuucguggugaccaccgacaucagcgagaugggcgccaacuucaaggccgaccgggucaucgacccgcgccggugccucaagcccgugauccugacggacggccccgagcgcgugauccuggccgggcccaugccggucaccgccgcguccgccgcccagcggcgcggccggguggggcgcaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgggagaaguccgccgccaucgacggcgaguaccgccugaagggcgagucccggaagacguucgucgagcugaugcgccgcggggaccuccccguguggcuggccuacaagguggcgagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcaccuacuccgacccgcuggcccucaaggaguucaaggacuucgccgccggccgcaagagcaucgcgcuggaccuggugacggagaucgggcgggugcccucccaccucgcccaccgcacccggaacgcccuggacaaccuggucaugcuccacaccagcgagcacggcgggaaggccuaccgccacgccguggaggagcugcccgagaccauggagacgcugcuccugcugggccucaugauccugcugaccgggggcgcgaugcuguuccugaucagcggcaaggggaucggcaagaccuccaucgggcugaucugcgugaucgccagcuccggcaugcucuggauggccgagaucccgcugcaguggaucgccagcgccaucguccuggaguucuucaugauggugcuccugauccccgagcccgagaagcagcggacgccccaggacaaccagcuggcguacguggucaucgggauccucacgcuggccgccaucaucgccgccaacgagaugggccugcucgagaccaccaagcgcgaccugggcauguccaaggagccggggguggugagccccaccuccuaccuggacgucgaccuccaccccgcgagcgccuggacgcuguacgccguggccaccaccgugaucacccccaugcugcggcacacgaucgagaacuccaccgcgaacgucagccucgccgccaucgccaaccaggccguggugcugaugggccuggacaagggguggccgaucuccaagauggaccucggcgucccccugcuggcgcucgggugcuacagccaggugaacccccugacccugaccgccgccgugcuccugcugaucacgcacuacgccaucaucggccccggccuccaggccaaggcgacccgcgaggcccagaagcggaccgccgccgggaucaugaagaacccgaccgucgacggcaucaugacgaucgaccuggaccccgugaucuacgacuccaaguucgagaagcagcugggccaggugaugcuccugguccugugcgccgugcagcuccugcugaugcgcaccagcugggcgcucugcgaggcccugacccuggccaccggccccaucacgacccucugggagggcucccccgggaaguucuggaacaccaccaucgccgugagcauggcgaacaucuuccggggcuccuaccuggccggggccggccuggccuucagcaucaugaaguccgucgggacgggcaagcgcggcaccgggagccagggcgagacccucggggagaaguggaagaagaagcugaaccagcugagccggaaggaguucgaccucuacaagaaguccggcaucaccgagguggaccgcaccgaggccaaggaggggcugaagcggggcgagaucacgcaccacgcggugagccgcggcuccgccaagcugcagugguucgucgagcggaacauggugaucccggaggggcgcgugaucgaccucggcugcgggcggggcggguggagcuacuacugcgccggccugaagaaggucaccgaggugcgcggcuacaccaagggcgggcccgggcacgaggagcccgugcccauguccaccuacggcuggaacaucgucaagcugaugagcgggaaggacguguucuaccucccgcccgagaagugcgacacgcugcugugcgacaucggcgaguccagccccucccccaccguggaggagagccggaccauccgcguccugaagaugguggagccguggcucaagaacaaccaguucugcaucaaggugcugaaccccuacaugcccaccgucaucgagcaccuggagcgccuccagcggaagcacggcgggaugcuggugcgcaacccccugucccggaacagcacgcacgagauguacuggaucuccaacggcaccgggaacaucguggccagcgucaacauggugucccgccuccugcugaaccgguucaccaugacccaccgccggccgacgaucgagaaggacguggaccucggcgccggcacccgccacgucaacgcggagcccgagacccccaacauggacgugaucggggagcggaucaagcgcaucaaggaggagcacaacagcaccuggcacuacgacgacgagaacccguacaagacgugggccuaccacggcuccuacgaggucaaggccaccgggagcgccuccagcaugaucaacggcguggugaagcugcugaccaagcccugggacgucgugcccauggugacccagauggccaugacggacaccacccccuucgggcagcagcgggucuucaaggagaagguggacacccgcacgccgcggagcaugcccggcacccgccgggugaugggcaucaccgcggaguggcucuggcgcacccuggggcggaacaagaagccccgccugugcacgcgggaggaguucaccaagaagguccgcaccaacgccgccaugggcgccguguucaccgaggagaaccagugggacuccgcgaaggccgccguggaggacgaggacuucuggaagcucgucgaccgcgagcgggagcugcacaagcuggggaagugcggcagcugcguguacaacaugauggggaagcgcgagaagaagcucggcgaguucggcaaggccaaggggucccgggccaucugguacauguggcugggcgcgcgcuaccuggaguucgaggcccucggguuccugaacgaggaccacugguucagccgggagaacuccuacagcggcguggagggggagggccugcacaagcucggcuacauccugcgcgacaucuccaagauccccgggggcgccauguacgccgacgacacggccgggugggacacccggaucaccgaggacgaccugcacaacgaggagaagaucacccagcagauggacccggagcaccgccagcucgcgaacgccaucuucaagcugacguaccagaacaaggucgugaaggugcagcggcccacccccaccggcaccgucauggacaucaucagccgcaaggaccagcggggcuccggccaggugggcaccuacgggcugaacacguucaccaacauggaggcccagcucauccgccagauggagggcgagggggugcugagcaaggccgaccuggagaacccccaccucccggagaagaagaucacccaguggcuggagaccaagggcgucgagcggcugaagcgcauggccaucuccggcgacgacugcguggugaagcccaucgacgaccgguucgcgaacgcccuccuggcccugaacgacauggggaagguccgcaaggacaucccccaguggcagcccagcaagggcuggcacgacuggcagcaggucccguucugcucccaccacuuccacgagcucaucaugaaggacgggcggaagcuggugguccccugccgcccccaggacgagcugaucggccgggcccgcaucagccagggggccggcuggucccuccgggagacggcgugccugggcaaggccuacgcccagauguggagccugauguacuuccaccgccgcgaccuccggcuggccuccaacgcgaucugcagcgccgugcccgugcacugggucccgaccucccgcaccaccuggagcauccacgcccaccaccaguggaugacgaccgaggacaugcugaccguguggaaccggguguggaucgaggacaaccccuggauggaggacaagacccccgucacgaccugggagaacgugcccuaccucgggaagcgcgaggaccaguggugcggcagccugaucgggcugaccucccgggccaccugggcccagaacaucccgacggcgauccagcagguccgcagccucaucggcaacgaggaguuccuggacuacaugcccuccaugaagcgguuccgcaaggaggaggagagcgagggggccaucugguga

SEQ ID NO: 10283 - RNA, 9873 nt, Artificial Sequence
  derived and/or modified CDS sequence (opt1) from DENV-3__FJ898472__SS-prME
accagccugugccucaugaugauccugcccgccgcccuggcguuccaccucaccucccgggacggggagccgcggaugaucguggggaagaacgagcggggcaagagccugcuguucaagaccgccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguuccugaccuucguccuccugcuguccggccagaucaccuggcgcgacauggcccacacccucaucaugaucggcagcaacgccuccgaccggauggggaugggcgugacguaccuggcccugaucgccaccuucaagauccagcccuuccucgcgcugggguucuuccugcgcaagcucaccagccgggagaaccugcugcucggcgugggccuggccauggccaccacgcugcagcuccccgaggacaucgagcagauggccaacgggaucgcgcugggccugauggcccucaagcugaucacccaguucgagaccuaccagcuguggaccgcccucaucagccugacgugcuccaacaccaucuucacccugaccgucgccuggcgcacggccacccucauccuggcgggggugagccugcucccggucugccaguccagcuccaugcggaagaccgacuggcugcccaugaccguggccgccaugggcgugccgccccugccccuguucaucuucaaccugaaggacacgcugaagcgccgcagcuggccccucaacgagggggucauggccgugggccugguguccauccuggccagcucccuccugcggaacgacguccccauggcgggcccccugguggccgggggccuccugaucgccugcuacgugaucaccgggaccagcgccgaccugaccgucgagaaggccgcggacgugacgugggaggaggaggccgagcagaccggcgugucccacaaccucaugaucaccgucgacgacgacgggaccaugcgcaucaaggacgacgagaccgagaacauccugacggugcugcucaagaccgcccugcugaucgugagcggcaucuucccguacuccauccccgccacccuccuggucuggcacaccuggcagaagcagacgcagcggagcggcgugcugugggacgugcccagcccgcccgagacccagaaggccgagcucgaggagggggucuaccgcaucaagcagcagggcaucuucgggaagacccaggugggcguggggguccagaaggagggcguguuccacaccauguggcacgugacgcggggcgcgguccugaccuacaacgggaagcgccuggagcccaacugggccagcgugaagaaggaccucaucuccuacggcgggggcuggcggcugagcgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccuccggcagccccaucaucaaccgcgagggcaagguggucgggcuguacggcaacgggguggugacgaagaacggcggguacgucagcggcaucgcccagaccaacgccgagccggacggccccacccccgagcucgaggaggagauguucaagaagcggaaccugaccaucauggaccugcaccccggguccggcaagacgcgcaaguaccucccggccaucgugcgggaggcgaucaagcgccggcugcgcacccugauccucgcccccacccggguggucgccgccgagauggaggaggcccugaaggggcugcccauccgcuaccagaccacggcgaccaagagcgagcacaccggccgggagaucguggaccucaugugccacgccaccuucacgaugcgccugcugucccccgugcgggucccgaacuacaaccucaucaucauggacgaggcccacuucaccgaccccgccagcaucgccgcgcgcggguacaucuccacccgggugggcaugggcgaggccgccgccaucuucaugaccgcgacgccgcccgggaccgccgacgccuucccgcagagcaacgcccccauccaggacgaggagcgcgacauccccgagcgcuccuggaacagcggcaacgaguggaucaccgacuucgccgggaagaccgugugguucguccccuccaucaaggcgggcaacgacaucgccaacugccugcggaagaacgggaagaaggugauccagcugagccgcaagacguucgacaccgaguaccagaagaccaagcucaacgacugggacuucguggucaccacggacaucuccgagaugggcgccaacuucaaggccgaccgggugaucgacccgcgccggugccugaagcccgugauccugaccgacggccccgagcgcgucauccucgccgggcccaugccggugaccgcggccagcgccgcccagcggcgcggccggguggggcgcaacccccagaaggagaacgaccaguacaucuucaccggccagccccugaacaacgacgaggaccacgcccacuggaccgaggcgaagaugcugcucgacaacaucaacacgcccgaggggaucaucccggcccuguucgagcccgagcgggagaaguccgccgccaucgacggcgaguaccgccugaagggcgagagccggaagaccuucgucgagcucaugcgccgcggggaccugcccguguggcuggcgcacaaggucgccuccgagggcaucaaguacaccgaccgcaaguggugcuucgacgggcagcggaacaaccagauccucgaggagaacauggacguggagaucuggaccaaggagggcgagaagaagaagcugcgcccccgguggcuggacgcccgcacguacagcgacccgcucgcccugaaggaguucaaggacuucgccgcgggccgcaaguccaucgcccuggaccucgugaccgagaucgggcggguccccacccaccuggcccaccgcacccggaacgcccuggacaaccucgugaugcugcacacgagcgagcacggcgggaaggccuaccgccacgcgguggaggagcugcccgagaccauggagacccuccugcugcucggccugaugauccugcucaccgggggcgccaugcuguuccugaucuccggcaaggggaucggcaagacgagcaucgggcucaucugcgucaucgccagcuccggcaugcuguggauggccgagaucccgcugcaguggaucgccagcgcgaucgugcucgaguucuucaugauggugcugcugauccccgagcccgagaagcagcggacgccccaggacaaccagcucgccuacgucgugaucgggauccugacccuggccgccaucaucgccgcgaacgagaugggccuccuggagaccacgaagcgcgaccugggcauguccaaggagccggggguggucagccccaccuccuaccucgacguggaccugcaccccgccagcgccuggacccuguacgccguggcgaccacggucaucacccccaugcuccggcacaccaucgagaacuccaccgccaacgugagccuggccgccaucgccaaccaggcggugguccugaugggccucgacaagggguggccgaucuccaagauggaccugggcgugccccugcucgcccuggggugcuacagccaggugaacccccugacgcucaccgccgccguccugcugcucaucacccacuacgccaucaucggccccggccugcaggcgaaggccacccgcgaggcccagaagcggacggccgccgggaucaugaagaacccgaccguggacggcaucaugaccaucgaccuggaccccgugaucuacgacuccaaguucgagaagcagcucgggcaggucaugcugcuggugcucugcgcggugcagcugcugcucaugcgcaccagcugggcccugugcgaggcccugacgcucgccaccggccccaucaccacccugugggagggcucccccgggaaguucuggaacacgaccaucgcggucagcauggccaacaucuuccggggcuccuaccuggccggggccggccucgccuucagcaucaugaaguccguggggaccggcaagcgcggcaccgggagccagggcgagacccugggggagaaguggaagaagaagcugaaccagcucucccggaaggaguucgaccuguacaagaaguccggcaucacggagguggaccgcaccgaggcgaaggaggggcugaagcggggcgagaucacccaccacgccgucagccgcggcuccgccaagcuccagugguucguggagcggaacauggugaucccggaggggcgcgucaucgaccugggcugcgggcggggcggguggagcuacuacugcgccggccugaagaaggugaccgaggugcgcggcuacacgaagggcgggcccgggcacgaggagcccguccccauguccaccuacggcuggaacaucgugaagcucaugagcgggaaggacguguucuaccugccgcccgagaagugcgacacccugcugugcgacaucggcgaguccagccccucccccaccgucgaggagagccggacgauccgcgugcucaagaugguggagccguggcugaagaacaaccaguucugcaucaagguccugaaccccuacaugcccaccgugaucgagcaccucgagcgccugcagcggaagcacggcgggaugcuggugcgcaacccccucucccggaacagcacccacgagauguacuggaucuccaacggcaccgggaacaucgucgccagcgugaacauggugucccgccugcugcucaaccgguucacgaugacccaccgccggccgaccaucgagaaggacgucgaccugggcgcgggcacccgccacgugaacgccgagcccgagacgcccaacauggacgugaucggggagcggaucaagcgcaucaaggaggagcacaacagcaccuggcacuacgacgacgagaacccguacaagaccugggccuaccacggcuccuacgaggucaaggccaccgggagcgccuccagcaugaucaacggcguggucaagcugcucacgaagcccugggacguggugcccauggucacccagauggcgaugaccgacaccacgcccuucgggcagcagcggguguucaaggagaagguggacacccgcaccccgcgguccaugcccggcacccgccgggucaugggcaucacggccgaguggcuguggcgcacccuggggcggaacaagaagccccgccucugcacccgggaggaguucaccaagaaggugcgcacgaacgccgccaugggcgcgguguucaccgaggagaaccagugggacagcgccaaggccgccgucgaggacgaggacuucuggaagcugguggaccgcgagcgggagcugcacaagcucgggaagugcggcagcugcguguacaacaugauggggaagcgcgagaagaagcugggcgaguucggcaaggccaaggggucccgggcgaucugguacauguggcugggcgcccgcuaccucgaguucgaggcccugggguuccugaacgaggaccacugguucagccgggagaacuccuacagcggcgucgagggggagggccuccacaagcugggcuacauccugcgcgacaucuccaagauccccgggggcgccauguacgccgacgacaccgcggggugggacacccggaucacggaggacgaccuccacaacgaggagaagaucacccagcagauggacccggagcaccgccagcuggccaacgccaucuucaagcugaccuaccagaacaagguggugaagguccagcggcccacccccaccggcacggugauggacaucaucagccgcaaggaccagcggggcuccggccaggugggcaccuacgggcucaacaccuucaccaacauggaggcccagcugauccgccagauggagggcgaggggguccugagcaaggccgaccucgagaacccccaccucccggagaagaagaucacgcaguggcuggagaccaagggcguggagcggcucaagcgcauggcgaucuccggcgacgacugcguggucaagcccaucgacgaccgguucgccaacgcccugcuggcccucaacgacauggggaaggugcgcaaggacaucccccaguggcagcccagcaagggcuggcacgacuggcagcaggucccguucugcucccaccacuuccacgagcugaucaugaaggacgggcggaagcuggucgugcccugccgcccccaggacgagcucaucggccgggcccgcaucagccagggggcgggcuggucccugcgggagaccgccugccugggcaaggccuacgcccagauguggagccucauguacuuccaccgccgcgaccugcggcuggcguccaacgccaucugcagcgccgugcccguccacugggugccgaccucccgcacgaccuggagcauccacgcccaccaccaguggaugaccaccgaggacaugcucacgguguggaaccgggucuggaucgaggacaaccccuggauggaggacaagacccccgugaccaccugggagaacgugcccuaccuggggaagcgcgaggaccaguggugcggcucccugaucgggcucacgagccgggccaccugggcgcagaacaucccgaccgccauccagcagguccgcagccugaucggcaacgaggaguuccuggacuacaugcccuccaugaagcgguuccgcaaggaggaggagagcgagggggccaucugguga

SEQ ID NO: 10284 - RNA, 9873 nt, Artificial Sequence
  derived and/or modified CDS sequence (opt1) from DENV-3__FJ898474__SS-prME
accagccugugccucaugaugauccugcccgccgcccuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgcccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacaccgugaucaucacggugcacaccggggaccagcaccaggucggcaacgagacccagggggugaccgccgagaucacgccccaggcgagcaccaccgaggccauccugcccgaguacggcacccuggggcucgagugcuccccgcgcaccggccuggacuucaacgagaugauccugcucacgaugaagaacaaggccuggaugguccaccggcagugguucuucgaccugccccugcccuggaccagcggcgccaccaccgagacgcccaccuggaaccgcaaggagcuccuggugaccuucaagaacgcccacgcgaagaagcaggagguggucgugcuggggucccaggagggcgccaugcacaccgcccucacgggggccaccgagauccagaacagcggcgggaccuccaucuucgccggccaccugaagugccggcugaagauggacaagcucgagcugaagggcaugagcuacgcgaugugcaccaacacguucgugcugaagaaggaggucuccgagacccagcacgggaccauccucaucaagguggaguacaagggcgaggacgugccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaucaucggcgugcucgagcagggcaagcgcacccugacgccccagccgauggagcugaaguacuccuggaagaccugggggaaggccaagaucaugaccgccgagacccagaacagcuccuucaucaucgacggccccaacacgcccgagugccccagcgcgucccgggccuggaacgugugggaggucgaggacuacggguucggcguguucaccaccaacaucuggcucaagcugcgcgagguguacacccagcugugcgaccaccggcucaugagcgccgccaucaaggacgagcgcgccguccacgcggacaugggcuacuggaucgagagccagaagaacggguccuggaagcuggagaaggccagccugaucgaggugaagaccugcacguggccgaagucccacacccucuggagcaacggcgugcuggaguccgacaugaucauccccaaggggcuggccggccccaucagccagcacaaccaccggccgggguaccacacccagaccgccggccccuggcaccucggcaagcuggagcuggacuucaacuacugcgaggggacgaccgucgugaucaccgagaacugcggcacccgcgggcccucccuccggacgaccaccgugagcggcaagcugauccacgaguggugcugccgcuccugcacccugcccccgcuccgguacaucggggaggacggcugcugguacggcauggagauccgccccaucagcgagaaggaggagaacauggucaagucccuggugagcgccggguccggcaagguggacaacuucacgauggggguccugugccucgcgauccuguucgaggaggugaugcggggcaaguucgggaagaagcacaugaucgccggcguguucuucaccuucguccugcuccugagcggccagaucaccuggcgcgacauggcccacacccugaucaugaucggguccaacgccagcgaccggaugggcaugggggugacguaccucgcccugaucgcgaccuucaagauccagcccuuccuggcccucggcuucuuccugcgcaagcugaccucccgggagaaccuccugcugggcguggggcucgccauggccaccacgcugcagcugcccgaggacaucgagcagauggcgaacggcaucgcccucgggcugauggcccugaagcucaucacccaguucgagaccuaccagcuguggaccgcccugaucagccucacgugcagcaacaccaucuucacccugaccgucgccuggcgcacggcgacccugauccucgccggcgugucccugcugccggugugccagagcuccagcaugcggaagaccgacuggcuccccauggccgucgccgccaugggggugccgccccucccgcuguucaucuucucccucaaggacacccugaagcgccgcagcuggccccugaacgagggcgucauggcggugggccucguguccauccuggccagcucccugcuccggaacgacguccccauggccgggccccugguggccggcgggcugcucaucgccugcuacgugaucacgggcaccagcgcggaccugaccgucgagaaggccgccgacaucaccugggaggaggaggccgagcagacgggggugucccacaaccugaugaucaccguggacgacgacggcaccaugcgcaucaaggacgacgagaccgagaacauccucaccguccugcugaagacggcccuccugaucgugagcggcaucuucccguacuccauccccgcgacccugcucguguggcacaccuggcagaagcagacccagcggagcgggguccugugggacgugcccagcccgcccgagacgcagaaggccgagcuggaggagggcguguaccgcaucaagcagcaggggaucuucggcaagacccaggucggggugggcgugcagaaggagggcgucuuccacaccauguggcacgugacccgcggggccgugcucacguacaacggcaagcgccuggagcccaacugggccagcgucaagaaggaccugaucuccuacgggggcggguggcggcucagcgcgcaguggcagaagggcgaggagguccaggugaucgccgucgagcccggcaagaaccccaagaacuuccagaccaugcccgggaccuuccagaccaucacgggcgagaucggggccaucgcccuggacuucaagcccggcaccuccggcagccccaucaucaaccgcgaggggaagguggugggccuguacgggaacggcgucgugaccaagaacgggggcuacgugagcggcaucgcccagaccaacgcggagccggacgggcccacgcccgagcuggaggaggagauguucaagaagcggaaccucaccaucauggaccugcaccccggcuccgggaagacccgcaaguaccugccggccaucguccgggaggccaucaagcgccggcuccgcacccugauccuggcccccacgcgggugguggccgcggagauggaggaggcccucaagggccugcccauccgcuaccagaccaccgccaccaagagcgagcacacggggcgggagaucgucgaccugaugugccacgccaccuucaccaugcgccuccugucccccgugcgggugccgaacuacaaccugaucaucauggacgaggcccacuucaccgaccccgcgagcaucgccgcccgcggcuacaucuccacgcgggucggcaugggggaggccgcggccaucuucaugaccgccacgccgcccggcaccgccgacgccuucccgcagagcaacgcgcccauccaggacgaggagcgcgacauccccgagcgcuccuggaacagcgggaacgaguggaucacggacuucgccggcaagaccgugugguucgugcccuccaucaaggccgggaacgacaucgccaacugccuccggaagaacggcaagaaggucauccagcugagccgcaagaccuucgacaccgaguaccagaagacgaagcugaacgacugggacuucguggugaccaccgacaucuccgagaugggcgccaacuucaaggcggaccgggucaucgacccgcgccggugccucaagcccgugauccugaccgacgggcccgagcgcgugauccuggccggccccaugccggucacggccgccagcgccgcgcagcggcgcgggcgggugggccgcaacccccagaaggagaacgaccaguacaucuucaccgggcagccccucaacaacgacgaggaccacgcccacuggaccgaggccaagaugcugcuggacaacaucaacacccccgagggcaucaucccggcccucuucgagcccgagcgggagaaguccgcggccaucgacggcgaguaccgccugaagggggagagccggaagaccuucguggagcugaugcgccggggcgaccuccccgucuggcuggcccacaagguggccuccgaggggaucaaguacacggaccgcaaguggugcuucgacggccagcggaacaaccagauccuggaggagaacauggacguggagaucuggaccaaggagggcgagaagaagaagcuccgcccccgguggcuggacgcccgcaccuacagcgacccgcuggcgcucaaggaguucaaggacuucgccgccgggcgcaaguccaucgcccuggaccuggucaccgagaucggccgggugcccagccaccucgcccaccgcacgcggaacgcgcuggacaaccuggucaugcuccacaccuccgagcacgggggccgcgccuaccggcacgccguggaggagcugcccgagaccauggagacccugcuccugcuggggcucaugauccugcugacgggcggcgccaugcuguuccugaucagcgggaagggcaucgggaagaccagcaucggccugaucugcgugaucgccuccagcgggaugcucuggauggcggagaucccgcugcaguggaucgccuccgccaucguccuggaguucuucaugauggugcuccugauccccgagcccgagaagcagcgcacgccccaggacaaccagcuggccuacguggucaucggcauccucacccuggccgcgaucaucgccgccaacgagaugggccugcucgagacgaccaagcgggaccuggggaugagcaaggagccgggcguggugucccccaccagcuaccuggacgucgaccuccaccccgccuccgcguggacccuguacgccguggccacgaccgugaucacccccaugcugcgccacaccaucgagaacagcacggccaacgucucccucgccgcgaucgccaaccaggccguggugcugauggggcuggacaagggcuggccgaucagcaagauggaccucggggucccccugcuggcccucggcugcuacucccaggugaacccccugacccugaccgccgcggugcuccugcugaucacccacuacgccaucaucggccccgggcuccaggccaaggccacgcgggaggcccagaagcgcaccgcggccggcaucaugaagaacccgaccgucgacgggaucaugaccaucgaccuggaccccgugaucuacgacagcaaguucgagaagcagcugggccaggugaugcuccugguccugugcgccgugcagcuccugcugaugcggacguccugggcccucugcgaggcgcugacccuggccaccggccccaucaccacgcucugggaggggagccccggcaaguucuggaacaccaccaucgccguguccauggccaacaucuuccgcgggagcuaccuggccggcgcggggcuggccuucuccaucaugaaguccgucggcaccggcaagcgggggacgggcucccagggggagacccucggcgagaaguggaagaagaagcugaaccagcugagccgcaaggaguucgaccucuacaagaaguccgggaucaccgagguggaccggaccgaggccaaggagggccugaagcgcggcgagaccacgcaccacgccgugucccgggggagcgccaagcugcagugguucgucgagcgcaacauggugaucccggagggccgggugaucgaccucgggugcggccgcgggggcugguccuacuacugcgcgggccugaagaaggucaccgaggugcggggguacaccaagggcgggcccggccacgaggagcccgugcccaugagcaccuacggguggaacaucgucaagcugauguccggcaaggacguguucuaccucccgcccgagaagugcgacacgcugcugugcgacaucggcgagagcucccccagccccaccguggaggagucccgcaccauccgcguccugaagaugguggagccguggcucaagaacaaccaguucugcaucaaggugcugaaccccuacaugcccaccgucaucgagcaccuggagcggcuccagcgcaagcacgggggcaugcuggugcggaacccccugagccgcaacuccacgcacgagauguacuggaucagcaacgggaccggcaacaucguggccuccgucaacauggugagccggcuccugcugaaccgcuucaccaugacccaccggcgcccgacgaucgagaaggacguggaccucggcgccgggacccggcacgucaacgccgagcccgagacccccaacauggacgugaucggcgagcgcaucaagcggaucaaggaggagcacaacuccaccuggcacuacgacgacgagaacccguacaagacgugggccuaccacgggagcuacgaggugaaggcgaccggcuccgccagcuccaugaucaacggggucgugaagcugcugaccaagcccugggacgugguccccauggugacccagauggccaugacggacaccacccccuucggccagcagcgcgucuucaaggagaagguggacacccggacgccgcgcagcaugcccggcacccggcgcgugauggggaucaccgccgaguggcucuggcggacccugggccgcaacaagaagccccggcugugcacgcgcgaggaguucaccaagaagguccgcaccaacgcggccaugggggccguguucaccgaggagaaccagugggacagcgccaaggccgcgguggaggacgaggacuucuggaagcucgucgaccgggagcgcgagcugcacaagcugggcaagugcggguccugcguguacaacaugaugggcaagcgggagaagaagcucggcgaguucgggaaggccaagggcagccgcgccaucugguacauguggcugggggcccgguaccuggaguucgaggcccucggcuuccugaacgaggaccacugguucucccgcgagaacagcuacuccgggguggagggcgagggccugcacaagcucggguacauccugcgggacaucagcaagauccccggcggggcgauguacgccgacgacacggccggcugggacacccgcaucaccgaggacgaccugcacaacgaggagaagaucacccagcagauggacccggagcaccggcagcucgccaacgccaucuucaagcugacguaccagaacaaggucgugaaggugcagcgccccacccccaccggcaccgucauggacaucaucucccggaaggaccagcgcgggagcggccagguggggaccuacggccugaacacguucaccaacauggaggcgcagcucauccggcagauggagggggagggcgugcuguccaaggccgaccuggagagcccccaccucccggagaagaagaucacccaguggcuggagaccaagggcgucgagcgccugaagcggauggccaucuccggggacgacugcguggugaagcccaucgacgaccgcuucgccaacgcccuccuggcgcugaacgacaugggcaagguccggaaggacaucccccaguggcagcccagcaagggguggcacgacuggcagcaggucccguucugcucccaccacuuccacgagcucaucaugaaggacggccgcaagcuggugguccccugccggccccaggacgagcugaucgggcgcgcccggaucagccagggcgccggcuggucccuccgcgagacggccugccuggggaaggcguacgcccagauguggagccugauguacuuccaccgccgggaccuccgccuggccuccaacgccaucugcagcgccgugcccgugcacugggucccgaccucccggaccaccuggagcauccacgcgcaccaccaguggaugacgaccgaggacaugcugaccguguggaaccgcguguggaucgaggacaaccccuggauggaggacaagacccccgucacgaccugggagaacgugcccuaccucggcaagcgggaggaccaguggugcgggagccugaucggccugaccucccgcgccaccugggcccagaacaucccgacggccauccagcagguccggagccucaucgggaacgaggaguuccuggacuacaugcccuccaugaagcgcuuccggaaggaggaggagagcgagggcgccaucugguga

SEQ ID NO: 10285 - RNA, 9873 nt, Artificial Sequence
  derived and/or modified CDS sequence (opt1) from DENV-3__EU529688__SS-prME
accagccucugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaccaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagacgugcaccuggccgaagucccacacccucuggagcaacggcgugcuggaguccgacaugaucauccccaagagccuggccgggcccaucucccagcacaacuaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcggggagguggacaacuucaccaugggcguccugugccucgccauccuguucgaggaggugaugcgggggaaguucggcaagaagcacaugaucgcggggguguucuucaccuucguccugcuccuguccggccagaucaccuggcgcgacauggcccacacgcugaucaugaucggcagcaacgccuccgaccggauggggaugggcgugaccuaccucgcccugaucgccaccuucaagauccagcccuuccuggcgcucggguucuuccugcgcaagcugaccagccgggagaaccuccugcugggcgugggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccaucuucacccugacggucgccuggcgcaccgccacccugauccucgcgggggugagccugcugccggucugccaguccagcuccaugcggaagaccgacuggcuccccaugacgguggccgccaugggcgugccgccccucccgcuguucaucuucagccucaaggacacccugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugacggucgagaaggccgcggacgugaccugggaggaggaggccgagcagaccggcgugagccacaaccugaugaucaccgucgacgacgacgggaccaugcgcaucaaggacgacgagacggagaacauccucaccgugcugcugaagaccgcccuccugaucguguccggcaucuucccguacagcauccccgccacccugcucgucuggcacacguggcagaagcagacccagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacacgauguggcacgugacccggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcacguuccagaccaccaccggggagaucggcgcgaucgcccuggacuucaagcccgggacgagcggcagccccaucaucaaccgcgagggcaagguggucgggcuguacggcaacgggguggugaccaagaacggcggguacgucuccggcaucgcccagaccaacgccgagccggacggccccacccccgagcuggaggaggagauguucaagaagcggaaccucacgaucauggaccugcaccccgggagcggcaagacccgcaaguaccugccggccaucgugcgggaggcgaucaagcgccggcuccgcacccugauccuggcccccacccggguggucgccgccgagauggaggaggcccucaaggggcugcccauccgcuaccagacgaccgcgaccaaguccgagcacaccggccgggagaucguggaccugaugugccacgccacguucaccaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugacggcgacgccgcccgggaccgccgacgccuucccgcaguccaacgcccccauccaggacgaggagcgcgacauccccgagcgcagcuggaacuccggcaacgaguggaucaccgacuucgccgggaagacggugugguucguccccagcaucaaggcgggcaacgacaucgccaacugccuccggaagaacgggaagaaggugauccagcugucccgcaagaccuucgacaccgaguaccagaagaccaagcugaacgacugggacuucguggucacgaccgacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggacggaggcgaagaugcugcuggacaacaucaacacccccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggacgaaggagggcgagaagaagaagcuccgcccccgguggcuggacgcccgcaccuacuccgacccgcuggcccucaaggaguucaaggacuucgccgcgggccgcaagagcaucgcccuggaccuggugaccgagaucgggcggguccccucccaccucgcccaccgcacccggaacgcccuggacaaccuggugaugcuccacacgagcgagcacggcgggaaggccuaccgccacgcgguggaggagcugcccgagaccauggagacccugcuccugcugggccucaugauccugcugaccgggggcgccaugcuguuccugaucagcggcaaggggaucggcaagacguccaucgggcugaucugcgucaucgccagcuccggcaugcucuggauggccgagaucccgcugcaguggaucgccagcgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccacgaagcgcgaccugggcauguccaaggagccggggguggucagccccaccuccuaccuggacguggaccuccaccccgccagcgccuggacccuguacgccguggcgaccacggucaucacccccaugcugcggcacaccaucgagaacuccaccgccaacgugagccucgccgccaucgccaaccaggcggugguccugaugggccuggacaagggguggccgaucuccaagauggaccucggcgugccccugcuggcccucgggugcuacagccaggugaacccccugacgcugaccgccgccguccuccugcugaucacccacuacgccaucaucggccccggccuccaggcgaaggccacccgcgaggcccagaagcggacggccgccgggaucaugaagaacccgaccguggacggcaucaugaccaucgaccuggaccccgugaucuacgacuccaaguucgagaagcagcuggggcaggucaugcuccuggugcugugcgcggugcagcuccugcugaugcgcaccagcugggcccucugcgaggcccugacgcuggccaccggccccaucaccacccucugggagggcucccccgggaaguucuggaacacgaccaucgcggucagcauggccaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggaguucgaccucuacaagaaguccggcaucacggagguggaccgcaccgaggcgaaggaggggcugaagcggggcgagaucacccaccacgccgucagccgcggcuccgccaagcugcagugguucguggagcggaacauggugaucccggaggggcgcgucaucgaccucggcugcgggcggggcggguggagcuacuacugcgccggccugaagaaggugaccgaggugcgcggcuacacgaagggcgggcccgggcacgaggagcccguccccauguccaccuacggcuggaacaucgugaagcugaugagcgggaaggacguguucuaccucccgcccgagaagugcgacacccugcugugcgacaucggcgaguccagccccucccccaccgucgaggagagccggacgauccgcgugcugaagaugguggagccguggcucaagaacaaccaguucugcaucaagguccugaaccccuacaugcccaccgugaucgagcaccuggagcgccuccagcggaagcacggcgggaugcuggugcgcaacccccugucccggaacagcacccacgagauguacuggaucuccaacggcaccgggaacaucgucgccagcgugaacauggugucccgccuccugcugaaccgguucacgaugacccaccgccggccgaccaucgagaaggacgucgaccucggcgcgggcacccgccacgugaacgccgagcccgagacgcccaacauggacgugaucggggagcggaucaagcgcaucaaggaggagcacaacagcaccuggcacuacgacgacgagaacccguacaagaccugggccuaccacggcuccuacgaggucaaggccaccgggagcgccuccagcaugaucaacggcguggucaagcugcugacgaagcccugggacguggugcccauggucacccagauggcgaugaccgacaccacgcccuucgggcagcagcggguguucaaggagaagguggacacccgcaccccgcggagcaugcccggcacccgccgggucaugggcaucacggccgaguggcucuggcgcacccuggggcggaacaagaagccccgccugugcacccgggaggaguucaccaagaaggugcgcacgaacgccgccaugggcgcgguguucaccgaggagaaccagugggacuccgccaaggccgccgucgaggacgaggacuucuggaagcucguggaccgcgagcgggagcugcacaagcuggggaagugcggcagcugcguguacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcgucgagggggagggccugcacaagcucggcuacauccugcgcgacaucuccaagauccccgggggcgccauguacgccgacgacaccgcggggugggacacccggaucacggaggacgaccugcacaacgaggagaagaucacccagcagauggacccggagcaccgccagcucgccaacgccaucuucaagcugaccuaccagaacaagguggugaagguccagcggcccacccccaccggcacggugauggacaucaucagccgcaaggaccagcggggcuccggccaggugggcaccuacgggcugaacaccuucaccaacauggaggcccagcucauccgccagauggagggcgaggggguccugagcaaggccgaccuggagaacccccaccucccggagaagaagaucacgcaguggcuggagaccaagggcguggagcggcugaagcgcauggcgaucuccggcgacgacugcguggucaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcuggucgugcccugccgcccccaggacgagcugaucggccgggcccgcaucagccagggggcgggcuggucccuccgggagaccgccugccugggcaaggccuacgcccagauguggagccugauguacuuccaccgccgcgaccuccggcuggcguccaacgccaucugcagcgccgugcccguccacugggugccgaccucccgcacgaccuggagcauccacgcccaccaccaguggaugaccaccgaggacaugcugacgguguggaaccgggucuggaucgaggacaaccccuggauggaggacaagacccccgugaccaccugggagaacgugcccuaccucgggaagcgcgaggaccaguggugcggcagccugaucgggcugacgucccgggccaccugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10286 - RNA, 9873 nt, Artificial Sequence
  derived and/or modified CDS sequence (opt1) from DENV-3__EU482613__SS-prME
accagccugugccucaugaugauccugcccgccgcccuggcguuccaccucaccagccgggacggggagccccggaugaucguggggaagaacgagcggggcaagagccugcuguucaagaccgccagcgggaucaacaugugcacccucaucgccauggaccugggggagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcggagcguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucaccuacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagaucguggggcuguacggcaacggggucgugacgaagaacggcggguacguguccggcaucgcccagaccaacgccgagccggacggccccacccccgagcuggaggaggagauguucaagaagcggaaccucaccaucauggaccugcaccccgggagcggcaagacgcgcaaguaccugccggccaucguccgggaggcgaucaagcgccggcuccgcacccugauccuggcccccacccgggugguggccgccgagauggaggaggcccucaaggggcugcccauccgcuaccagaccacggcgaccaaguccgagcacaccggccgggagaucgucgaccugaugugccacgccaccuucacgaugcgccuccugagccccgugcgggugccgaacuacaaccugaucaucauggacgaggcccacuucaccgaccccgccuccaucgccgcgcgcggguacaucagcacccgggucggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucgugcccagcaucaaggcgggcaacgacaucgccaacugccuccggaagaacgggaagaaggucauccagcugucccgcaagacguucgacaccgaguaccagaagaccaagcugaacgacugggacuucguggugaccacggacaucagcgagaugggcgccaacuucaaggccgaccgggucaucgacccgcgccggugccucaagcccgugauccugaccgacggccccgagcgcgugauccuggccgggcccaugccggucaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucguggagcugaugcgccgcggggaccuccccgucuggcuggcgcacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggugaccgagaucgggcgggugcccacccaccucgcccaccgcacccggaacgcccuggacaaccuggucaugcuccacacguccgagcacggcgggaaggccuaccgccacgcgguggaggagcugcccgagaccauggagacccugcuccugcugggccucaugauccugcugaccgggggcgccaugcuguuccugaucagcggcaaggggaucggcaagacgagcaucgggcugaucugcgugaucgccuccagcggcaugcucuggauggccgagaucccgcugcaguggaucgccuccgcgaucguccuggaguucuucaugauggugcuccugauccccgagcccgagaagcagcggacgccccaggacaaccagcuggccuacguggucaucgggauccucacccuggccgccaucaucgccgcgaacgagaugggccugcucgagaccacgaagcgcgaccugggcaugagcaaggagccggggguggugucccccaccagcuaccuggacgucgaccuccaccccgccuccgccuggacccuguacgccguggcgaccacggugaucacccccaugcugcggcacaccaucgagaacagcaccgccaacgucucccucgccgccaucgccaaccaggcgguggugcugaugggccuggacaagggguggccgaucagcaagauggaccucggcgucccccugcuggcccucgggugcuacucccaggugaacccccugacgcugaccgccgccgugcuccugcugaucacccacuacgccaucaucggccccggccuccaggcgaaggccacccgcgaggcccagaagcggacggccgccgggaucaugaagaacccgaccgucgacggcaucaugaccaucgaccuggaccccgugaucuacgacagcaaguucgagaagcagcugggccaggugaugcuccugguccugugcgcggugcagcuccugcugaugcgcaccuccugggcccucugcgaggcccugacgcuggccaccggccccaucaccacccucugggagggcagccccgggaaguucuggaacacgaccaucgcgguguccauggccaacaucuuccggggcagcuaccuggccggggccggccuggccuucuccaucaugaaguccgucgggaccggcaagcgcggcaccgggucccagggcgagacccucggggagaaguggaagaagaagcugaaccagcugagccggaaggaguucgaccucuacaagaaguccggcaucacggagguggaccgcaccgaggcgaaggaggggcugaagcggggcgagaucacccaccacgccgugucccgcggcagcgccaagcugcagugguucgucgagcggaacauggugaucccggaggggcgcgugaucgaccucggcugcgggcggggcgggugguccuacuacugcgccggccugaagaaggucaccgaggugcgcggcuacacgaagggcgggcccgggcacgaggagcccgugcccaugagcaccuacggcuggaacaucgucaagcugauguccgggaaggacguguucuaccucccgcccgagaagugcgacacccugcugugcgacaucggcgagagcucccccagccccaccguggaggagucccggacgauccgcguccugaagaugguggagccguggcucaagaacaaccaguucugcaucaaggugcugaaccccuacaugcccaccgucaucgagcaccuggagcgccuccagcggaagcacggcgggaugcuggugcgcaacccccugagccggaacuccacccacgagauguacuggaucagcaacggcaccgggaacaucguggccuccgucaacauggugagccgccuccugcugaaccgguucacgaugacccaccgccggccgaccaucgagaaggacguggaccucggcgcgggcacccgccacgucaacgccgagcccgagacgcccaacauggacgugaucggggagcggaucaagcgcaucaaggaggagcacaacuccaccuggcacuacgacgacgagaacccguacaagaccugggccuaccacggcagcuacgaggugaaggccaccggguccgccagcuccaugaucaacggcgucgugaagcugcugacgaagcccugggacgucgugcccauggugacccagauggcgaugaccgacaccacgcccuucgggcagcagcgggucuucaaggagaagguggacacccgcaccccgcggagcaugcccggcacccgccgggugaugggcaucacggccgaguggcucuggcgcacccuggggcggaacaagaagccccgccugugcacccgggaggaguucaccaagaagguccgcacgaacgccgccaugggcgcgguguucaccgaggagaaccagugggacagcgccaaggccgccguggaggacgaggacuucuggaagcucgucgaccgcgagcgggagcugcacaagcuggggaagugcggcuccugcguguacaacaugauggggaagcgcgagaagaagcucggcgaguucggcaaggccaaggggagccgggcgaucugguacauguggcugggcgcccgcuaccuggaguucgaggcccucggguuccugaacgaggaccacugguucucccgggagaacagcuacuccggcguggagggggagggccugcacaagcucggcuacauccugcgcgacaucagcaagauccccgggggcgccauguacgccgacgacaccgcggggugggacacccggaucacggaggacgaccugcacaacgaggagaagaucacccagcagauggacccggagcaccgccagcucgccaacgccaucuucaagcugaccuaccagaacaaggucgugaaggugcagcggcccacccccaccggcacggucauggacaucaucucccgcaaggaccagcggggcagcggccaggugggcaccuacgggcugaacaccuucaccaacauggaggcccagcucauccgccagauggagggcgagggggugcuguccaaggccgaccuggagaacccccaccucccggagaagaagaucacgcaguggcuggagaccaagggcgucgagcggcugaagcgcauggcgaucagcggcgacgacugcguggugaagcccaucgacgaccgguucgccaacgcccuccuggcccugaacgacauggggaagguccgcaaggacaucccccaguggcagcccuccaagggcuggcacgacuggcagcaggucccguucugcagccaccacuuccacgagcucaucaugaaggacgggcggaagcuggugguccccugccgcccccaggacgagcugaucggccgggcccgcaucucccagggggcgggcuggagccuccgggagaccgccugccugggcaaggccuacgcccagauguggucccugauguacuuccaccgccgcgaccuccggcuggcgagcaacgccaucugcuccgccgugcccgugcacugggucccgaccagccgcacgaccugguccauccacgcccaccaccaguggaugaccaccgaggacaugcugacgguguggaaccggguguggaucgaggacaaccccuggauggaggacaagacccccgucaccaccugggagaacgugcccuaccucgggaagcgcgaggaccaguggugcggcagccugaucgggcugacgagccgggccaccugggcgcagaacaucccgaccgccauccagcagguccgcucccucaucggcaacgaggaguuccuggacuacaugcccagcaugaagcgguuccgcaaggaggaggaguccgagggggccaucugguga

SEQ ID NO: 10287 - RNA, 9873 nt, Artificial Sequence
  derived and/or modified CDS sequence (opt1) from DENV-3__EU529690__SS-prME
accagccucugccucaugaugauccugcccgccgcccuggcguuccaccucaccucccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacacggggugcgugaucaacuggaagggcaaggagcugaagugcggcagcgggaucuucgugaccaacgagguccacaccuggaccgagcaguacaaguuccaggcggacucccccaagcgccucgccacggccaucgccggcgccugggagaacggggugugcggcauccgcagcaccacccggauggagaaccugcuguggaagcagaucgcgaacgagcucaacuacauccugugggagaacaacaucaagcugaccguggucgugggggacaucaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagacgugcaccuggccgaagucccacacccucuggagcaacggcgugcuggaguccgacaugaucauccccaagagccuggccgggcccaucucccagcacaacuaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcggggagguggacaacuucaccaugggcguccugugccucgccauccuguucgaggaggugaugcgggggaaguucggcaagaagcacaugaucgcggggguguucuucaccuucguccugcuccuguccggccagaucaccuggcgcgacauggcccacacgcugaucaugaucggcagcaacgccuccgaccggauggggaugggcgugaccuaccucgcccugaucgccaccuucaagauccagcccuuccuggcgcucggguucuuccugcgcaagcugaccagccgggagaaccuccugcugggcgugggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccaucuucacccugacggucgccuggcgcaccgccacccugauccucgcgggggugagccugcugccggucugccaguccagcuccaugcggaagaccgacuggcuccccaugacgguggccgccaugggcgugccgccccucccgcuguucaucuucaaccucaaggacacccugaagcgccgcagcuggccccugaacgagggggucauggccgugggccucguguccauccuggccagcucccugcuccggaacgacguccccauggcgggcccccugguggccgggggccugcucaucgccugcuacgugaucaccgggaccagcgccgaccugacggucgagaaggccgcggacgugaccugggaggaggaggccgagcagaccggcgugucccacaaccugaugaucaccgucgacgacgacgggaccaugcgcaucaaggacgacgagacggagaacauccucaccgugcugcugaagaccgcccuccugaucgugagcggcaucuucccguacuccauccccgccacccugcucgucuggcacacguggcagaagcagacccagcggagcggcgugcugugggacgugcccagcccgcccgagacccagaaggccgagcuggaggagggggucuaccgcaucaagcagcagggcaucuucgggaagacccaggugggcguggggguccagaaggagggcguguuccacacgauguggcacgugacccggggcgcgguccucaccuacaacgggaagcgccuggagcccaacugggccagcgugaagaaggaccugaucuccuacggcgggggcuggcggcucagcgcccaguggcagaagggggaggaggugcaggucaucgccguggagcccggcaagaaccccaagaacuuccagaccaugcccggcacguuccagaccaccaccggggagaucggcgcgaucgcccuggacuucaagcccgggacguccggcagccccaucaucaaccgcgagggcaagguggucgggcuguacggcaacgggguggugaccaagaacggcggguacgucagcggcaucgcccagaccaacgccgagccggacggccccacccccgagcuggaggaggagauguucaagaagcggaaccucacgaucauggaccugcaccccggguccggcaagacccgcaaguaccugccggccaucgugcgggaggcgaucaagcgccggcuccgcacccugauccuggcccccacccggguggucgccgccgagauggaggaggcccucaaggggcugcccauccgcuaccagacgaccgcgaccaagagcgagcacaccggccgggagaucguggaccugaugugccacgccacguucaccaugcgccuccugucccccgugcgggucccgaacuacaaccugaucaucauggacgaggcccacuucaccgaccccgccagcaucgccgcgcgcggguacaucuccacccgggugggcaugggcgaggccgccgccaucuucaugacggcgacgccgcccgggaccgccgacgccuucccgcagagcaacgcccccauccaggacgaggagcgcgacauccccgagcgcuccuggaacagcggcaacgaguggaucaccgacuucgccgggaagacggugugguucguccccuccaucaaggcgggcaacgacaucgccaacugccuccggaagaacgggaagaaggugauccagcugagccgcaagaccuucgacaccgaguaccagaagaccaagcugaacgacugggacuucguggucacgaccgacaucuccgagaugggcgccaacuucaaggccgaccgggugaucgacccgcgccggugccucaagcccgugauccugaccgacggccccgagcgcgucauccuggccgggcccaugccggugaccgcggccagcgccgcccagcggcgcggccggguggggcgcaacccccagaaggagaacgaccaguacaucuucaccggccagccccucaacaacgacgaggaccacgcccacuggacggaggcgaagaugcugcuggacaacaucaacacccccgaggggaucaucccggcccucuucgagcccgagcgggagaaguccgccgccaucgacggcgaguaccgccugaagggcgagagccggaagaccuucgucgagcugaugcgccgcggggaccuccccguguggcuggcgcacaaggucgccuccgagggcaucaaguacaccgaccgcaaguggugcuucgacgggcagcggaacaaccagauccuggaggagaacauggacguggagaucuggacgaaggagggcgagaagaagaagcuccgcccccgguggcuggacgcccgcaccuacagcgacccgcuggcccucaaggaguucaaggacuucgccgcgggccgcaaguccaucgcccuggaccuggugaccgagaucgggcggguccccacccaccucgcccaccgcacgcggaacgcccuggacaaccuggugaugcuccacaccagcgagcacggcgggaaggccuaccgccacgcgguggaggagcugcccgagaccauggagacccugcuccugcugggccucaugauccugcugaccggcggggccaugcuguuccugaucuccgggaaggggaucggcaagaccagcaucgggcugaucugcgucaucgccagcuccggcaugcucuggauggccgagaucccgcugcaguggaucgccagcgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagacgaccaagcgcgaccugggcauguccaaggagccggggguggucagccccaccuccuaccuggacguggaccuccaccccgccagcgccuggacccuguacgccguggcgacgaccgucaucacccccaugcugcggcacaccaucgagaacuccacggccaacgugagccucgccgccaucgccaaccaggcggugguccugaugggccuggacaagggguggccgaucuccaagauggaccucggcgugccccugcuggcccucgggugcuacagccaggugaacccccugacccugaccgccgccguccuccugcugaucacccacuacgccaucaucggccccggccuccaggcgaaggccacgcgcgaggcccagaagcggaccgccgccgggaucaugaagaacccgaccguggacggcaucaugaccaucgaccuggaccccgugaucuacgacuccaaguucgagaagcagcuggggcaggucaugcuccuggugcugugcgcggugcagcuccugcugaugcgcacgagcugggcccucugcgaggcccugacccuggccaccggccccaucaccacgcucugggagggcucccccgggaaguucuggaacaccaccaucgcggucagcauggccaacaucuuccggggcuccuaccuggccggggccggccuggccuucagcaucaugaaguccguggggaccggcaagcgcggcaccgggagccagggcgagacgcucggggagaaguggaagaagaagcugaaccagcugucccggaaggaguucgaccucuacaagaaguccggcaucaccgagguggaccgcaccgaggcgaaggaggggcugaagcggggcgagaucacccaccacgccgucagccgcggcuccgccaagcugcagugguucguggagcggaacauggugaucccggaggggcgcgucaucgaccucggcugcgggcggggcggguggagcuacuacugcgccggccugaagaaggugacggaggugcgcggcuacaccaagggcgggcccgggcacgaggagcccguccccauguccaccuacggcuggaacaucgugaagcugaugagcgggaaggacguguucuaccucccgcccgagaagugcgacacccugcugugcgacaucggcgaguccagccccucccccacggucgaggagagccggaccauccgcgugcugaagaugguggagccguggcucaagaacaaccaguucugcaucaagguccugaaccccuacaugcccaccgugaucgagcaccuggagcgccuccagcggaagcacggcgggaugcuggugcgcaacccccugucccggaacagcacccacgagauguacuggaucuccaacggcacggggaacaucgucgccagcgugaacauggugucccgccuccugcugaaccgguucaccaugacccaccgccggccgaccaucgagaaggacgucgaccucggcgcgggcacgcgccacgugaacgccgagcccgagacccccaacauggacgugaucggggagcggaucaagcgcaucaaggaggagcacaacagcaccuggcacuacgacgacgagaacccguacaagaccugggccuaccacggcuccuacgaggucaaggccacggggagcgccuccagcaugaucaacggcguggucaagcugcugaccaagcccugggacguggugcccauggucacccagauggcgaugaccgacacgacccccuucgggcagcagcggguguucaaggagaagguggacacccgcaccccgcgguccaugcccggcacgcgccgggucaugggcaucaccgccgaguggcucuggcgcacccuggggcggaacaagaagccccgccugugcacccgggaggaguucacgaagaaggugcgcaccaacgccgccaugggcgcgguguucaccgaggagaaccagugggacagcgccaaggccgccgucgaggacgaggacuucuggaagcucguggaccgcgagcgggagcugcacaagcuggggaagugcggcagcugcguguacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcgucgagggggagggccugcacaagcucggcuacauccugcgcgacaucuccaagauccccgggggcgccauguacgccgacgacaccgcggggugggacacgcggaucaccgaggacgaccugcacaacgaggagaagaucacccagcagauggacccggagcaccgccagcucgccaacgccaucuucaagcugaccuaccagaacaagguggugaagguccagcggcccacccccacgggcaccgugauggacaucaucagccgcaaggaccagcggggcuccggccaggugggcaccuacgggcugaacaccuucacgaacauggaggcccagcucauccgccagauggagggcgaggggguccugagcaaggccgaccuggagaacccccaccucccggagaagaagaucacccaguggcuggagaccaagggcguggagcggcugaagcgcauggcgaucuccggcgacgacugcguggucaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcuggucgugcccugccgcccccaggacgagcugaucggccgggcccgcaucagccagggggcgggcuggucccuccgggagaccgccugccugggcaaggccuacgcccagauguggagccugauguacuuccaccgccgcgaccuccggcuggcguccaacgccaucugcagcgccgugcccguccacugggugccgacgucccgcaccaccuggagcauccacgcccaccaccaguggaugaccacggaggacaugcugaccguguggaaccgggucuggaucgaggacaaccccuggauggaggacaagacccccgugaccacgugggagaacgugcccuaccucgggaagcgcgaggaccaguggugcggcucccugaucgggcugaccagccgggccaccugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10288 - RNA, 9873 nt, Artificial Sequence
  derived and/or modified CDS sequence (opt1) from DENV-3__EU529691__SS-prME
accagccugugccucaugaugauccugcccgccgcccuggcguuccaccucaccagccgggacggggagccgcggaugaucguggggaagaacgagcggggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgggcagggcaaggcccacagcggccgccugaucacggccaaccccgucgugaccaagaaggaggagcccgugaacaucgaggccgagccgcccuucggggaguccaacaucgucaucggcaucggggacaacgcgcugaagaucaacugguacaagaagggcagcuccaucgggaagauguucgaggccaccgcccggggcgcccgccggauggccauccugggcgacaccgcgugggacuucgggagcgugggcggggugcucaacucccugggcaagaugguccaccagaucuucgggagcgccuacacggcccuguucuccggcgugagcugggugaugaagaucggcaucgggguccuccugaccuggaucggccugaacuccaagaacaccagcauguccuucagcugcaucgccguggggaucaucacccucuaccugggcgccgugguccaggcggacauggggugcgugaucaacuggaagggcaaggagcugaagugcggcuccgggaucuucgugacgaacgagguccacaccuggaccgagcaguacaaguuccaggccgacagccccaagcgccucgccaccgccaucgccggcgcgugggagaacggggugugcggcauccgcuccacgacccggauggagaaccugcuguggaagcagaucgccaacgagcucaacuacauccugugggagaacaacaucaagcugaccguggucgugggggacaucaucggcgugcucgagcagggcaagcgcacccugacgccccagccgauggagcugaaguacagcuggaagaccugggggaaggccaagaucgucaccgccgagacccagaacuccagcuucaucaucgacggccccaacacgcccgagugccccuccgcgagccgggccuggaacgugugggagguggaggacuacggguucggcgucuucaccaccaacaucuggcucaagcugcgcgagguguacacccagcugugcgaccaccggcucaugagcgccgccgugaaggacgagcgcgccguccacgcggacaugggcuacuggaucgagucccagaagaacgggagcuggaagcuggagaaggccucccugaucgaggugaagaccugcacguggcccaagucccacacccucugguccaacggcgugcuggagagcgacaugaucauccccaagucccuggccgggcccaucagccagcacaaccaccggccgggcuaccacacccagaccgccgggcccuggcaccucggcaagcuggagcuggacuucaacuacugcgagggcacgaccgucgugaucaccgagaacugcgggacccgcggccccucccuccggacgaccaccgugagcgggaagcugauccacgaguggugcugccgcuccugcacccugcccccgcuccgguacaugggcgaggacgggugcugguacggcauggagauccgccccaucagcgagaaggaggagaacauggucaagucccuggugagcgccggcuccgggaagguggacaacuucacgaugggcguccugugccucgcgauccuguucgaggaggugaugcgggggaaguucggcaagaagcacaugaucgccgggguguucuucaccuucguccugcuccugagcggccagaucaccuggcgcgacauggcccacacccugaucaugaucggcuccaacgccagcgaccggauggggaugggcgugacguaccucgcccugaucgcgaccuucaagauccagcccuuccuggcccucggguucuuccugcgcaagcugaccagccgggagaaccuccugcugggcgugggccucgccauggccaccacgcugcagcugcccgaggacaucgagcagauggcgaacgggaucgcccucggccugauggcccugaagcucaucacccaguucgagaccuaccagcuguggaccgcccugaucucccucacgugcagcaacaccauguucacccugaccgucgccuggcgcacggcgacccugauccucgccggggugucccugcugccggucugccagagcuccagcaugcggaagaccgacuggcuccccauggccguggccgccaugggcgugccgccccucccgcuguucaucuucucccucaaggacacccugaagcgccgcagcuggccccugaacgagggggucauggcggugggccucguguccauccuggccagcucccugcuccggaacgacguccccauggccggcccccugguggccgggggccugcucaucgccugcuacgugaucacggggaccagcgcggaccugaccgucgagaaggccgccgacaucaccugggaggaggaggccgagcagacgggcgugucccacaaccugaugaucaccguggacgacgacgggaccaugcgcaucaaggacgacgagaccgagaacauccucaccguccugcugaagacggcccuccugaucgugagcggcguguucccguacuccauccccgcgacccugcucgucuggcacaccuggcagaagcagacccagcggagcggcgugcugugggacgugcccagcccgcccgagacgcagaaggccgagcuggaggagggggucuaccgcaucaagcagcagggcaucuucgggaagacccaggugggcguggggguccagaaggagggcguguuccacaccauguggcacgugacccggggcgccguccucacguacaacgggaagcgccuggagcccaacugggccagcgugaagaaggaccugaucuccuacggcgggggcuggcggcucagcgcgcaguggcagaagggggaggaggugcaggucaucgccguggagcccggcaagaaccccaagaacuuccagaccaugcccggcaccuuccagaccacgaccggggagaucggcgccaucgcccuggacuucaagcccgggaccagcggcucccccaucaucaaccgcgagggcaagguggucgggcuguacggcaacgggguggugaccaagaacggcggguacgucagcggcaucgcccagacgaacgcggagccggacggccccacccccgagcuggaggaggagauguucaagaagcggaaccucaccaucauggaccugcaccccggguccggcaagacccgcaaguaccugccggccaucgugcgggaggccaucaagcgccggcuccgcacgcugauccuggcccccacccggguggucgccgcggagauggaggaggcccucaaggggcugcccauccgcuaccagaccaccgccaccaagagcgagcacaccggccgggagaucguggaccugaugugccacgccaccuucaccaugcgccuccugucccccgugcgggucccgaacuacaaccugaucaucauggacgaggcccacuucacggaccccgcgagcaucgccgcccgcggguacaucuccacccgggugggcaugggcgaggccgcggccaucuucaugaccgccacgccgcccgggacggccgacgccuucccgcagagcaacgcgcccauccaggacgaggagcgcgacauccccgagcgcuccuggaacagcggcaacgaguggaucaccgacuucgccgggaagaccgugugguucguccccuccaucaaggccggcaacgacaucgccaacugccuccggaagaacgggaagaaggugauccagcugagccgcaagaccuucgacacggaguaccagaagaccaagcugaacgacugggacuucguggucaccaccgacaucuccgagaugggcgccaacuucaaggcggaccgggugaucgacccgcgccggugccucaagcccgugauccugacggacggccccgagcgcgucauccuggccgggcccaugccggugaccgccgccagcgccgcgcagcggcgcggccggguggggcgcaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgggagaaguccgcggccaucgacggcgaguaccgccugaagggcgagagccggaagacguucgucgagcugaugcgccgcggggaccuccccguguggcuggcccacaaggucgccuccgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcaccuacagcgacccgcuggcgcucaaggaguucaaggacuucgccgccggccgcaaguccaucgcccuggaccuggugacggagaucgggcggguccccagccaccucgcccaccgcacccggaacgcgcuggacaaccuggugaugcuccacaccagcgagcacggcgggcgcgccuaccggcacgccguggaggagcugcccgagaccauggagacgcugcuccugcugggccucaugauccugcugaccgggggcgccaugcuguuccugaucuccggcaaggggaucggcaagaccagcaucgggcugaucugcgucaucgccuccagcggcaugcucuggauggcggagaucccgcugcaguggaucgccuccgccaucgugcuggaguucuucaugauggugcuccugauccccgagcccgagaagcagcgcacgccccaggacaaccagcuggccuacgucgugaucgggauccucacgcuggccgcgaucaucgccgccaacgagaugggccugcucgagaccaccaagcgggaccugggcaugagcaaggagccggggguggucucccccaccagcuaccuggacguggaccuccaccccgccuccgcguggacgcuguacgccguggccaccaccgucaucacccccaugcugcgccacacgaucgagaacagcaccgccaacgugucccucgccgcgaucgccaaccaggccgugguccugaugggccuggacaagggguggccgaucagcaagauggaccucggcgugccccugcuggcccucgggugcuacucccaggugaacccccugacccugaccgccgcgguccuccugcugaucacgcacuacgccaucaucggccccggccuccaggccaaggccacccgggaggcccagaagcgcaccgcggccgggaucaugaagaacccgaccguggacggcaucaugacgaucgaccuggaccccgugaucuacgacagcaaguucgagaagcagcuggggcaggucaugcuccuggugcugugcgccgugcagcuccugcugaugcggaccuccugggcccucugcgaggcgcugacccuggccaccggccccaucacgacccucugggagggcagccccgggaaguucuggaacaccaccaucgccgucuccauggccaacaucuuccgcggcagcuaccuggccggggcgggccuggccuucuccaucaugaaguccguggggacgggcaagcggggcaccgggagccagggcgagacccucggggagaaguggaagaagaagcugaaccagcugucccgcaaggaguucgaccucuacaagaaguccggcaucaccgagguggaccggaccgaggccaaggaggggcugaagcgcggcgagacgacccaccacgccgucucccggggcagcgccaagcugcagugguucguggagcgcaacauggugaucccggaggggcgggucaucgaccucggcugcgggcgcggcgggugguccuacuacugcgcgggccugaagaaggugaccgaggugcggggcuacaccaagggcgggcccgggcacgaggagcccguccccaugagcacguacggcuggaacaucgugaagcugauguccgggaaggacguguucuaccucccgcccgagaagugcgacacccugcugugcgacaucggcgagagcucccccagccccaccgucgaggagucccgcaccauccgcgugcugaagaugguggagccguggcucaagaacaaccaguucugcaucaagguccugaaccccuacaugcccacggugaucgagcaccuggagcggcuccagcgcaagcacggcgggaugcuggugcggaacccccugagccgcaacuccacccacgagauguacuggaucagcaacggcaccgggaacaucgucgccuccgugaacauggugagccggcuccugcugaaccgcuucaccaugacgcaccggcgcccgaccaucgagaaggacgucgaccucggcgccggcacccggcacgugaacgccgagcccgagacccccaacauggacgugaucggggagcgcaucaagcggaucaaggaggagcacaacuccacguggcacuacgacgacgagaacccguacaagaccugggccuaccacggcagcuacgaggucaaggcgaccggguccgccagcagcaugaucaacggcguggucaagcugcugaccaagcccugggacguggugcccauggucacgcagauggccaugaccgacaccacccccuucgggcagcagcgcguguucaaggagaagguggacacgcggaccccgcgcuccaugcccggcacccggcgcgucaugggcaucaccgccgaguggcucuggcggacgcuggggcgcaacaagaagccccggcugugcacccgcgaggaguucaccaagaaggugcgcaccaacgcggccaugggcgccguguucacggaggagaaccagugggacagcgccaaggccgcggucgaggacgaggacuucuggaagcucguggaccgggagcgcgagcugcacaagcuggggaagugcggcuccugcguguacaacaugauggggaagcgggagaagaagcucggcgaguucggcaaggccaaggggagccgcgccaucugguacauguggcugggcgcccgguaccuggaguucgaggcccucggguuccugaacgaggaccacugguucucccgcgagaacagcuacuccggcgucgagggggagggccugcacaagcucggcuacauccugcgggacaucagcaagauccccgggggcgcgauguacgccgacgacaccgccgggugggacacccgcaucaccgaggacgaccugcacaacgaggagaagaucacgcagcagauggacccggagcaccggcagcucgccaacgccaucuucaagcugaccuaccagaacaagguggugaagguccagcgccccacccccaccggcaccgugauggacaucaucucccggaaggaccagcgcggcagcggccaggugggcacguacgggcugaacaccuucaccaacauggaggcgcagcucauccggcagauggagggcgaggggguccuguccaaggccgaccuggagaacccccaccucccggagaagaagaucacccaguggcuggagacgaagggcguggagcgccugaagcggauggccaucagcggcgacgacugcguggucaagcccaucgacgaccgcuucgccaacgcccuccuggcgcugaacgacauggggaaggugcggaaggacaucccccaguggcagcccuccaagggcuggcacgacuggcagcaggucccguucugcagccaccacuuccacgagcucaucaugaaggacgggcgcaagcuggucgugcccugccggccccaggacgagcugaucggccgcgcccggaucucccagggggccggcuggagccuccgcgagaccgccugccugggcaaggcguacgcccagauguggucccugauguacuuccaccgccgggaccuccgccuggccagcaacgccaucugcuccgccgugcccguccacugggugccgaccagccggaccacguggagcauccacgcgcaccaccaguggaugaccaccgaggacaugcugaccguguggaaccgcgucuggaucgaggacaaccccuggauggaggacaagacgcccgugaccaccugggagaacgugcccuaccucgggaagcgggaggaccaguggugcggcucccugaucgggcugaccagccgcgccacgugggcccagaacaucccgaccgccauccagcagguccggucccucaucggcaacgaggaguuccuggacuacaugcccagcaugaagcgcuuccggaaggaggaggaguccgagggggccaucugguga

SEQ ID NO: 10289 - RNA, 9873 nt, Artificial Sequence
  derived and/or modified CDS sequence (opt1) from DENV-3__EU569689__SS-prME
accagccugugccucaugaugauccugcccgccgcccuggcguuccaccucaccagccgggacggggagccgcggaugaucguggggaagaacgagcggggcaagagccugcuguucaagacggccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcggagcgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaaggccugggggaaggccaagaucgucaccgccgagacccagaacagcuccuucaucaucgacggccccaacacccccgagugccccagcgcgucccgggccuggaacgugugggagguggaggacuacggguucggcgucuucacgaccaacaucuggcucaagcugcgcgagguguacacccagcugugcgaccaccggcucaugagcgccgccgugaaggacgagcgcgccguccacgcggacaugggcuacuggaucgagagccagaagaacggguccuggaagcuggagaaggccagccugaucgaggugaagaccugcaccuggccgaagucccacacgcucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcaccacggucgugaucaccgagaacugcgggacccgcggccccagccuccggaccacgaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucaccaugggcguccugugccucgcgauccuguucgaggaggugaugcgggggaaguucggcaagaagcacaugaucgccgggguguucuucacguucguccugcuccuguccggccagaucaccuggcgcgaccuggcccacacccucaucaugaucggcagcaacgccuccgaccggauggggaugggcgugaccuaccuggcccugaucgcgacguucaagauccagcccuuccucgcccugggguucuuccugcgcaagcucaccagccgggagaaccugcugcucggcgugggccuggccauggccaccacccugcagcuccccgaggacaucgagcagauggcgaacgggaucgcccugggccugauggcccucaagcugaucacgcaguucgagaccuaccagcuguggaccgcccucaucagccugaccugcuccaacacgaucuucacccugaccgucgccuggcgcaccgcgacgcucauccuggccggggugagccugcucccggucugccaguccagcuccaugcggaagaccgacuggcugcccaugaccguggccgccaugggcgugccgccccugccccuguucaucuucagccugaaggacacccugaagcgccgcuccuggccccucaacgagggggucauggccgugggccuggugagcauccuggcguccagccuccugcggaacgacguccccauggccggcccccugguggccgggggccuccugaucgccugcuacgugaucacggggaccuccgccgaccugaccgucgagaaggcggccgacgugaccugggaggaggaggccgagcagacgggcgugagccacaaccucaugaucaccgucgacgacgacgggaccaugcgcaucaaggacgacgagaccgagaacauccugaccgugcugcucaagacggcccugcugaucguguccggcaucuucccguacagcauccccgccacccuccuggucuggcacaccuggcagaagcagacccagcgguccggcgugcugugggacgugcccagcccgcccgagacgcagaaggcggagcucgaggagggggucuaccgcaucaagcagcagggcaucuucgggaagacccaggugggcguggggguccagaaggagggcguguuccacaccauguggcacgugacccggggcgccguccugacguacaacgggaagcgccuggagcccaacugggccuccgugaagaaggaccucaucagcuacggcgggggcuggcggcuguccgcccaguggcagaagggggaggaggugcaggucaucgcgguggagcccggcaagaaccccaagaacuuccagaccaugcccggcaccuuccagaccacgaccggggagaucggcgccaucgcccuggacuucaagcccgggaccagcggcagccccaucaucaaccgcgagggcaagguggucgggcuguacggcaacgggguggugaccaagaacggcggguacgucuccggcaucgcccagacgaacgccgagccggacggccccacccccgagcucgaggaggagauguucaagaagcggaaccugaccaucauggaccugcaccccgggagcggcaagacccgcaaguaccucccggcgaucgugcgggaggccaucaagcgccggcugcgcacgcugauccucgcccccacccggguggucgccgccgagauggaggaggcgcugaaggggcugcccauccgcuaccagaccaccgccacgaaguccgagcacaccggccgggagaucguggaccucaugugccacgccaccuucaccaugcgccugcugagccccgugcgggucccgaacuacaaccucaucaucauggacgaggcccacuucacggaccccgccuccaucgcggcccgcggguacaucagcacccgggugggcaugggcgaggccgccgcgaucuucaugaccgccacgccgcccgggacggccgacgccuucccgcaguccaacgcccccauccaggacgaggagcgcgacauccccgagcgcagcuggaacuccggcaacgaguggaucaccgacuucgcggggaagaccgugugguucguccccagcaucaaggccggcaacgacaucgccaacugccugcggaagaacgggaagaaggugauccagcugucccgcaagaccuucgacacggaguaccagaagaccaagcucaacgacugggacuucguggucaccaccgacaucagcgagaugggcgccaacuucaaggccgaccgggugaucgacccgcgccggugccugaagcccgugauccugacggacggccccgagcgcgucauccucgcggggcccaugccggugaccgccgccuccgccgcccagcggcgcggccggguggggcgcaacccccagaaggagaacgaccaguacaucuucaccggccagccccugaacaacgacgaggaccacgcgcacuggaccgaggccaagaugcugcucgacaacaucaacacccccgaggggaucaucccggcccuguucgagcccgagcgggagaaguccgccgcgaucgacggcgaguaccgccugaagggcgagucccggaagacguucgucgagcucaugcgccgcggggaccugcccguguggcuggcccacaaggucgccagcgagggcaucaaguacaccgaccgcaaguggugcuucgacgggcagcggaacaaccagauccucgaggagaacauggacguggagaucuggaccaaggagggcgagaagaagaagcugcgcccccgguggcuggacgcccgcaccuacuccgacccgcucgcccugaaggaguucaaggacuucgcggccggccgcaagagcaucgcccuggaccucgugacggagaucgggcggguccccacccaccuggcccaccgcacccggaacgcccuggacaaccucgugaugcugcacaccuccgagcacggcgggaaggcguaccgccacgccguggaggagcugcccgagacgauggagacccuccugcugcucggccugaugauccugcucaccgggggcgccaugcuguuccugaucagcggcaaggggaucggcaagaccagcaucgggcucaucugcgucaucgccuccagcggcaugcuguggauggccgagaucccgcugcaguggaucgcguccgccaucgugcucgaguucuucaugauggugcugcugauccccgagcccgagaagcagcggacgccccaggacaaccagcucgccuacgucgugaucgggauccugacccuggccgccaucaucgcggccaacgagaugggccuccuggagaccaccaagcgcgaccugggcaugagcaaggagccggggguggucucccccacgagcuaccucgacguggaccugcaccccgccuccgccuggacccuguacgcgguggccaccaccgucaucacgcccaugcuccggcacaccaucgagaacagcaccgccaacgugucccuggccgccaucgcgaaccaggccgugguccugaugggccucgacaagggguggccgaucagcaagauggaccugggcgugccccugcucgcccuggggugcuacucccaggugaacccccugacccucacggccgccguccugcugcucaucacccacuacgcgaucaucggccccggccugcaggccaaggccacccgcgaggcccagaagcggaccgccgcggggaucaugaagaacccgacgguggacggcaucaugaccaucgaccuggaccccgugaucuacgacagcaaguucgagaagcagcucgggcaggucaugcugcuggugcucugcgccgugcagcugcugcucaugcgcaccuccugggcccugugcgaggcccugacccucgcgacgggccccaucaccacccugugggagggcagccccgggaaguucuggaacaccacgaucgccgucuccauggccaacaucuuccggggcagcuaccuggccggggccggccucgcguucuccaucaugaaguccguggggaccggcaagcgcggcaccgggucccagggcgagacccugggggagaaguggaagaagaagcugaaccagcucagccggaaggaguucgaccuguacaagaaguccggcaucaccgagguggaccgcacggaggccaaggaggggcugaagcggggcgagaucacccaccacgccgucucccgcggcagcgccaagcuccagugguucguggagcggaacauggugaucccggaggggcgcgucaucgaccugggcugcgggcggggcgggugguccuacuacugcgccggccugaagaaggugaccgaggugcgcggcuacaccaagggcgggcccgggcacgaggagcccguccccaugagcacguacggcuggaacaucgugaagcucauguccgggaaggacguguucuaccugccgcccgagaagugcgacacccugcugugcgacaucggcgagagcucccccagccccaccgucgaggagucccggaccauccgcgugcucaagaugguggagccguggcugaagaacaaccaguucugcaucaagguccugaaccccuacaugcccacggugaucgagcaccucgagcgccugcagcggaagcacggcgggaugcuggugcgcaacccccucagccggaacuccacccacgagauguacuggaucagcaacggcaccgggaacaucgucgcguccgugaacauggugagccgccugcugcucaaccgguucaccaugacgcaccgccggccgaccaucgagaaggacgucgaccugggcgccggcacccgccacgugaacgccgagcccgagacccccaacauggacgugaucggggagcggaucaagcgcaucaaggaggagcacaacuccacguggcacuacgacgacgagaacccguacaagaccugggccuaccacggcagcuacgaggucaaggccaccggguccgcgagcuccaugaucaacggcguggucaagcugcucaccaagcccugggacguggugcccauggucacgcagauggccaugaccgacaccacccccuucgggcagcagcggguguucaaggagaagguggacacgcgcaccccgcggagcaugcccggcacccgccgggucaugggcaucaccgccgaguggcuguggcgcacgcuggggcggaacaagaagccccgccucugcacccgggaggaguucaccaagaaggugcgcaccaacgccgcgaugggcgccguguucacggaggagaaccagugggacagcgccaaggccgccgucgaggacgaggacuucuggaagcugguggaccgcgagcgggagcugcacaagcucgggaagugcggcuccugcguguacaacaugauggggaagcgcgagaagaagcugggcgaguucggcaaggcgaaggggagccgggccaucugguacauguggcugggcgcccgcuaccucgaguucgaggcccugggguuccugaacgaggaccacugguucucccgggagaacagcuacuccggcgucgagggggagggccuccacaagcugggcuacauccugcgcgacaucagcaagauccccgggggcgccauguacgcggacgacaccgccgggugggacacccggaucaccgaggacgaccuccacaacgaggagaagaucacgcagcagauggacccggagcaccgccagcuggccaacgccaucuucaagcugaccuaccagaacaagguggugaagguccagcggcccacccccaccggcaccgugauggacaucaucucccgcaaggaccagcggggcagcggccaggugggcacguacgggcucaacaccuucaccaacauggaggcccagcugauccgccagauggagggcgaggggguccuguccaaggcggaccucgagaacccccaccucccggagaagaagaucacccaguggcuggagacgaagggcguggagcggcucaagcgcauggccaucagcggcgacgacugcguggucaagcccaucgacgaccgguucgccaacgcccugcuggcccucaacgacauggggaaggugcgcaaggacaucccccaguggcagcccuccaagggcuggcacgacuggcagcaggucccguucugcagccaccacuuccacgagcugaucaugaaggacgggcggaagcuggucgugcccugccgcccccaggacgagcucaucggccgggcgcgcaucucccagggggccggcuggagccugcgggagaccgccugccugggcaaggccuacgcgcagauguggucccucauguacuuccaccgccgcgaccugcggcuggccagcaacgccaucugcuccgccgugcccguccacugggugccgaccagccgcaccacgugguccauccacgcccaccaccaguggaugaccaccgaggacaugcucaccguguggaaccgggucuggaucgaggacaaccccuggauggaggacaagacgcccgugaccaccugggagaacgugcccuaccuggggaagcgcgaggaccaguggugcggcagccugaucgggcucaccagccgggcgacgugggcccagaacaucccgaccgccauccagcagguccgcucccugaucggcaacgaggaguuccuggacuacaugcccagcaugaagcgguuccgcaaggaggaggaguccgagggggccaucugguga

SEQ ID NO: 10290 - RNA, 9873 nt, Artificial Sequence
  derived and/or modified CDS sequence (opt1) from DENV-3__EU482614__SS-prME
accagccugugccucaugaugauccugcccgccgcccuggcguuccaccucaccagccgggacggggagccccggaugaucguggggaagaacgagcggggcaagagccugcuguucaagacggccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacauggggugcgugaucaacuggaagggcaaggagcugaagugcggcagcgggaucuucgugacgaacgagguccacaccuggaccgagcaguacaaguuccaggcggacucccccaagcgccucgccaccgccaucgccggcgccugggagaacggggugugcggcauccgcagcacgacccggauggagaaccugcuguggaagcagaucgcgaacgagcucaacuacauccugugggagaacaacaucaagcugaccguggucgugggggacaucaucggcgugcucgagcagggcaagcgcacccugacgccccagccgauggagcugaaguacuccuggaagaccugggggaaggccaagaucgucaccgccgagacccagaacagcuccuucaucaucgacggccccaacacgcccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccgucgugaucaccgagaacugcgggacccgcggccccagccuccggacgaccaccguguccgggaagcugauccacgaguggugcugccgcagcugcacccugcccccgcuccgguacaugggcgaggacgggugcugguacggcauggagauccgccccaucuccgagaaggaggagaacauggucaagagccugguguccgccggcagcggggagguggacaacuucacgaugggcguccugugccucgccauccuguucgaggaggugaugcgggggaaguucggcaagaagcacaugaucgcggggguguucuucaccuucguccugcuccuguccggccagaucaccuggcgcgacauggcccacacccugaucaugaucggcagcaacgccuccgaccggauggggaugggcgugacguaccucgcccugaucgccaccuucaagauccagcccuuccuggcgcucggguucuuccugcgcaagcugaccagccgggagaaccuccugcugggcgugggccucgccauggccaccacgcugcagcugcccgaggacaucgagcagauggccaacgggaucgcgcucggccugauggcccugaagcucaucacccaguucgagaccuaccagcuguggaccgcccugaucagccucacgugcuccaacaccaucuucacccugaccgucgccuggcgcacggccacccugauccucgcgggggugagccugcugccggucugccaguccagcuccaugcggaagaccgacuggcuccccaugaccguggccgccaugggcgugccgccccucccgcuguucaucuucagccucaaggacacgcugaagcgccgcuccuggccccugaacgagggggucauggccgugggccucgugagcauccuggccuccagccugcuccggaacgacguccccauggcgggcccccugguggccgggggccugcucaucgccugcuacgugaucaccgggaccuccgccgaccugaccgucgagaaggccgcggacgugacgugggaggaggaggccgagcagaccggcgugagccacaaccugaugaucaccgucgacgacgacgggaccaugcgcaucaaggacgacgagaccgagaacauccucacggugcugcugaagaccgcccuccugaucguguccggcaucuucccguacagcauccccgccacccugcucgucuggcacaccuggcagaagcagacgcagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacgcggggcgcgguccucacccacaacgggaagcgccuggagcccaacugggccuccgugaagaaggaccugaucagcuacggcgggggcuggcggcucuccgcccaguggcagaagggggaggaggugcaggucaucgccguggagcccggcaagaaccccaagaacuuccagaccaugcccggcaccuuccagacgaccaccggggagaucggcgcgaucgcccuggacuucaagcccgggaccagcggcagccccaucaucaaccgcgagggcaagguggucgggcuguacggcaacgggguggugacgaagaacggcggguacgucuccggcaucgcccagaccaacgccgagccggacggccccacccccgagcuggaggaggagauguucaagaagcggaaccucaccaucauggaccugcaccccgggagcggcaagacgcgcaaguaccugccggccaucgugcgggaggcgaucaagcgccggcuccgcacccugauccuggcccccacccggguggucgccgccgagauggaggaggcccucaaggggcugcccauccgcuaccagaccacggcgaccaaguccgagcacaccggccgggagaucguggaccugaugugccacgccaccuucacgaugcgccuccugagccccgugcgggucccgaacuacaaccugaucaucauggacgaggcccacuucaccgaccccgccuccaucgccgcgcgcggguacaucagcacccgggugggcaugggcgaggccgccgccaucuucaugaccgcgacgccgcccgggaccgccgacgccuucccgcaguccaacgcccccauccaggacgaggagcgcgacauccccgagcgcagcuggaacuccggcaacgaguggaucaccgacuucgccgggaagaccgugugguucguccccagcaucaaggcgggcaacgacaucgccaacugccuccggaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccgcgccggugccucaagcccgugauccugaccgacggccccgagcgcgucauccuggccgggcccaugccggugaccgcggccuccgccgcccagcggcgcggccggguggggcgcaacccccagaaggagaacgaccaguacaucuucaccggccagccccucaacaacgacgaggaccacgcccacuggaccgaggcgaagaugcugcuggacaacaucaacacgcccgaggggaucaucccggcccucuucgagcccgagcgggagaaguccgccgccaucgacggcgaguaccgccugaagggcgagucccggaagaccuucgucgagcugaugcgccgcggggaccuccccguguggcuggcgcacaaggucgccagcgagggcaucaaguacaccgaccgcaaguggugcuucgacgggcagcggaacaaccagauccuggaggagaacauggacguggagaucuggaccaaggagggcgagaagaagaagcuccgcccccgguggcuggacgcccgcacguacuccgacccgcuggcccucaaggaguucaaggacuucgccgcgggccgcaagagcaucgcccuggaccuggugaccgagaucgggcggguccccucccaccucgcccaccgcacccggaacgcccuggacaaccuggugaugcuccacaccagcgagcacggcgggaaggccuaccgccacgcgguggaggagcugcccgagacgauggagacccugcuccugcugggccucaugauccugcugaccgggggcgccaugcuguuccugaucagcggcaaggggaucggcaagaccuccaucgggcugaucugcgucaucgccagcuccggcaugcucuggauggccgagaucccgcugcaguggaucgccagcgcgaucgugcuggaguucuucaugauggugcuccugauccccgagcccgagaagcagcggacgccccaggacaaccagcuggccuacgucgugaucgggauccucacccuggccgccaucaucgccgcgaacgagaugggccugcucgagaccaccaagcgcgaccugggcauguccaaggagccggggguggucagccccacguccuaccuggacguggaccuccaccccgccagcgccuggacccuguacgccguggcgaccaccgucaucacgcccaugcugcggcacaccaucgagaacuccaccgccaacgugagccucgccgccaucgccaaccaggcggugguccugaugggccuggacaagggguggccgaucuccaagauggaccucggcgugccccugcuggcccucgggugcuacagccaggugaacccccugacccugacggccgccguccuccugcugaucacccacuacgccaucaucggccccggccuccaggcgaaggccacccgcgaggcccagaagcggaccgccgccgggaucaugaagaacccgacgguggacggcaucaugaccaucgaccuggaccccgugaucuacgacuccaaguucgagaagcagcuggggcaggucaugcuccuggugcugugcgcggugcagcuccugcugaugcgcaccagcugggcccucugcgaggcccugacccuggccacgggccccaucaccacccucugggagggcucccccgggaaguucuggaacaccacgaucgcggucagcauggccaacaucuuccggggcuccuaccuggccggggccggccuggccuucagcaucaugaaguccguggggaccggcaagcgcggcaccgggagccagggcgagacccucggggagaaguggaagaagaagcugaaccagcugagccggaaggaguucgaccucuacaagaaguccggcaucaccgagguggaccgcacggaggcgaaggaggggcugaagcggggcgagaucacccaccacgccgucagccgcggcuccgccaagcugcagugguucguggagcggaacauggugaucccggaggggcgcgucaucgaccucggcugcgggcggggcggguggagcuacuacugcgccggccugaagaaggugaccgaggugcgcggcuacaccaagggcgggcccgggcacgaggagcccguccccauguccacguacggcuggaacaucgugaagcugaugagcgggaaggacguguucuaccucccgcccgagaagugcgacacccugcugugcgacaucggcgaguccagccccucccccaccgucgaggagagccggaccauccgcgugcugaagaugguggagccguggcucaagaacaaccaguucugcaucaagguccugaaccccuacaugcccacggugaucgagcaccuggagcgccuccagcggaagcacggcgggaugcuggugcgcaacccccugucccggaacagcacccacgagauguacuggaucuccaacggcaccgggaacaucgucgccagcgugaacauggugucccgccuccugcugaaccgguucaccaugacgcaccgccggccgaccaucgagaaggacgucgaccucggcgcgggcacccgccacgugaacgccgagcccgagacccccaacauggacgugaucggggagcggaucaagcgcaucaaggaggagcacaacagcacguggcacuacgacgacgagaacccguacaagaccugggccuaccacggcuccuacgaggucaaggccaccgggagcgccuccagcaugaucaacggcguggucaagcugcugaccaagcccugggacguggugcccauggucacgcagauggcgaugaccgacaccacccccuucgggcagcagcggguguucaaggagaagguggacacgcgcaccccgcggagcaugcccggcacccgccgggucaugggcaucaccgccgaguggcucuggcgcacgcuggggcggaacaagaagccccgccugugcacccgggaggaguucaccaagaaggugcgcaccaacgccgccaugggcgcgguguucacggaggagaaccagugggacuccgccaaggccgccgucgaggacgaggacuucuggaagcucguggaccgcgagcgggagcugcacaagcuggggaagugcggcagcugcguguacaacaugauggggaagcgcgagaagaagcucggcgaguucggcaaggccaaggggucccgggcgaucugguacauguggcugggcgcccgcuaccuggaguucgaggcccucggguuccugaacgaggaccacugguucagccgggagaacuccuacagcggcgucgagggggagggccugcacaagcucggcuacauccugcgcgacaucuccaagauccccgggggcgccauguacgccgacgacaccgcggggugggacacccggaucaccgaggacgaccugcacaacgaggagaagaucacgcagcagauggacccggagcaccgccagcucgccaacgccaucuucaagcugaccuaccagaacaagguggugaagguccagcggcccacccccaccggcaccgugauggacaucaucagccgcaaggaccagcggggcuccggccaggugggcacguacgggcugaacaccuucaccaacauggaggcccagcucauccgccagauggagggcgaggggguccugagcaaggccgaccuggagaacccccaccucccggagaagaagaucacccaguggcuggagacgaagggcguggagcggcugaagcgcauggcgaucuccggcgacgacugcguggucaagcccaucgacgaccgguucgccaacgcccuccuggcccugaacgacauggggaaggugcgcaaggacaucccccaguggcagcccagcaagggcuggcacgacuggcagcaggucccguucugcucccaccacuuccacgagcucaucaugaaggacgggcggaagcuggucgugcccugccgcccccaggacgagcugaucggccgggcccgcaucagccagggggcgggcuggucccuccgggagaccgccugccugggcaaggccuacgcccagauguggagccugauguacuuccaccgccgcgaccuccggcuggcguccaacgccaucugcagcgccgugcccguccacugggugccgaccucccgcaccacguggagcauccacgcccaccaccaguggaugaccaccgaggacaugcugaccguguggaaccgggucuggaucgaggacaaccccuggauggaggacaagacgcccgugaccaccugggagaacgugcccuaccucgggaagcgcgaggaccaguggugcggcagccugaucgggcugaccucccgggccacgugggcgcagaacaucccgaccgccauccagcagguccgcagccucaucggcaacgaggaguuccuggacuacaugcccuccaugaagcgguuccgcaaggaggaggagagcgagggggccaucugguga

SEQ ID NO: 10291 - RNA, 9873 nt, Artificial Sequence
  derived and/or modified CDS sequence (opt1) from DENV-3__EU569690__SS-prME
accagccucugccucaugaugauccugcccgccgcccuggcguuccaccucaccucccgggacggcgagccgcggaugaucguggggaagaacgagcggggcaagagccugcuguucaagaccgccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgggacaagcgguccguggcccucgcgccccacgugggcauggggcuggacacccggacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggucccgcaaggagcuccuggugaccuucaagaacgcccacgccaagaagcaggaggucguggugcuggggagccaggagggcgcgaugcacaccgcccucacgggggccaccgagauccagaacuccggcgggaccagcaucuucgccggccaccugaagugccggcugaagauggacaagcucgagcugaagggcauguccuacgccaugugcaccaacacguucguccugaagaaggaggugagcgagacccagcacgggaccauccucaucaagguggaguacaagggcgaggacgucccgugcaagauccccuucagcaccgaggacgagcaggggaaggcgcacaacggccgccugaucacggccaaccccguggugaccaagaaggaggagcccgucaacaucgaggccgagccgcccuucggcgaguccaacaucgugaucgggaucggcgacaacgcccugaagaucaacugguacaagaaggggagcuccaucggcaagauguucgaggcgaccgcccgcggggcccgccggauggccauccugggcgacaccgccugggacuucggcagcgucgggggcguccucaacucccuggggaagauggugcaccagaucuucggcagcgcguacacggcccuguucuccggggugagcugggucaugaagaucggcaucggcgugcuccugaccuggaucgggcugaacuccaagaacaccagcauguccuucagcugcaucgccaucggcaucaucacccucuaccugggggccgugguccaggccgacaugggcugcgugaucaacuggaaggggaaggagcugaagugcggcuccggcaucuucgugacgaacgagguccacaccuggaccgagcaguacaaguuccaggcggacagccccaagcgccucgccaccgccaucgccggggccugggagaacggcgugugcgggauccgcuccacgacccggauggagaaccugcuguggaagcagaucgcgaacgagcucaacuacauccugugggagaacaacaucaagcugaccguggucgugggcgacaucaucggggugcucgagcagggcaagcgcacccugaucccccagccgauggagcugaaguacagcuggaagacguggggcaaggccaagaucgucaccgccgagacccagaacuccagcuucaucaucgacgggcccaacacccccgagugccccuccgccagccgggcguggaacgugugggagguggaggacuacggcuucggggucuucacgaccaacaucuggcucaagcugcgcgagguguacacccagcugugcgaccaccggcucaugagcgccgccgugaaggacgagcgcgccguccacgccgacaugggcuacuggaucgagucccagaagaacggcagcuggaagcuggagaaggcgucccugaucgaggugaagaccugcaccuggcccaagucccacacgcucugguccaacggggugcuggagagcgacaugaucauccccaagucccuggccggccccaucagccagcacaacuaccggccgggguaccacacccagaccgccggccccuggcaccucgggaagcuggagcuggacuucaacuacugcgagggcaccacggucgugaucaccgagaacugcggcacccgcgggcccucccuccggaccacgaccgugagcggcaagcugauccacgaguggugcugccgcuccugcacccugcccccgcuccgguacaugggggaggacggcugcugguacgggauggagauccgccccaucagcgagaaggaggagaacauggucaagucccuggugagcgccggcuccggcgagguggacaacuucaccauggggguccugugccucgccauccuguucgaggaggugaugcggggcaaguucgggaagaagcacaugaucgcgggcguguucuucacguucguccugcuccugagcgggcagaucaccuggcgcgacauggcccacacccugaucaugaucggcuccaacgccagcgaccggaugggcaugggggugaccuaccucgcccugaucgccacguucaagauccagcccuuccuggcgcucggcuucuuccugcgcaagcugaccagccgggagaaccuccugcugggggugggccucgccauggccaccacccugcagcugcccgaggacaucgagcagauggccaacggcaucgcgcucgggcugauggcccugaagcucaucacgcaguucgagaccuaccagcuguggaccgcccugaucucccugaccugcagcaacacgaucuucacccugaccgucgccuggcgcaccgccacgcugauccucgcgggcgugucccugcugccggucugccagagcuccagcaugcggaagaccgacuggcuccccaugaccguggccgccaugggggugccgccccucccgcuguucaucuucucccucaaggacacccugaagcgccgcagcuggccccugaacgagggcgucauggccguggggcucguguccauccuggccagcucccugcuccggaacgacguccccauggcgggcccccugguggccggcgggcugcucaucgccugcuacgugaucacgggcaccagcgccgaccugaccgucgagaaggccgcggacgugaccugggaggaggaggccgagcagacgggggugucccacaaccugaugaucaccgucgacgacgacggcaccaugcgcaucaaggacgacgagaccgagaacauccucaccgugcugcugaagacggcccuccugaucgugagcgggaucuucccguacuccauccccgccacccugcucgucuggcacaccuggcagaagcagacccagcggagcggcgugcugugggacgugcccagcccgcccgagacgcagaaggccgagcuggaggagggcgucuaccgcaucaagcagcaggggaucuucggcaagacccaggugggggugggcguccagaaggaggggguguuccacaccauguggcacgugacccggggcgcgguccucacguacaacggcaagcgccuggagcccaacugggccagcgugaagaaggaccugaucuccuacgggggcggguggcggcucagcgcccaguggcagaagggcgaggaggugcaggucaucgccguggagcccgggaagaaccccaagaacuuccagaccaugcccggcaccuuccagaccacgaccggcgagaucggggcgaucgcccuggacuucaagcccggcaccagcgggucccccaucaucaaccgcgagggcaagguggucggccuguacgggaacggcguggugaccaagaacgggggcuacgucagcgggaucgcccagacgaacgccgagccggacggccccacccccgagcuggaggaggagauguucaagaagcggaaccucaccaucauggaccugcaccccggcuccgggaagacccgcaaguaccugccggccaucgugcgggaggcgaucaagcgccggcuccgcacgcugauccuggcccccacccggguggucgccgccgagauggaggaggcccucaagggccugcccauccgcuaccagaccaccgcgaccaagagcgagcacacggggcgggagaucguggaccugaugugccacgccaccuucaccaugcgccuccugucccccgugcgggucccgaacuacaaccugaucaucauggacgaggcccacuucacggaccccgccagcaucgccgcgcgcggcuacaucuccacccggguggggaugggcgaggccgccgccaucuucaugaccgcgacgccgcccggcacggccgacgccuucccgcagagcaacgcccccauccaggacgaggagcgcgacauccccgagcgcuccuggaacagcgggaacgaguggaucaccgacuucgccggcaagaccgugugguucguccccuccaucaaggcggggaacgacaucgccaacugccuccggaagaacggcaagaaggugauccagcugagccgcaagaccuucgacacggaguaccagaagaccaagcugaacgacugggacuucguggucaccaccgacaucuccgagaugggggccaacuucaaggccgaccgggugaucgacccgcgccggugccucaagcccgugauccugacggacggccccgagcgcgucauccuggccggccccaugccggugaccgcggccagcgccgcccagcggcgcgggcgggugggccgcaacccccagaaggagaacgaccaguacaucuucaccgggcagccccucaacaacgacgaggaccacgcccacuggaccgaggcgaagaugcugcuggacaacaucaacacccccgagggcaucaucccggcccucuucgagcccgagcgggagaaguccgccgccaucgacggggaguaccgccugaagggcgagagccggaagacguucgucgagcugaugcgccggggcgaccuccccguguggcuggcgcacaaggucgccuccgaggggaucaaguacaccgaccgcaaguggugcuucgacggccagcggaacaaccagauccuggaggagaacauggacguggagaucuggaccaaggagggggagaagaagaagcuccgcccccgguggcuggacgcccgcaccuacagcgacccgcuggcccucaaggaguucaaggacuucgccgcgggccgcaaguccaucgcccuggaccuggugacggagaucggccggguccccacccaccucgcccaccgcacccggaacgcccuggacaaccuggugaugcuccacaccagcgagcacgggggcaaggccuaccgccacgcgguggaggagcugcccgagacgauggagacccugcuccugcuggggcucaugauccugcugaccggcggggccaugcuguuccugaucagcggcaagggcaucgggaagaccuccaucggccugaucugcgucaucgccagcuccgggaugcucuggauggccgagaucccgcugcaguggaucgccagcgcgaucgugcuggaguucuucaugauggugcuccugauccccgagcccgagaagcagcggacgccccaggacaaccagcuggccuacgucgugaucggcauccucacccuggccgccaucaucgccgcgaacgagauggggcugcucgagaccaccaagcgcgaccugggcauguccaaggagccgggcguggucagccccacguccuaccuggacguggaccuccaccccgccagcgccuggacccuguacgccguggcgaccaccgucaucacgcccaugcugcggcacaccaucgagaacuccaccgccaacgugagccucgccgccaucgccaaccaggcggugguccugauggggcuggacaagggcuggccgaucuccaagauggaccucggggugccccugcuggcccucggcugcuacagccaggugaacccccugacccugacggccgccguccuccugcugaucacccacuacgccaucaucgggcccggccuccaggcgaaggccacccgcgaggcccagaagcggaccgccgccggcaucaugaagaacccgacgguggacgggaucaugaccaucgaccuggaccccgugaucuacgacuccaaguucgagaagcagcugggccaggucaugcuccuggugcugugcgcggugcagcuccugcugaugcgcaccagcugggcccucugcgaggcccugacccuggccacggggcccaucaccacccucugggagggcucccccggcaaguucuggaacaccacgaucgcggucagcauggccaacaucuuccggggguccuaccuggccggcgccgggcuggccuucagcaucaugaaguccgugggcaccgggaagcgcggcaccggcagccagggggagacccucggcgagaaguggaagaagaagcugaaccagcugagccggaaggaguucgaccucuacaagaaguccgggaucaccgagguggaccgcacggaggcgaaggagggccugaagcgcggggagaucacccaccacgccgucagccgcggcuccgccaagcugcagugguucguggagcggaacauggugaucccggagggccgcgucaucgaccucgggugcggccgcgggggcuggagcuacuacugcgccgggcugaagaaggugaccgaggugcgcggcuacaccaagggcgggcccggccacgaggagcccguccccauguccacguacggguggaacaucgugaagcugaugagcggcaaggacguguucuaccucccgcccgagaagugcgacacccugcugugcgacaucggggaguccagccccucccccaccgucgaggagagccggaccauccgcgugcugaagaugguggagccguggcucaagaacaaccaguucugcaucaagguccugaaccccuacaugcccacggugaucgagcaccuggagcgccuccagcggaagcacggcggcaugcuggugcgcaacccccugucccggaacagcacccacgagauguacuggaucuccaacgggaccggcaacaucgucgccagcgugaacauggugucccgccuccugcugaaccgguucaccaugacgcaccgccggccgaccaucgagaaggacgucgaccucggggcgggcacccgccacgugaacgccgagcccgagacccccaacauggacgugaucggcgagcggaucaagcgcaucaaggaggagcacaacagcacguggcacuacgacgacgagaacccguacaagaccugggccuaccacggguccuacgaggucaaggccaccggcagcgccuccagcaugaucaacgggguggucaagcugcugaccaagcccugggacguggugcccauggucacgcagauggcgaugaccgacaccacccccuucggccagcagcggguguucaaggagaagguggacacgcgcaccccgcggagcaugcccgggacccgccgggucaugggcaucaccgccgaguggcucuggcgcacgcugggccggaacaagaagccccgccugugcacccgggaggaguucaccaagaaggugcgcaccaacgccgccaugggggcgguguucacggaggagaaccagugggacuccgccaaggccgccgucgaggacgaggacuucuggaagcucguggaccgcgagcgggagcugcacaagcugggcaagugcgggagcugcguguacaacaugaugggcaagcgcgagaagaagcucggggaguucggcaaggccaagggcucccgggcgaucugguacauguggcugggggcccgcuaccuggaguucgaggcccucggcuuccugaacgaggaccacugguucagccgggagaacuccuacagcggggucgagggcgaggggcugcacaagcucggcuacauccugcgcgacaucuccaagauccccggcggggccauguacgccgacgacaccgcgggcugggacacccggaucaccgaggacgaccugcacaacgaggagaagaucacgcagcagauggacccggagcaccgccagcucgccaacgccaucuucaagcugaccuaccagaacaagguggugaagguccagcggcccacccccaccgggaccgugauggacaucaucagccgcaaggaccagcggggcuccggccagguggggacguacggccugaacaccuucaccaacauggaggcccagcucauccgccagauggagggggagggcguccugagcaaggccgaccuggagaacccccaccucccggagaagaagaucacccaguggcuggagacgaaggggguggagcggcugaagcgcauggcgaucuccggcgacgacugcguggucaagcccaucgacgaccgguucgccaacgcccuccuggcccugaacgacaugggcaaggugcgcaaggacaucccccaguggcagcccagcaagggguggcacgacuggcagcaggucccguucugcucccaccacuuccacgagcucaucaugaaggacggccggaagcuggucgugcccugccgcccccaggacgagcugaucgggcgggcccgcaucagccagggcgcgggguggucccuccgggagaccgccugccugggcaaggccuacgcccagauguggagccugauguacuuccaccgccgcgaccuccggcuggcguccaacgccaucugcagcgccgugcccguccacugggugccgaccucccgcaccacguggagcauccacgcccaccaccaguggaugaccaccgaggacaugcugaccguguggaaccgggucuggaucgaggacaaccccuggauggaggacaagacgcccgugaccaccugggagaacgugcccuaccucggcaagcgcgaggaccaguggugcgggagccugaucggccugaccucccgggccacgugggcgcagaacaucccgaccgccauccagcagguccgcagccucaucgggaacgaggaguuccuggacuacaugcccuccaugaagcgguuccgcaaggaggaggagagcgagggcgccaucugguga

SEQ ID NO: 10292 - RNA, 9873 nt, Artificial Sequence
  derived and/or modified CDS sequence (opt1) from DENV-3__EU569691__SS-prME
accagccucugccucaugaugauccugcccgccgcccuggcguuccaccucaccucccgggacggggagccccggaugaucguggggaagaacgagcggggcaagagccugcuguucaagaccgccuccgggaccaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccgucgcccucgcgccccacgugggcauggggcuggacacccgcacccagacguggaugagcgccgagggcgccuggcgccagguggagaaggucgagaccugggcccugcgccacccgggguucaccauccucgcgcuguuccuggcccacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggcgacccuccggaagcugugcaucgagggcaagaucaccaacaucaccacggacagccgcugccccacccagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacacggugaucaucaccguccacaccggggaccagcaccaggugggcaacgagacccagggggucacggccgagaucacgccccaggccagcaccaccgaggcgauccugcccgaguacggcacccuggggcucgagugcuccccgcgcacgggccuggacuucaacgagaugauccugcucaccaugaagaacaaggccuggauggugcaccggcagugguucuucgaccugccccugcccuggaccagcggcgccaccacggagacccccaccuggaaccgcaaggagcuccuggugaccuucaagaacgcccacgccaagaagcaggaggucguggugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucguccugaagaaggagguguccgagacccagcacgggaccauccucaucaagguggaguacaagggcgaggacgucccgugcaagauccccuucagcacggaggacgggcagggcaaggcgcacaacggccgccugaucaccgccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacacggccugggacuucggguccgugggcgggguccucaacagccugggcaagauggugcaccagaucuucggguccgcguacaccgcccuguucagcggcguguccugggucaugaagaucggcaucggggugcuccugaccuggaucggccugaacagcaagaacaccuccaugagcuucuccugcaucgccaucgggaucaucacgcucuaccugggcgccgugguccaggccgacauggggugcgugaucaacuggaagggcaaggagcugaagugcggcagcgggaucuucgugaccaacgagguccacaccuggaccgagcaguacaaguuccaggcggacucccccaagcgccucgccacggccaucgccggcgccugggagaacggggugugcggcauccgcagcaccacccggauggagaaccugcuguggaagcagaucgcgaacgagcucaacuacauccugugggagaacaacaucaagcugaccguggucgugggggacaucaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgccucccgggcguggaacgugugggagguggaggacuacggguucggcgucuucaccaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagacgugcaccuggccgaagucccacacccucuggagcaacggcgugcuggaguccgacaugaucauccccaagagccuggccgggcccaucucccagcacaacuaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcggggagguggacaacuucaccaugggcguccugugccucgccauccuguucgaggaggugaugcgggggaaguucggcaagaagcacaugaucgcggggguguucuucaccuucguccugcuccuguccggccagaucaccuggcgcgacauggcccacacgcugaucaugaucggcagcaacgccuccgaccggauggggaugggcgugaccuaccucgcccugaucgccaccuucaagauccagcccuuccuggcgcucggguucuuccugcgcaagcugaccagccgggagaaccuccugcugggcgugggccucgccauggccacgacccugcagcugcccgaggacaucgagcagauggccaacgggaucgcgcucggccugauggcccugaagcucaucacccaguucgagaccuaccagcuguggacggcccugaucagccugaccugcuccaacaccaucuucacccugacggucgccuggcgcaccgccacccugauccucgcgggggugagccugcugccggucugccaguccagcuccaugcggaagaccgacuggcuccccaugacgguggccgccaugggcgugccgccccucccgcuguucaucuucacccucaaggacacccugaagcgccgcagcuggccccugaacgagggggucauggccgugggccucguguccauccuggccagcucccugcuccggaacgacguccccauggcgggcccccugguggccgggggccugcucaucgccugcuacgugaucaccgggacgagcgccgaccugaccgucgagaaggccgcggacgugaccugggaggaggaggccgagcagaccggcgugucccacaaccugaugaucaccgucgacgacgacgggacgaugcgcaucaaggacgacgagaccgagaacauccucaccgugcugcugaagaccgcccuccugaucgugagcggcaucuucccguacuccauccccgccacgcugcucgucuggcacaccuggcagaagcagacccagcggagcggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacccggggcgcgguccucacccacaacgggaagcgccuggagcccaacugggccagcgugaagaaggaccugaucuccuacggcgggggcuggcggcucagcgcccaguggcagaagggggaggaggugcaggucaucgccguggagcccggcaagaaccccaagaacuuccagacgaugcccggcaccuuccagaccaccacgggggagaucggcgcgaucgcccuggacuucaagcccgggaccuccggcagccccaucaucaaccgcgagggcaagguggucgggcuguacggcaacgggguggugaccaagaacggcggguacgucagcggcaucgcccagaccaacgccgagccggacggccccacgcccgagcuggaggaggagauguucaagaagcggaaccucaccaucauggaccugcaccccggguccggcaagacccgcaaguaccugccggccaucgugcgggaggcgaucaagcgccggcuccgcacccugauccuggcccccacgcggguggucgccgccgagauggaggaggcccucaaggggcugcccauccgcuaccagaccaccgcgaccaagagcgagcacacgggccgggagaucguggaccugaugugccacgccaccuucaccaugcgccuccugucccccgugcgggucccgaacuacaaccugaucaucauggacgaggcccacuucaccgaccccgccagcaucgccgcgcgcggguacaucuccacgcgggugggcaugggcgaggccgccgccaucuucaugaccgcgacgccgcccgggaccgccgacgccuucccgcagagcaacgcccccauccaggacgaggagcgcgacauccccgagcgcuccuggaacagcggcaacgaguggaucacggacuucgccgggaagaccgugugguucguccccuccaucaaggcgggcaacgacaucgccaacugccuccggaagaacgggaagaaggugauccagcugagccgcaagaccuucgacaccgaguaccagaagacgaagcugaacgacugggacuucguggucaccaccgacaucuccgagaugggcgccaacuucaaggccgaccgggugaucgacccgcgccggugccucaagcccgugauccugaccgacggccccgagcgcgucauccuggccgggcccaugccggugaccgcggccagcgccgcccagcggcgcggccggguggggcgcaacccccagaaggagaacgaccaguacaucuucacgggccagccccucaacaacgacgaggaccacgcccacuggaccgaggcgaagaugcugcuggacaacaucaacacccccgaggggaucaucccggcccucuucgagcccgagcgggagaaguccgccgccaucgacggcgaguaccgccugaagggcgagagccggaagaccuucgucgagcugaugcgccgcggggaccuccccguguggcuggcgcacaaggucgccuccgagggcaucaaguacacggaccgcaaguggugcuucgacgggcagcggaacaaccagauccuggaggagaacauggacguggagaucuggaccaaggagggcgagaagaagaagcuccgcccccgguggcuggacgcccgcaccuacagcgacccgcuggcccucaaggaguucaaggacuucgccgcgggccgcaaguccaucgcccuggaccuggugaccgagaucgggcggguccccacgcaccucgcccaccgcacccggaacgcccuggacaaccuggugaugcuccacaccagcgagcacggcgggaaggccuaccgccacgcgguggaggagcugcccgagaccauggagacgcugcuccugcugggccucaugauccugcugaccgggggcgccaugcuguuccugaucuccggcaaggggaucggcaagaccagcaucgggcugaucugcgucaucgccagcuccggcaugcucuggauggccgagaucccgcugcaguggaucgccagcgcgaucgugcuggaguucuucaugauggugcuccugauccccgagcccgagaagcagcggacgccccaggacaaccagcuggccuacgucgugaucgggauccucacgcuggccgccaucaucgccgcgaacgagaugggccugcucgagaccaccaagcgcgaccugggcauguccaaggagccggggguggucagccccaccuccuaccuggacguggaccuccaccccgccagcgccuggacgcuguacgccguggcgaccaccgucaucacccccaugcugcggcacacgaucgagaacuccaccgccaacgugagccucgccgccaucgccaaccaggcggugguccugaugggccuggacaagggguggccgaucuccaagauggaccucggcgugccccugcuggcccucgggugcuacagccaggugaacccccugacccugaccgccgccguccuccugcugaucacgcacuacgccaucaucggccccggccuccaggcgaaggccacccgcgaggcccagaagcggaccgccgccgggaucaugaagaacccgaccguggacggcaucaugacgaucgaccuggaccccgugaucuacgacuccaaguucgagaagcagcuggggcaggucaugcuccuggugcugugcgcggugcagcuccugcugaugcgcaccagcugggcccucugcgaggcccugacccuggccaccggccccaucacgacccucugggagggcucccccgggaaguucuggaacaccaccaucgcggucagcauggccaacaucuuccggggcuccuaccuggccggggccggccuggccuucagcaucaugaaguccguggggaccggcaagcgcggcacggggagccagggcgagacccucggggagaaguggaagaagaagcugaaccagcugucccggaaggaguucgaccucuacaagaaguccggcaucaccgagguggaccgcaccgaggcgaaggaggggcugaagcggggcgagaucacgcaccacgccgucagccgcggcuccgccaagcugcagugguucguggagcggaacauggugaucccggaggggcgcgucaucgaccucggcugcgggcggggcggguggagcuacuacugcgccggccugaagaaggugaccgaggugcgcggcuacaccaagggcgggcccgggcacgaggagcccguccccauguccaccuacggcuggaacaucgugaagcugaugagcgggaaggacguguucuaccucccgcccgagaagugcgacacgcugcugugcgacaucggcgaguccagccccucccccaccgucgaggagagccggaccauccgcgugcugaagaugguggagccguggcucaagaacaaccaguucugcaucaagguccugaaccccuacaugcccaccgugaucgagcaccuggagcgccuccagcggaagcacggcgggaugcuggugcgcaacccccugucccggaacagcacgcacgagauguacuggaucuccaacggcaccgggaacaucgucgccagcgugaacauggugucccgccuccugcugaaccgguucaccaugacccaccgccggccgacgaucgagaaggacgucgaccucggcgcgggcacccgccacgugaacgccgagcccgagacccccaacauggacgugaucggggagcggaucaagcgcaucaaggaggagcacaacagcaccuggcacuacgacgacgagaacccguaccggacgugggccuaccacggcuccuacgaggucaaggccaccgggagcgccuccagcaugaucaacggcguggucaagcugcugaccaagcccugggacguggugcccauggucacccagauggcgaugacggacaccacccccuucgggcagcagcgcguguucaaggagaagguggacacccggacgccgcgcuccaugcccggcacccggcgcgucaugggcaucaccgccgaguggcucuggcggacccuggggcgcaacaagaagccccggcugugcacgcgcgaggaguucaccaagaaggugcgcaccaacgccgccaugggcgcgguguucaccgaggagaaccagugggacagcgccaaggccgccgucgaggacgaggacuucuggaagcucguggaccgggagcgcgagcugcacaagcuggggaagugcggcagcugcguguacaacaugauggggaagcgggagaagaagcucggcgaguucggcaaggccaaggggucccgcgcgaucugguacauguggcugggcgcccgguaccuggaguucgaggcccucggguuccugaacgaggaccacugguucagccgcgagaacuccuacagcggcgucgagggggagggccugcacaagcucggcuacauccugcgggacaucuccaagauccccgggggcgccauguacgccgacgacacggcggggugggacacccgcaucaccgaggacgaccugcacaacgaggagaagaucacccagcagauggacccggagcaccggcagcucgccaacgccaucuucaagcugaccuaccagaacaagguggugaagguccagcgccccacgcccaccggcaccgugauggacaucaucagccggaaggaccagcgcggcuccggccaggugggcaccuacgggcugaacacguucaccaacauggaggcccagcucauccggcagauggagggcgaggggguccugagcaaggccgaccuggagaacccccaccucccggagaagaagaucacccaguggcuggagaccaagggcguggagcgccugaagcggauggcgaucuccggcgacgacugcguggucaagcccaucgacgaccgcuucgccaacgcccuccuggcccugaacgacauggggaaggugcggaaggacaucccccaguggcagcccagcaagggcuggcacgacuggcagcaggucccguucugcucccaccacuuccacgagcucaucaugaaggacgggcgcaagcuggucgugcccugccggccccaggacgagcugaucggccgcgcccggaucagccagggggcgggcuggucccuccgcgagacggccugccugggcaaggccuacgcccagauguggagccugauguacuuccaccgccgggaccuccgccuggcguccaacgccaucugcagcgccgugcccguccacugggugccgaccucccggaccaccuggagcauccacgcccaccaccaguggaugacgaccgaggacaugcugaccguguggaaccgcgucuggaucgaggacaaccccuggauggaggacaagacccccgugacgaccugggagaacgugcccuaccucgggaagcgggaggaccaguggugcggcucccugaucgggcugaccagccgcgccaccugggcgcagaacaucccgacggccauccagcagguccggagccucaucggcaacgaggaguuccuggacuacaugcccuccaugaagcgcuuccggaaggaggaggagagcgagggggccaucugguga

SEQ ID NO: 10293 - RNA, 9873 nt, Artificial Sequence
  derived and/or modified CDS sequence (opt1) from DENV-3__EU482452__SS-prME
accagccugugccucaugaugaugcugcccgccacccuggccuuccaccucaccagccgggacggcgagccccggaugaucguggggaagaacgagcgcggcaagagccugcuguucaagaccgcguccgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggacgugcaaccaggccggcgagcaccggcgcgacaagcgguccguggcccuggcgccccacgugggcauggggcuggacacccgcacccagaccuggaugagcgccgagggcgccuggcgccagguggagaaggucgagacgugggcccuccgccaccccggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccuccccgaggagcaggaccagaacuacgugugcaagcacaccuacgucgaccggggguggggcaacgggugcggccuguucgggaagggcucccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccagcaccguggaggccgugcugcccgaguacggcacccucgggcuggagugcuccccgcgcaccggccuggacuucaacgagaugauccuccugaccaugaagaacaaggcguggaugguccaccggcagugguucuucgaccugccccuccccuggacgagcggcgccaccaccgagacccccacguggaaccgcaaggagcugcuggugaccuucaagaacgcccacgccaagaagcaggagguggucgugcucgggucccaggagggcgccaugcacaccgcgcugaccggggccacggagauccagaacagcggcgggaccuccaucuucgccggccaccugaagugccggcucaagauggacaagcuggagcugaagggcaugagcuacgccaugugccucgacaccuucgugcugaagaaggaggucuccgagacccagcacgggacgauccugaucaagguggaguacaagggcgaggacgccccgugcaagauccccuucagcaccgaggacgggcagggcaaggcgcacaacggccgccugaucaccgccaaccccguggucaccaagaaggaggagcccgugaacaucgaggccgagccgcccuucggggagagcaacaucgugaucggcaucggggacaaggcccucaagaucaacugguacaagaagggcuccagcaucgggaagauguucgaggcgacggcccggggcgcccgccggauggccauccugggcgacaccgccugggacuucggguccgucggcggggugcugaacagccucggcaagauggugcaccagaucuucggguccgcguacaccgcccuguucagcggcgucuccuggaucaugaagaucggcaucggggugcugcucaccuggaucggccugaacagcaagaacacguccaugagcuucuccugcaucgugaucgggaucaucacccuguaccucggcgccgucgugcaggccgacauggggugcgugaucaacuggaagggcaaggagcugaagugcggcagcgggaucuucgucaccaacgaggugcacaccuggacggagcaguacaaguuccaggccgacucccccaagcgccuggcgaccgccaucgccggcgccugggagaacggggugugcggcauccgcagcaccacccggauggagaaccuccuguggaagcagaucgccaacgagcugaacuacauccucugggagaacaacaucaagcugacggucguggugggggacgucaucggcgugcuggagcagggcaagcgcacccucacgccccagccgauggagcugaaguacuccuggaagaccugggggaaggcgaagaucgugacggccgagacccagaacagcuccuucaucaucgacggccugaacacccccgagugccccagcgccucccgggccuggaacgucugggagguggaggacuacggguucggcguguucaccacgaacaucuggcucaagcugcgcgaggucuacacccagagcugcgaccaccggcugaugagcgcggccaucaaggacgagcgcgccgugcacgccgacaugggcuacuggaucgagucccagaagaacgggagcuggaagcucgagaaggccuccuucaucgaggugaagaccugcaccuggcccaagagccacacccugugguccaacggcguccuggagagcgacaugaucaucccgaagucccucgcggggcccaucagccagcacaaccaccggcccggcuaccacacgcagaccgccgggccguggcaccugggcaagcuggagcucgacuucaacuacugcgagggcaccaccguggugaucacggagaacugcgggacccgcggccccucccugcggaccaccacggucagcgggaagcugauccacgaguggugcugccgcuccugcacccugccgccccuccgguacaugggcgaggacgggugcugguacggcauggagauccgcccgaucaacgagaaggaggagaacauggucaagagccugguguccgccggcagcgggaagguggacaacuucaccaugggcgugcucugccuggccauccuguucgaggaggugaugcgggggaaguucggcaagaagcacaugaucgccgggguccucuucaccuucgugcugcugcucuccggccagaucacguggcgcgacauggcgcacacccugaucaugaucggcagcaacgccuccgaccggauggggaugggcgugaccuaccuggcccucaucgccaccuucaagauccagcccuuccuggcccugggguucuuccuccgcaagcugacgagccgggagaaccugcuccugggcgucggccuggcgauggccaccacccuccagcugcccgaggacaucgagcagauggccaacgggaucgcccugggccucaugacccugaagcugaucacgcaguucgagaccuaccagcucuggaccgcgcuggugagccugaccugcuccaacacgaucuucacccucaccgucgccuggcgcaccgccacgcugauccuggccggggugagccuccugccccugugccaguccagcuccaugcggaagaccgacuggcucccgaugaccguggccgcgaugggcgucagcccccugccccuguucaucuucucccucaaggacacccccaagcgccgcagcuggccgcugaacgagggggugauggccgugggccuggucuccauccucgccagcucccugcugcggaacgacgugcccauggccggcccccucguggccgggggccugcugaucgcgugcuacgucaucacggggaccagcgccgaccucaccguggagaaggccgccgacgugaccugggaggaggaggccgagcagacgggcgucucccacaaccugaugaucaccguggacgacgacgggaccaugcgcaucaaggacgacgagaccgagaacauccugaccgugcuccugaagacggcgcugcucaucgucagcggcaucuuccccuacuccaucccggccacccugcugguguggcacaccuggcagaagcagacccagcggagcggcgugcucugggacguccccagcccgcccgagacgcagaaggccgagcuggaggaggggguguaccgcaucaagcagcagggcaucuucgggaagacccaggugggcgucggggugcagaaggagggcguguuccacaccauguggcacgucacccggggcgccgugcugacgcacaacgggaagcgccucgagccgaacugggccagcgugaagaaggaccugaucuccuacggcgggggcuggcggcugagcgcgcaguggcagaagggggaggagguccaggugaucgccguggagcccggcaagaaccccaagaacuuccagaccaugcccggcaucuuccagaccaccacgggggagaucggcgccaucgcccuggacuucaagccggggaccagcggcucccccaucaucaaccgcgagggcaaggucguggggcucuacggcaacgggguggucaccaagaacggcggguacgugagcggcaucgcgcagaccaacgccgagcccgacggcccgacgcccgagcuggaggaggagauguucaagaagcggaaccugaccaucauggaccuccaccccggguccggcaagacccgcaaguaccugcccgccaucgugcgggaggccaucaagcgccggcugcgcacccucauccuggccccgacgcgggucguggcggccgagauggaggaggcccugaaggggcuccccauccgcuaccagaccaccgccaccaagagcgagcacacgggccgggagaucguggaccugaugugccacgccaccuucaccaugcgccugcucucccccguccgggugcccaacuacaaccugaucaucauggacgaggcgcacuucaccgacccggccagcaucgccgcccgcggguacaucuccacgcgggugggcaugggcgaggccgcggccaucuucaugaccgccacgccgcccgggaccgccgaggcguucccccagagcaacgccccgauccaggacgaggagcgcgacauccccgagcgcuccuggaacagcggcaacgaguggaucacggacuucgucgggaagaccgugugguucgugcccuccaucaaggccggcaacgacaucgccaacugccugcggaagaacgggaagaaggucauccagcucagccgcaagaccuucgacaccgaguaccagaagacgcggcugaacgacugggacuucguggugaccaccgacaucuccgagaugggcgccaacuucaaggcggaccgcgucaucgacccccggcgcugccugaagccggugauccucaccgacggccccgagcgggugauccuggccgggcccaugcccgucacggccgccagcgccgcgcagcgccggggccgcguggggcggaacccgcagaaggagaacgaccaguacaucuucaccggccagccccugaacaacgacgaggaccacgcccacuggaccgaggccaagaugcuccuggacaacaucaacacccccgaggggaucauccccgcccuguucgagccggagcgcgagaaguccgccgcgaucgacggcgaguaccggcucaagggcgagagccgcaagaccuucgucgagcugaugcggcgcggggaccugcccguguggcucgcccacaagguggccuccgagggcaucaaguacacggaccggaaguggugcuucgacggggagcgcaacaaccagauccuggaggagaacauggacgucgagaucuggaccaaggagggcgagcggaagaagcugcgcccccgcuggcucgacgcccggaccuacagcgacccccuggcgcugaaggaguucaaggacuucgccgccggccgcaaguccaucgcccucgaccuggugaccgagaucgggcgggugccgagccaccuggccuaccgcacgcggaacgcgcucgacaaccuggucaugcugcacaccagcgagcacggcgggcgcgccuaccggcacgccguggaggagcuccccgagaccauggagacccugcugcuccugggccugaugauccuccugaccggcggggccaugcuguuccucaucuccgggaaggggaucggcaagaccagcaucgggcugaucugcgugaucgucuccagcggcaugcuguggauggccgacaucccccuccaguggaucgcguccgccaucgugcuggaguucuucaugauggugcugcucaucccggagcccgagaagcagcgcacgccccaggacaaccagcuggccuacgucgugaucgggauccugacccucgccgccaucguggcggccaacgagaugggccugcuggagacgaccaagcgggaccucggcaugagcaaggagcccggggucguguccccgaccagcuaccuggacguggaccugcaccccgccuccgccuggacccucuacgccgucgcgacgaccgugaucacccccaugcugcgccacaccaucgagaacagcacggccaacgugucccuggccgccaucgcgaaccaggccgucgugcucaugggccuggacaagggguggcccaucagcaagauggaccugggcgugccgcuccuggcccuggggugcuacucccaggucaacccccucacccugaccgccgccgugcugcuccuggugacccacuacgcgaucaucggccccggccugcaggccaaggccacgcgggaggcccagaagcgcaccgccgcggggaucaugaagaaccccaccgucgacggcaucaugaccaucgaccucgacccggugaucuacgacagcaaguucgagaagcagcugggccaggugaugcugcucguccugugcgccgugcagcugcuccugaugcggacguccugggcccugugcgaggcccucacccuggccaccggccccaucaccacgcugugggagggcagccccgggaaguucuggaacaccaccaucgcgguguccauggccaacaucuuccgcggcagcuaccucgccggggccggccuggcguucuccaucaugaaguccgucgggaccggccggcgcggcacggggagccagggcgagacccugggggagaaguggaagaagaagcucaaccagcugucccggaaggaguucgaccuguacaagaaguccggcaucaccgagguggaccgcaccgaggccaaggaggggcucaagcggggcgagaccacgcaccacgccgugucccgcggcagcgccaagcugcagugguucgucgagcggaacauggugauccccgaggggcgcgugaucgaccugggcugcgggcgcggcgggugguccuacuacugcgccggccucaagaaggucaccgaggugcggggcuacaccaagggcgggccggggcacgaggagcccgugcccaugagcaccuacggcuggaacaucgucaagcugauguccgggaaggacguguucuaccugcccccggagaagugcgacacgcugcucugcgacaucggcgagagcucccccagccccaccguggaggagucccgcaccauccggguccugaagaugguggagcccuggcugaagaacaaccaguucugcaucaaggugcucaacccguacaugcccaccgucaucgagcaccuggagcgccugcagcggaaguacggcgggaugcucgugcgcaacccccugagccggaacuccacgcacgagauguacuggaucagcaacggcaccgggaacaucguguccagcgucaacauggugucccgccugcuccugaaccgguucaccaugacccaccgccggcccacgaucgagaaggacgucgaccugggcgcgggcacccgccacgugaacgccgagccggagacccccaacauggacgugaucggggagcggaucaagcgcaucaaggaggagcacagcuccaccuggcacuacgacgacgagaaccccuacaagacgugggccuaccacggcagcuacgaggucaaggccaccgggagcgccuccagcaugaucaacggcguggugaagcuccugaccaagccgugggacgucgugcccauggugacccagauggcgaugacggacaccacccccuucgggcagcagcgggucuucaaggagaagguggacacccgcacgccccggccgaugcccggcacccgcaaggugauggagaucaccgccgaguggcuguggcggacccucggccgcaacaagaagccccgccugugcacgcgggaggaguucaccaagaagguccgcaccaacgccgccaugggggccguguucaccgaggagaaccagugggacuccgcgcgggccgccguggaggacgaggaguucuggaagcuggucgaccgcgagcgggagcuccacaagcugggcaagugcgggagcugcguguacaacaugaugggcaagcgcgagaagaagcugggggaguucggcaaggccaagggcucccgggcgaucugguacauguggcucggggcccgcuaccuggaguucgaggcccugggcuuccucaacgaggaccacugguucagccgggagaacuccuacagcgggguggagggcgaggggcugcacaagcugggcuacauccuccgcgacaucuccaagauccccggcggggccauguacgccgacgacacggcgggcugggacacccggaucaccgaggacgaccugcacaacgaggagaagaucacccagcagauggacccggagcaccgccagcuggccaacgccaucuucaagcucacguaccagaacaaggucgugaaggugcagcggcccacccccaaggggaccgucauggacaucaucagccgcaaggaccagcggggcuccggccagguggggaccuacggccugaacaccuucacgaacauggaggcccagcuggugcgccagauggagggggagggcguccucagcaaggccgaccuggagaacccccaccuccuggagaagaagaucacccaguggcuggagaccaaggggguggagcggcugaagcgcauggcgaucuccggcgacgacugcguggucaagccgaucgacgaccgguucgccaacgcccuccuggcccugaacgacaugggcaaggugcgcaaggacaucccccaguggcagcccagcaagggguggcacgacuggcagcagguccccuucugcucccaccacuuccacgagcucaucaugaaggacggccggaagcuggucgugccgugccgcccccaggacgagcugaucgggcgcgcccggaucagccagggcgcgggguggucccucaaggagaccgccugccugggcaaggccuacgcccagauguggagccugauguacuuccaccgccgggaccuccgccuggccuccaacgcgaucugcagcgccgugcccguccacuggauccccacgagccggaccaccugguccauccacgcccaccaccaguggaugaccacggaggacaugcugaccguguggaaccgcguguggaucgaggacaacccguggauggaggacaagacccccgucaccacgugggaggacgugcccuaccucggcaagcgggaggaccaguggugcgggagccugaucggccugaccucccgcgccaccugggcgcagaacauccucaccgccauccagcagguccggagccugaucggggacgaggaguuccuggacuacaugcccuccaugaagcgcuuccggaaggaggaggagagcgagggcgccaucugguga

SEQ ID NO: 10294 - RNA, 9873 nt, Artificial Sequence
  derived and/or modified CDS sequence (opt1) from DENV-3__EU482453__SS-prME
accagccugugccucaucaugaugcugcccgccacccuggccuuccaccucaccagccgcgacggcgagccgcggaugaucguggggaagaacgagcgcggcaagagccugcuguucaagaccgcguccgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgcgacaagcgguccgucgcccuggcgccccacgugggcauggggcuggacacccgcacccagaccuggaugagcgccgagggcgccuggcggcaggucgagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgugugcaagcacaccuacgucgaccggggguggggcaacgggugcggccuguucgggaagggcucccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccagcaccguggaggccgugcugcccgaguacggcacccucgggcuggagugcuccccgcgcaccggccuggacuucaacgagaugauccuccugaccaugaagaacaaggcguggaugguccaccggcagugguucuucgaccugccccuccccuggacgagcggcgccaccaccgagacccccacguggaaccgcaaggagcugcuggugaccuucaagaacgcccacgccaagaagcaggagguggucgugcucgggucccaggagggcgccaugcacaccgcgcugaccggggccacggagauccagaacagcggcgggaccuccaucuucgccggccaccugaagugccggcucaagauggacaagcuggagcugaagggcaugagcuacgccaugugccucaacaccuucgugcugaagaaggaggucuccgagacccagcacgggacgauccugaucaagguggaguacaagggcgaggacgccccgugcaagauccccuucagcaccgaggacgggcagggcaaggcgcacaacggccgccugaucaccgccaaccccguggucaccaagaaggaggagcccgugaacaucgaggccgagccgcccuucggggagagcaacaucgugaucggcaucggggacaaggcccucaagaucaacugguacaagaagggcuccagcaucgggaagauguucgaggcgacggcccggggcgcccgccggauggccauccugggcgacaccgccugggacuucggguccgucggcggggugcugaacagccucggcaagauggugcaccagaucuucggguccgcguacaccgcccuguucagcggcgucuccuggaucaugaagaucggcaucggggugcugcucaccuggaucggccugaacagcaagaacacguccaugagcuucuccugcaucgccaucgggaucaucacccuguaccucggcgccgugguccaggccgacauggggugcgcgaucaacuggaagggcaaggagcugaagugcggcagcgggaucuucgugaccaacgaggugcacaccuggacggagcaguacaaguuccaggccgacucccccaagcgccuggccaccgccaucgccggcgcgugggagaacggggucugcggcauccgcagcaccacccggauggagaaccuccuguggaagcagaucgccaacgagcugaacuacauccucugggagaacaacaucaagcugacggugguggucggggacaucaucggcgugcuggagcagggcaagcgcacccucacgccccagccgauggagcugaaguacuccuggaagaccugggggaaggccaagaucgugacggccgagacccagaacagcuccuucaucaucgacggccccaacacccccgagugccccagcgcgucccgggccuggaacgucugggagguggaggacuacggguucggcguguucaccacgaacaucuggcugaagcuccgcgaggucuacacccagagcugcgaccaccggcugaugagcgccgccaucaaggacgagcgcgccgugcacgcggacaugggcuacuggaucgagucccagaagaacgggagcuggaagcuggagaaggccuccuucaucgaggugaagaccugcaccuggcccaagagccacacccucugguccaacggcguccuggagagcgacaugaucauccccaagucccuggccgggcccaucagccagcacaaccaccggccgggcuaccacacgcagaccgccgggcccuggcaccucggcaagcuggagcuggacuucaacuacugcgagggcaccaccguggugaucacggagaacugcgggacccgcggccccucccuccggaccaccacggucagcgggaagcugauccacgaguggugcugccgcuccugcacccugcccccgcuccgguacaugggcgaggacgggugcugguacggcauggagauccgccccaccaacgagaaggaggagaacauggucaagagccugguguccgccggcagcgggaaggucgacaacuucaccaugggcgugcugugccucgcgauccuguucgaggaggugaugcgggggaaguucggcaagaagcacaugaucgccgggguccuguucacguucgugcuccugcuguccggccagaucaccuggcgcgacauggcccacacccucaucaugaucggcagcaacgccuccgaccggauggggaugggcgugaccuaccuggcccugaucgcgacguucaagauccagcccuuccucgcccugggguucuuccugcgcaagcucaccagccgggagaaccugcugcucggcgucggccuggccauggccaccacccugcagcuccccgaggacaucgagcagauggcgaacgggaucgcccugggccugaugacgcucaagcugaucacccaguucgagaccuaccagcuguggaccgcccucgugagccugacgugcuccaacaccaucuucacccugaccguggccuggcgcacggccacccucauccuggcgggggucagccugcucccgcugugccaguccagcuccaugcggaagaccgacuggcugcccaugaccguggccgccaugggcgugccgccccugccgcuguucaucuucagccugaaggacacgcccaagcgccgcuccuggccccucaacgagggggugauggccgugggccuggucagcauccuggccuccagccuccugcggaacgacgugcccauggcgggcccgcugguggccgggggccuccugaucgccugcuacgucaucaccgggaccuccgccgaccugaccguggagaaggccgcggacgugacgugggaggaggaggccgagcagaccggcgucagccacaaccucaugaucaccguggacgacgacgggaccaugcgcaucaaggacgacgagaccgagaacauccugacggugcugcucaagaccgcccugcugaucgucuccggcaucuuccccuacagcauccccgccacccuccugguguggcacaccuggcagaagcagacgcagcgguccggcgugcugugggacguccccagcccgcccgagacccagaaggccgagcucgaggaggggguguaccgcaucaagcagcagggcaucuucgggaagacccaggugggcgucggggugcagaaggagggcguguuccacaccauguggcacgucacgcggggcgcggugcugacccacaacgggaagcgccuggagcccaacugggccuccgugaagaaggaccucaucagcuacggcgggggcuggcggcuguccgcccaguggcagaagggggaggagguccaggugaucgccguggagcccggcaagaacccgaagaacuuccagaccaugcccggcaucuuccagaccacgaccggggagaucggcgcgaucgcccuggacuucaagcccgggaccagcggcagcccgaucaucaaccgcgagggcaaggucguggggcuguacggcaacgggguggucaccaagaacggcggguacguguccggcaucgcccagacgaacgccgagcccgacggccccacccccgagcucgaggaggagauguucaagaagcggaaccugaccaucauggaccugcacccggggagcggcaagacccgcaaguaccuccccgccaucgugcgggaggcgaucaagcgccggcugcgcacgcugauccucgcccccacccgggucguggccgccgagauggaggaggcccugaaggggcugcccauccgcuaccagaccaccgcgacgaaguccgagcacaccggccgggagaucguggaccucaugugccacgccaccuucaccaugcgccugcugagcccgguccgggugcccaacuacaaccucaucaucauggacgaggcccacuucacggaccccgccuccaucgccgcgcgcggguacaucagcacccgggugggcaugggcgaggccgccgccaucuucaugaccgcgacgccgcccgggacggccgaggccuucccccaguccaacgcccccauccaggacgaggagcgcgacauccccgagcgcagcuggaacuccggcaacgaguggaucaccgacuucgucgggaagaccgugugguucgugcccagcaucaaggccggcaacgacaucgcgaacugccugcggaagaacgggaagaaggucauccagcugucccgcaagaccuucgacacggaguaccagaagacccggcucaacgacugggacuucguggugaccaccgacaucagcgagaugggcgccaacuucaaggccgaccgcgucaucgacccccggcgcugccugaagcccgugauccugacggacggccccgagcgggugauccucgccgggccgaugcccgucaccgccgcguccgccgcccagcgccggggccgcguggggcggaacccccagaaggagaacgaccaguacaucuucaccggccagccccugaacaacgacgaggaccacgcccacuggaccgaggccaagaugcugcucgacaacaucaacaccccggaggggaucauccccgcgcuguucgagcccgagcgcgagaaguccgccgccaucgacggcgaguaccggcugaagggcgagucccgcaagacguucguggagcucaugcggcgcggggaccugcccgucuggcuggcccacaagguggcgagcgagggcaucaaguacaccgaccggaaguggugcuucgacggggagcgcaacaaccagauccucgaggagaacauggacgucgagaucuggaccaaggagggcgagcggaagaagcugcgcccgcgcuggcuggacgcccggaccuacuccgacccccucgcccugaaggaguucaaggacuucgccgccggccgcaagagcaucgcgcuggaccucgugacggagaucgggcgggugcccucccaccuggccuaccgcacccggaacgcccuggacaaccucgucaugcugcacaccagcgagcacggcgggcgcgccuaccggcacgccguggaggagcugccggagaccauggagacgcuccugcugcucggccugaugauccugcucaccgggggcgcgaugcuguuccugaucagcggcaaggggaucggcaagaccuccaucgggcucaucugcgugaucgucagcuccggcaugcuguggauggccgacgugccccugcaguggaucgccagcgccaucgugcucgaguucuucaugaugguccugcugauccccgagcccgagaagcagcgcaccccgcaggacaaccagcucgccuacguggugaucgggauccugacgcuggcggccaucgucgccgccaacgagaugggccuccuggagaccaccaagcgggaccugggcauguccaaggagcccgggguggugagccccaccuccuaccucgacgucgaccugcaccccgccagcgcguggacgcuguacgccguggccaccaccgugaucaccccgaugcuccgccacacgaucgagaacuccaccgccaacgucagccuggcggccaucgccaaccaggccguggugcugaugggccucgacaagggguggcccaucuccaagauggaccugggcgucccccugcucgcccuggggugcuacagccaggugaacccccugacccucaccgcggccgugcugcugcucgucacgcacuacgccaucaucggcccgggccugcaggccaaggccacccgggaggcgcagaagcgcaccgccgccgggaucaugaagaaccccaccguggacggcaucaugacgaucgaccuggaccccgugaucuacgacuccaaguucgagaagcagcucgggcaggucaugcugcuggugcucugcgccgugcagcugcugcucaugcggaccagcugggcccugugcgaggcgcugacccucgccaccggccccaucacgacccugugggagggcuccccggggaaguucuggaacaccaccaucgccgucagcauggccaacaucuuccgcggcuccuaccuggcgggggccggccucgccuucagcaucaugaaguccguggggacgggccggcgcggcaccgggagccagggcgagacccugggggagaaguggaagaagaagcugaaccagcucagccggaaggaguucgaccuguacaagaaguccggcaucaccgagguggaccgcaccgaggccaaggaggggcugaagcggggcgagacgacccaccacgccgucagccgcggcuccgcgaagcuccagugguucguggagcggaacauggugauccccgaggggcgcgucaucgaccugggcugcgggcgcggcggguggagcuacuacugcgccggccugaagaaggugaccgaggugcggggcuacaccaagggcgggcccgggcacgaggagcccgucccgauguccacguacggcuggaacaucgugaagcucaugagcgggaaggacguguucuaccugccgcccgagaagugcgacacccugcugugcgacaucggcgaguccagccccuccccgaccgucgaggagagccgcaccauccgggugcucaagaugguggagcccuggcugaagaacaaccaguucugcaucaagguccugaaccccuacaugcccacggugaucgagcaccucgagcgccugcagcggaaguacggcgggaugcuggugcgcaacccgcucucccggaacagcacccacgagauguacuggaucuccaacggcaccgggaacaucgucagcuccgugaacauggugagccgccugcugcucaaccgguucaccaugacgcaccgccggcccaccaucgagaaggacgucgaccugggcgccggcacccgccacgugaacgccgagcccgagaccccgaacauggacgucaucggggagcggaucaagcgcaucaaggaggagcacuccagcacguggcacuacgacgacgagaaccccuacaagaccugggccuaccacggcuccuacgaggugaaggcgaccgggagcgccagcuccaugaucaacggcguggucaagcugcucaccaagcccugggacguggugcccauggucacgcagauggccaugaccgacaccaccccguucgggcagcagcggguguucaaggagaagguggacacgcgcacgccccggcccaugcccggcacccgcaaggucauggagaucaccgccgaguggcuguggcggacgcugggccgcaacaagaagccgcgccucugcacccgggaggaguucaccaagaaggugcgcaccaacgccgcgaugggggccguguucacggaggagaaccagugggacagcgcccgggccgcggucgaggacgaggaguucuggaagcugguggaccgcgagcgggagcugcacaagcucggcaagugcggguccugcguguacaacaugaugggcaagcgcgagaagaagcugggggaguucggcaaggccaagggcagccgggccaucugguacauguggcugggggcccgcuaccucgaguucgaggcccugggcuuccugaacgaggaccacugguucucccgggagaacagcuacuccggggucgagggcgaggggcuccacaagcugggcuacauccugcgcgacaucagcaagauccccggcggggcgauguacgccgacgacaccgccggcugggacacccggaucaccgaggacgaccuccacaacgaggagaagaucacgcagcagauggaccccgagcaccgccagcuggccaacgccaucuucaagcugaccuaccagaacaagguggugaagguccagcggcccaccccgaaggggaccgugauggacaucaucucccgcaaggaccagcggggcagcggccagguggggaccuacggccucaacacguucaccaacauggaggcgcagcugguccgccagauggagggggagggcgugcuguccaaggccgaccucgagaacccccaccuccuggagaagaagaucacccaguggcucgagaccaaggggguggagcggcugaagcgcauggccaucagcggcgacgacugcgucgugaagcccaucgacgaccgguucgccaacgcccugcucgcgcugaacgacaugggcaaggugcgcaaggacaucccccaguggcagccguccaagggguggcacgacuggcagcagguccccuucugcagccaccacuuccacgagcugaucaugaaggacggccggaagcucguggugcccugccgcccccaggacgagcugaucgggcgcgcccggaucucccagggcgccggguggagccugaaggagacggccugccucggcaaggccuacgcgcagauguggucccugauguacuuccaccgccgggaccugcgccucgccagcaacgccaucugcuccgccgucccggugcacuggauccccaccagccggaccaccuggagcauccacgcgcaccaccaguggaugacgaccgaggacaugcugaccguguggaaccgcgucuggaucgaggacaaccccuggauggaggacaagacccccgugacgaccugggaggacgugccguaccugggcaagcgggaggaccaguggugcgggucccucaucggccugaccagccgcgccaccugggcccagaacauccugacggccauccagcagguccggucccucaucggggacgaggaguuccuggacuacaugcccagcaugaagcgcuuccggaaggaggaggagcuggagggcgccaucugguga

SEQ ID NO: 10295 - RNA, 9873 nt, Artificial Sequence
  derived and/or modified CDS sequence (opt1) from DENV-3__EU482454__SS-prME
accagccugugccucaugaugaugcugcccgccacccuggccuuccaccucacgucccgcgacggcgagccgcggaugaucguggggaagaacgagcgcggcaagagccugcuguucaagaccgcguccgggaucaacaugugcacccucaucgccauggaccugggcgagaugugcgacgacaccgucacguacaagugcccccugaucgccgagguggagcccgaggacaucgacugcuggugcaaccucaccagcaccugggugaccuacgggacgugcaaccaggccggcgagcaccggcgcgacaagcgguccgucgcccuggcgccccacgugggcauggggcuggacacccgcacccagaccuggaugagcgccgagggcgccuggcggcagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccacccucccggaggagcaggaccagaacuacgugugcaagcacaccuacgucgaccggggguggggcaacgggugcggccuguucgggaagggcucccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucaccccccaggccagcaccguggaggccgugcugcccgaguacggcacccucgggcuggagugcuccccgcgcaccggccuggacuucaacgagaugauccuccugacgaugaagaacaaggcguggaugguccaccggcagugguucuucgaccugccccuccccuggaccagcggcgccaccaccgagacgcccaccuggaaccgcaaggagcugcuggugaccuucaagaacgcccacgccaagaagcaggagguggucgugcucgggucccaggagggcgccaugcacaccgcgcugacgggggccaccgagauccagaacagcggcgggaccuccaucuucgccggccaccugaagugccggcucaagauggacaagcuggagcugaagggcaugagcuacgccaugugccucaacaccuucgugcugaagaaggaggucuccgagacgcagcacgggaccauccugaucaagguggaguacaagggcgaggacgccccgugcaagauccccuucagcaccgaggacgggcagggcaaggcgcacaacggccgccugaucaccgccaaccccguggucacgaagaaggaggagcccgugaacaucgaggccgagccgcccuucggggagagcaacaucgugaucggcaucggggacaaggcccucaagaucaacugguacaagaagggcuccagcaucgggaagauguucgaggcgaccgccaagggcgcccggcgcauggccauccugggcgacaccgccugggacuucggguccgucggcggggugcugaacagccucggcaagauggugcaccagaucuucggguccgcguacaccgcccuguucagcggcgucuccuggaucaugaagaucggcaucggggugcugcucacguggaucggccugaacagcaagaacaccuccaugagcuucuccugcaucgugaucgggaucaucacccuguaccucggcgccgucgugcaggccgacauggggugcgugaucaacuggaagggcaaggagcugaagugcggcagcgggaucuucgucaccaacgaggugcacacguggaccgagcaguacaaguuccaggccgacucccccaagcggcuggcgaccgccaucgccggcgccugggagaacggggugugcggcauccgcagcaccacgcgcauggagaaccuccuguggaagcagaucgccaacgagcugaacuacauccucugggagaacaacaucaagcugaccgucguggugggggacaucaucggcguccuggagcagggcaagcggacccucaccccccagccgauggagcugaaguacuccuggaagacgugggggaaggcgaagaucgugaccgccgagacccagaacagcuccuucaucaucgacggccccaacacccccgagugccccagcgccucccgcgccuggaacgugugggaggucgaggacuacggguucggcguguucacgaccaacaucuggcugaagcuccgggagguguacacccagagcugcgaccaccgccugaugagcgcggccaucaaggacgagcgggccguccacgccgacaugggcuacuggaucgagucccagaagaacgggagcuggaagcuggagaaggccuccuucaucgaggugaagaccugcaccuggccgaagagccacacgcucugguccaacggcgugcuggagagcgacaugaucauccccaagucccuggcggggcccaucagccagcacaaccaccgcccgggcuaccacacccagaccgccgggcccuggcaccucggcaagcuggagcuggacuucaacuacugcgagggcaccacggucgugaucaccgagaacugcgggacccggggccccucccuccgcaccacgaccgugagcgggaagcugauccacgaguggugcugccgguccugcacccugcccccgcuccgcuacaugggcgaggacgggugcugguacggcauggagauccggcccaucaacgagaaggaggagaacauggucaagagccugguguccgccggcagcgggaagguggacaacuucaccaugggcguccugugccucgccauccuguucgaggaggugaugcgcgggaaguucggcaagaagcacaugaucgccggggugcuguucacguucguccuccugcuguccggccagaucaccuggcgggacauggcgcacacccucaucaugaucggcagcaacgccuccgaccgcauggggaugggcgugaccuaccuggcccugaucgccacguucaagauccagcccuuccucgcccugggguucuuccugcggaagcucaccagccgcgagaaccugcugcucggcgugggccuggcgauggccaccacccugcagcuccccgaggacaucgagcagauggccaacgggaucgcccugggccugaugacgcucaagcugaucacccaguucgagaccuaccagcuguggaccgcgcucgucagccugacgugcuccaacaccaucuucacccugaccguggccuggcggacggccacccucauccuggccggggucagccugcucccgcugugccaguccagcuccaugcgcaagaccgacuggcugcccaugaccguggccgcgaugggcgugcccccccucccgcuguucaucuucagccugaaggacacgcccaagcggcgcuccuggccccucaacgagggggucauggccgugggccuggugagcauccuggccuccagccuccugcgcaacgacguccccauggccggcccgcugguggccgggggccuccugaucgcgugcuacgugaucaccgggaccuccgccgaccugaccgucgagaaggccgccgacgugacguggguggaggaggccgagcagaccggcgucagccacaaccucaugaucaccguggacgacgacgggaccaugcggaucaaggacgacgagaccgagaacauccugacggugcugcucaagaccgcgcugcugaucgucuccggcaucuuccccuacagcauccccgccacccuccugguguggcacaccuggcagaagcagacgcagcgcuccggcgugcugugggacguccccagcccgcccgagacccagaaggccgagcucgaggaggggguguaccggaucaagcagcagggcaucuucgggaagacccaggugggcgucggggugcagcgcgagggcguguuccacaccauguggcacgucacgcggggcgccgugcugacccacaacgggaagcgccuggagcccaacugggccuccgugaagaaggaccucaucagcuacggcgggggcuggcggcuguccgcgcaguggcagaagggggaggagguccaggugaucgccguggagcccggcaagaacccgaagaacuuccagaccaugcccggcaccuuccagacgaccaccggggagaucggcgccaucgcccuggacuucaagcccgggaccagcggcagcccgaucaucaaccgcgagggcaaggucguggggcuguacggcaacgggguggucacgaagaacggcggguacguguccggcaucgcgcagaccaacgccgagcccgacggccccacccccgagcucgaggaggagauguucaagaagcggaaccugaccaucauggaccugcacccggggagcggcaagacgcgcaaguaccuccccgccaucgugcgggaggccaucaagcgccggcugcgcacccugauccucgcccccacccgggucguggcggccgagauggaggaggcccugaaggggcugcccauccgcuaccagaccacggccaccaaguccgagcacaccggccgggagaucguggaccucaugugccacgccaccuucacgaugcgccugcugagcccgguccgggugcccaacuacaaccucaucaucauggacgaggcgcacuucaccgaccccgccuccaucgccgcccgcggguacaucagcacccgggugggcaugggcgaggccgcggccaucuucaugaccgccacgcccccggggaccgccgaggcguucccccaguccaacgcccccauccaggacgaggagcgcgacauccccgagcgcagcuggaacuccggcaacgaguggaucaccgacuucgucgggaagaccgugugguucgugccgagcaucaaggccggcaacgacaucgccaacugccugcggaagaacgggaagaaggucauccagcugucccgcaagacguucgacaccgaguaccagaagacccggcucaacgacugggacuucguggugaccacggacaucagcgagaugggcgccaacuucaaggcggaccgcgucaucgacccccggcgcugccugaagcccgugauccugaccgacggccccgagcgggugauccucgccgggccgaugcccgucaccgccgccuccgccgcgcagcgccggggccgcguggggcggaacccccagaaggagaacgaccaguacaucuucaccggccagccccugaacaacgacgaggaccacgcccacuggaccgaggccaagaugcugcucgacaacaucaacacgccggaggggaucauccccgcccuguucgagcccgagcgcgagaagagcgccgcgaucgacggcgaguaccggcugaagggcgagucccgcaagaccuucgucgagcucaugcggcgcggggaccugcccguguggcuggcccacaagguggccagcgagggcaucaaguacaccgaccggaaguggugcuucgacggggagcgcaacaaccagauccucgaggagaacauggacgucgagaucuggaccaaggagggcgagcggaagaagcugcgcccgcgcuggcuggacgcccggacguacuccgacccccucgcgcugaaggaguucaaggacuucgccgccggccgcaagagcaucgcccuggaccucgugaccgagaucgggcgggugcccucccaccuggcccaccgcacccggaacgcgcuggacaaccucgucaugcugcacaagagcgagcacggcgggcgcgccuaccggcacgccguggaggagcugccggagaccauggagacgcuccugcugcucggccugaugauccugcucaccgggggcgccaugcuguuccugaucagcggcaaggggaucggcaagaccuccauggggcucaucugcgugaucgucagcuccggcaugcuguggauggccgacgugccccugcaguggaucgcgagcgccaucgugcucgaguucuucaugaugguccugcugauccccgagcccgagaagcagcgcaccccgcaggacaaccagcucgccuacguggugaucgggauccugacgcuggccgccaucgucgcggccaacgagaugggccuccuggagaccaccaagcgggaccugggcauguccaaggagcccgggguggugagccccaccuccuaccucgacgucgaccugcaccccgccagcgccuggacgcuguacgccguggcgaccaccgugaucaccccgaugcuccgccacacgaucgagaacuccaccgccaacgucagccuggccgccaucgcgaaccaggccguggugcugaugggccucgacaagggguggcccaucuccaagauggaccugggcgucccccugcucgcccuggggugcuacagccaggugaacccccugacccucaccgccgccgugcugcugcucgucacgcacuacgcgaucaucggcccgggccugcaggccaaggccacccgggaggcccagaagcgcaccgccgcggggaucaugaagaaccccaccguggacggcaucaugacgaucgaccuggaccccgugaucuacgacuccaaguucgagaagcagcucgggcaggucaugcugcuggugcucugcgccgugcagcugcugcucaugcggaccagcugggcccugugcgaggcccugacccucgccaccggccccaucacgacccugugggagggcuccccggggaaguucuggaacaccaccaucgcggucagcauggccaacaucuuccgcggcuccuaccuggccggggccggccucgcguucagcaucaugaaguccguggggacgggccggcgcggcaccgggagccagggcgagacccugggggagaaguggaagaagaagcugaaccagcucagccggaaggaguucgaccuguacaagaaguccggcaucaccgagguggaccgcaccgaggccaaggaggggcugaagcggggcgagacgacccaccacgccgucagccgcggcuccgccaagcuccagugguucguggagcggaacauggugauccccgaggggcgcgucaucgaccugggcugcgggcgcggcggguggagcuacuacugcgccggccugaagaaggugaccgaggugcggggcuacaccaaggggggccccgggcacgaggagcccgucccgauguccacguacggcuggaacaucgugaagcucaugagcgggaaggacguguucuaccugccccccgagaagugcgacacccugcugugcgacaucggcgaguccagccccuccccgaccgucgaggagagccgcaccauccgggugcucaagaugguggagcccuggcugaagaacaaccaguucugcaucaagguccugaaccccuacaugcccacggugaucgagcaccucgagcgccugcagcggaaguacggcgggaugcuggugcgcaacccgcucucccggaacagcacccacgagauguacuggaucuccaacggcaccgggaacaucgucagcuccgugaacauggucagccgccugcugcucaaccgguucaccaugacgcaccgccggcccaccaucgagaaggacguggaccugggcgcgggcacccgccacgugaacgccgagcccgagaccccgaacauggacgucaucggggagcggaucaagcgcaucaaggaggagcacuccagcacguggcacuacgacgacgagaaccccuacaagaccugggccuaccacggcuccuacgaggugaaggccaccgggagcgccagcuccaugaucaacggcguggucaagcugcucaccaagcccugggacguggugcccauggucacgcagauggcgaugaccgacaccaccccguucgggcagcagcggguguucaaggagaagguggacacgcgcaccccccggcccaugcccggcacccgcaaggucauggagaucaccgccgaguggcuguggcggacgcugggccgcaacaagaagccgcgccucugcacccgggaggaguucaccaagaaggugcgcaccaacgccgccaugggggccguguucacggaggagaaccagugggacagcgcgcgggccgccgucgaggacgaggaguucuggaagcugguggaccgcgagcgggagcugcacaagcucggcaagugcggguccugcguguacaacaugaugggcaagcgcgagaagaagcugggggaguucggcaaggccaagggcagccgggcgaucugguacauguggcugggggcccgcuaccucgaguucgaggcccugggcuuccugaacgaggaccacugguucucccgggagaacagcuacuccggggucgagggcgaggggcuccacaagcugggcuacauccugcgcgacaucagcaagauccccggcggggccauguacgccgacgacaccgcgggcugggacacccggaucaccgaggacgaccuccacaacgaggagaagaucacgcagcagauggaccccgagcaccgccagcuggccaacgccaucuucaagcugaccuaccagaacaagguggugaagguccagcggcccaccccgaaggggaccgugauggacaucaucucccgcaaggaccagcggggcagcggccagguggggaccuacggccucaacacguucaccaacauggaggcccagcugguccgccagauggagggggagggcgugcuguccaaggccgaccucgagaacccccaccugcuggagaagcggaucacccaguggcucgagaccaaggggguggagcgccugaagcggauggcgaucagcggcgacgacugcgucgugaagcccaucgacgaccgcuucgccaacgcccugcucgcccugaacgacaugggcaaggugcggaaggacaucccccaguggcagccguccaagggguggcacgacuggcagcagguccccuucugcagccaccacuuccacgagcugaucaugaaggacggccgcaagcucguggugcccugccgcccccaggacgagcugaucgggcgggcccgcaucucccagggcgcgggguggagccugaaggagacggccugccucggcaaggccuacgcccagauguggucccugauguacuuccaccggcgcgaccugcggcucgccagcaacgcgaucugcuccgccgucccggcccacuggauccccaccagccgcaccaccuggagcauccacgcccaccaccaguggaugacgaccgaggacaugcugaccguguggaaccggguguggaucgaggacaaccccuggauggaggacaagacccccgucacgaccugggaggacgugccguaccugggcaagcgcgaggaccaguggugcgggucccucaucggccugaccagccgggcgaccugggcccagaacauccugacggccauccagcaggugcgcucccucaucggggacgaggaguuccuggacuacaugcccagcaugaagcgguuccgcaaggaggaggaguccgagggcgccaucugguga

SEQ ID NO: 10296 - RNA, 9873 nt, Artificial Sequence
  derived and/or modified CDS sequence (opt1) from DENV-3__EU482455__SS-prME
accagccucugccucaugaugaugcuccccgcgacccuggccuuccaccucaccagccgggacggcgagccgcggaugaucguggggaagaacgagcgcggcaagagccugcuguucaagaccgcguccgggaucaacaugugcacccucaucgccauggaccugggcgagaugugcgacgacaccgugaccuacaagugcccccugguggccgagguggagcccgaggacaucgacugcuggugcaaccucaccagcaccugggugaccuacgggacgugcaaccaggccggcgagcaccggcgcgacaagcgguccguggcccuggcgccccacgugggcauggggcuggacacccgcacccagaccuggaugagcgccgagggcgccuggcggcaggucgagaagguggagacgugggcccuccgccacccgggguucaccauccuggcgcuguuccucgcccacuacaucggcaccucccugacccagaagguggucaucuucauccugcucaugcuggugacgcccagcaugaccaugcggugcgugggggucggcaaccgcgacuucguggagggccuguccggggccaccuggguggacgucgugcucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgucugcaagcacaccuacguggaccggggguggggcaacgggugcggccuguucgggaagggcucccuggugaccugcgccaaguuccagugccucgagcccaucgagggcaaggucgugcaguacgagaaccugaaguacaccgugaucaucacgguccacaccggggaccagcaccaggugggcaacgacacccagggggucaccguggagaucacgccccaggccagcaccguggaggccguccugcccgaguacggcacccucgggcuggagugcuccccgcgcaccggccuggacuucaacgagaugauccuccugaccaugaagaacaaggcguggauggugcaccggcagugguucuucgaccugccccuccccuggacgagcggcgccaccaccgagacccccacguggaacaagaaggagcugcuggugaccuucaagaacgcccacgccaagaagcaggaggucguggugcucgggucccaggagggcgccaugcacaccgcgcugaccggggccacggagauccagaacagcggcgggaccuccaucuucgccggccaccugaagugccgccucaagauggacaagcuggagcugaagggcaugagcuacgccaugugccucaacaccuucguccugaagaaggagguguccgagacccagcacgggacgauccugaucaagguggaguacaagggcgaggacgccccgugcaagauccccuucagcaccgaggacgggcagggcaaggcgcacaacggccggcugaucaccgccaaccccgucgugaccaagaaggaggagcccgugaacaucgaggccgagccgcccuucggggagagcaacaucgucaucggcaucggggacaaggcccucaagaucaacugguacaagaagggcuccagcaucgggaagauguucgaggcgacggcccgcggcgcccggcgcauggccauccugggcgacaccgccugggacuucggguccgugggcggggugcugaacagccucggcaagaugguccaccagaucuucggguccgcguacaccgcccuguucagcggcguguccuggaucaugaagaucggcaucggggugcugcucaccuggaucggccugaacagcaagaacacguccaugagcuucuccugcaucgucaucgggaucaucacccuguaccucggcgccguggugcaggccgacauggggugcgccaucaacuggaagggcaaggagcugaagugcggcagcgggaucuucgucaccaacgaggugcacaccuggacggagcaguacaaguuccaggcggacucccccaagcggcuggccaccgccaucgccggcgccugggagaacggggugugcggcauccgcagcaccacccgcauggagaaccuccuguggaagcagaucgcgaacgagcugaacuacauccucugggagaacaacaucaagcugacggucguggugggggacaucaucggcguccuggagcagggcaagcggacccucacgccccagccgauggagcugaaguacuccuggaagaccugggggaaggccaagaucgugacggccgagacccagaacagcuccuucaucaucgacggccccaacacccccgagugccccagcgccucccgcgcguggaacgugugggaggucgaggacuacggguucggcguguucaccacgaacaucuggcugaagcuccgggagguguacacccagagcugcgaccaccgccugaugagcgccgccaucaaggacgagcgggccguccacgccgacaugggcuacuggaucgagucccagaagaacgggagcuggaagcuggagaaggcguccuucaucgaggugaagaccugcaccuggcccaagagccacacccucugguccaacggcgugcuggagagcgacaugaucauccccaagucccuggccgggcccaucagccagcacaaccaccgcccgggcuaccacacgcagaccgccgggcccuggcaccucggcaagcuggagcuggacuucaacuacugcgagggcaccaccgucgugaucacggagaacugcgggacccggggccccucccuccgcaccaccacggugagcgggaagcugauccacgaguggugcugccgguccugcacccugcccccgcuccgcuacaugggcgaggacgggugcugguacggcauggagauccggcccaucaacgagaaggaggagaacauggucaagagccugguguccgccggcagcgggaagguggacaacuucaccaugggcguccugugccucgccauccuguucgaggaggugaugcgcgggaaguucggcaagaagcacaugaucgcgggggugcuguucaccuucguccuccugcuguccggccagaucacguggcgggacauggcccacacccucaucaugaucggcagcaacgccuccgaccgcauggggaugggcgugaccuaccuggcccugaucgccaccuucaagauccagcccuuccucgcgcugggguucuuccugcggaagcucacgagccgcgagaaccugcugcucggcgugggccuggccauggccaccacccugcagcuccccgaggacaucgagcagauggccaacgggaucgcgcugggccugaugacccucaagcugaucacgcaguucgagaccuaccagcuguggaccgcccucgucagccugaccugcuccaacacgaucuucacccugaccguggccuggcggaccgccacgcucauccuggccggggucagccugcucccgcugugccaguccagcuccaugcgcaagaccgacuggcugcccaugaccguggcggccaugggcgugccgccccucccgcuguucaucuucagccugaaggacacccccaagcggcgcuccuggccccucaacgagggggucauggccgugggccuggugagcauccuggccuccagccuccugcgcaacgacguccccauggccggcccgcugguggccggcgggcuccugaucgccugcuacgugaucacggggaccuccgccgaccugaccgucgagaaggccgccgacgugaccugggaggaggaggcggagcagacgggggugagccacaaccucaugaucaccgucgacgacgacgggaccaugcggaucaaggacgacgagaccgagaacauccugaccgugcugcucaagacggcccugcugaucguguccggcaucuuccccuacagcauccccgccacccuccuggucuggcacaccuggcagaagcagacccagcgcuccggcgugcugugggacgugcccagcccgcccgagacgcagaaggccgagcucgaggagggggucuaccggaucaagcagcagggcaucuucgggaagacccaggugggcguggggguccagaaggagggcguguuccacaccauguggcacgugacccgcggcgccguccugacgcacaacgggaagcggcuggagcccaacugggcguccgugaagaaggaccucaucagcuacggcgggggcuggcgccuguccgcccaguggcagaagggggaggaggugcaggucaucgccguggagcccggcaagaacccgaagaacuuccagaccaugcccggcaucuuccagaccaccacgggggagaucggcgccaucgcgcuggacuucaagcccgggaccagcggcagcccgaucaucaaccgggagggcaagguggucgggcuguacggcaacgggguggugaccaagaacggcggguacgucuccggcaucgcccagaccaacgccgagcccgacggccccacgcccgagcucgaggaggagauguucaagaagcgcaaccugaccaucauggaccugcacccggggagcggcaagacccggaaguaccuccccgccaucgugcgcgaggccaucaagcggcgccugcggacccugauccucgcgcccacgcgcguggucgccgccgagauggaggaggcccugaaggggcugcccauccgguaccagaccaccgccaccaaguccgagcacacgggccgcgagaucguggaccucaugugccacgcgaccuucaccaugcggcugcugagcccggugcgcguccccaacuacaaccucaucaucauggacgaggcccacuucaccgaccccgccuccaucgccgcccggggguacaucagcacgcgcgugggcaugggcgaggcggccgccaucuucaugaccgccacgccgcccgggaccgcggaggccuucccccaguccaacgcccccauccaggacgaggagcgggacauccccgagcgcagcuggaacuccggcaacgaguggaucacggacuucguggggaagaccgucugguucgugcccagcaucaaggccggcaacgacaucgccaacugccugcgcaagaacgggaagaaggugauccagcugucccggaagaccuucgacaccgaguaccagaagacgcgccucaacgacugggacuucgucgugaccaccgacaucagcgagaugggcgcgaacuucaaggccgaccgggugaucgacccccgccggugccugaagcccgucauccugaccgacggccccgagcgcgugauccucgccgggccgaugcccgugacggccgccuccgcggcccagcggcgcggccgggucgggcgcaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgggagaaguccgcggccaucgacggcgaguaccgccugaagggcgagucccggaagaccuucguggagcucaugcgccgcggggaccugcccgucuggcuggcccacaagguggccagcgagggcaucaaguacacggaccgcaaguggugcuucgacggggagcggaacaaccagauccucgaggagaacauggacguggagaucuggaccaaggagggcgagcgcaagaagcugcggccgcgcuggcuggacgcgcgcaccuacuccgacccccucgcccugaaggaguucaaggacuucgccgccggccgcaagagcaucgccuucgaccuggucaccgagaucgggcgcgugcccucccaccucgcguaccggacgcgcaacgcccuggacaaccuggugaugcuccacaccagcgagcacggcgggcgggccuaccgccacgccgucgaggagcugccggagaccauggagacccugcuccugcugggccucaugauccugcugaccggcggggccaugcuguuccugaucagcgggaaggggaucggcaagaccuccaucgggcugaucugcgugaucgugagcuccggcaugcucuggauggcggacgucccccugcaguggaucgccagcgccaucgugcuggaguucuucaugauggugcuccugauccccgagcccgagaagcagcggaccccgcaggacaaccagcuggccuacgucgugaucgggauccucacccuggccgcgaucguggccgccaacgagaugggccugcucgagacgaccaagcgcgaccugggcauguccaaggagcccggggucgugagccccaccuccuaccuggacguggaccuccaccccgccagcgccuggacccuguacgcggucgccacgaccgugaucaccccgaugcugcggcacaccaucgagaacuccacggccaacgugagccucgccgcgaucgccaaccaggccgucgugcugaugggccuggacaagggguggcccaucuccaagauggaccucggcgugccccugcuggcccucgggugcuacagccaggucaacccccugacccugaccgccgcggugcuccugcuggugacccacuacgccaucaucggcccgggccuccaggccaaggccacgcgcgaggcccagaagcggaccgcggccgggaucaugaagaaccccaccgucgacggcaucaugaccaucgaccuggaccccgugaucuacgacuccaaguucgagaagcagcugggccaggugaugcuccugguccugugcgccgugcagcuccugcugaugcgcacgagcugggcccucugcgaggcccugacccuggcgaccggccccaucaccacgcucugggagggcuccccggggaaguucuggaacaccaccaucgccgugagcauggccaacaucuuccggggcuccuaccuggccggggcgggccuggccuucagcaucaugaaguccgucgggaucggccgccggggcaccgggagccagggcgagacgcucggggagaaguggaagaagaagcugaaccagcugagccgcaaggaguucgaccucuacaagaaguccggcaucaccgagguggaccggaccgaggccaaggaggggcugaagcgcggcgagaccacccaccacgccgugagccggggcuccgccaagcugcagugguucgucgagcgcaacauggugauccccgaggggcgggugaucgaccucggcugcgggcgcggcggguggagcuacuacugcgcgggccugaagaaggucacggaggugcgcggcuacaccaagggcggccccgggcacgaggagcccgugccgauguccaccuacggcuggaacaucgucaagcugaugagcgggaaggacguguucuaccugccgcccgagaagugcgacacccugcugugcgacaucggcgaguccagccccuccccgacgguggaggagagccggaccauccgcguccugaagaugguggagcccuggcucaagaacaaccaguucugcaucaaggugcugaaccccuacaugcccaccgucaucgagcaccuggagcggcuccagcgcaaguacggcgggaugcuggugcggaacccgcugucccgcaacagcacccacgagauguacuggaucuccaacggcacggggaacaucgugagcuccgucaacauggugagccggcuccugcugaaccgcuucaccaugacccaccggcgccccaccaucgagaaggacgucgaccucggcgccggcacgcggcacgugaacgccgagcccgagaccccgaacauggacgugaucggggagcgcaucaagcggaucaaggaggagcacuccagcaccuggcacuacgacgacgagaaccccuacaagaccugggccuaccacggcuccuacgaggucaaggccacggggagcgcgagcuccaugaucaacggcguggugaagcugcugaccaagcccugggacgucgugcccauggugacccagauggccaugaccgacacgaccccguucgggcagcagcgcgucuucaaggagaagguggacacccggacgccccggcccaugcccggcacgcggaaggugauggagaucaccgccgaguggcucuggcgcacccugggccggaacaagaagccgcgccugugcacccgcgaggaguucacgaagaagguccggaccaacgccgccaugggggcgguguucaccgaggagaaccagugggacagcgcccgcgccgccguggaggacgaggaguucuggaagcucgucgaccgggagcgcgagcugcacaagcugggcaagugcggguccugcguguacaacaugaugggcaagcgggagaagaagcucggggaguucggcaaggcgaagggcagccgcgccaucugguacauguggcugggggcccgguaccuggaguucgaggcccucggcuuccugaacgaggaccacugguucucccgcgagaacagcuacuccgggguggagggcgaggggcugcacaagcucggcuacauccugcgggacaucagcaagauccccggcggggccauguacgcggacgacaccgccggcugggacacgcgcaucaccgaggacgaccugcacaacgaggagaagaucacccagcagauggaccccgagcaccggcagcucgccaacgccaucuucaagcugaccuaccagaacaaggucgugaaggugcagcgccccacgccgaaggggaccgucauggacaucaucucccggaaggaccagcgcggcagcggccagguggggaccuacggccugaacaccuucaccaacauggaggcccagcucgugcggcagauggagggggagggcguccuguccaaggcggaccuggagaacccccaccuccuggagaagaagaucacgcaguggcuggagaccaaggggguggagcgccucaagcggauggccaucagcggcgacgacugcguggucaagcccaucgacgaccgcuucgccaacgcccugcuggcccucaacgacaugggcaaggugcggaaggacaucccccaguggcagccguccaagggguggcacgacuggcagcagguccccuucugcagccaccacuuccacgagcugaucaugaaggacggccgcaagcuggucgugcccugccggccccaggacgagcucaucgggcgcgcgcgcaucucccagggcgccggguggagccugaaggagaccgccugccugggcaaggccuacgcccagauguggucccucauguacuuccaccggcgcgaccugcggcuggcgagcaacgccaucugcuccgccgugccgguccacuggauccccaccagccgcacgaccuggagcauccacgcccaccaccaguggaugaccaccgaggacaugcucacgguguggaaccggguguggaucgaggacaaccccuggauggaggacaagacccccgucaccaccugggaggacgugccguaccugggcaagcgcgaggaccaguggugcgggucccugaucggccucacgagccgggcgaccugggcccagaacauccugaccgccauccagcagguccgcucccugaucggggacgaggaguuccucgacuacaugcccagcaugaagcgguuccgcaaggaggaggaguccgagggcgccaucugguga

SEQ ID NO: 10297 - RNA, 9873 nt, Artificial Sequence
  derived and/or modified CDS sequence (opt1) from DENV-3__EU482456__SS-prME
accagccugugccucaugaugaugcugcccgccacccuggccuuccaccucacgucccgcgacggcgagccgcggaugaucguggggaagaacgagcgcggcaagagccugcuguucaagaccgcguccgggaucaacaugugcacccucaucgccauggaccugggcgagaugugcgacgacaccgucacguacaagugcccccugaucgccgagguggagcccgaggacaucgacugcuggugcaaccucaccagcaccugggugaccuacgggacgugcaaccaggccggcgagcaccggcgcgacaagcgguccgucgcccuggcgccccacgugggcauggggcuggacacccgcacccagaccuggaugagcgccgagggcgccuggcggcagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgugugcaagcacaccuacgucgaccggggguggggcaacgggugcggccuguucgggaagggcucccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccagcaccguggaggccgugcugcccgaguacggcacccucgggcuggagugcuccccgcgcaccggccuggacuucaccgagaugauccuccugacgaugaagaacaaggcguggaugguccaccggcagugguucuucgaccugccccuccccuggaccagcggcgccaccaccgagacgcccaccuggaaccgcaaggagcugcuggugaccuucaagaacgcccacgccaagaagcaggagguggucgugcucgggucccaggagggcgccaugcacaccgcgcugacgggggccaccgagauccagaacagcggcgggaccuccaucuucgccggccaccugaagugccggcucaagauggacaagcuggagcugaagggcaugagcuacgccaugugccucaacaccuucgugcugaagaaggaggucuccgagacgcagcacgggaccauccugaucaagguggaguacaagggcgaggacgccccgugcaagauccccuucagcaccgaggacgggcagggcaaggcgcacaacggccgccugaucaccgccaaccccguggucacgaagaaggaggagcccgugaacaucgaggccgagccgcccuucggggagagcaacaucgugaucggcaucggggacaaggcccucaagaucaacugguacaagaagggcuccagcaucgggaagauguucgaggcgaccgcccggggcgcccgccggauggccauccugggcgacaccgccugggacuucggguccgucggcggggugcugaacagccucggcaagauggugcaccagaucuucggguccgcguacaccgcccuguucagcggcgucuccuggaucaugaagaucggcaucggggugcugcucacguggaucggccugaacagcaagaacaccuccaugagcuucuccugcaucgugaucgggaucaucacccuguaccucggcgccgucgugcaggccgacauggggugcgugaucaacuggaagggcaaggagcugaagugcggcagcgggaucuucgucaccaacgaggugcacacguggaccgagcaguacaaguuccaggccgacucccccaagcgccuggcgaccgccaucgccggcgccugggagaacggggugugcggcauccgcagcaccacgcggauggagaaccuccuguggaagcagaucgccaacgagcugaacuacauccucugggagaacaacaucaagcugaccgucguggugggggacaccaucggcguccuggagcagggcaagcgcacccucacgccccagccgauggagcugaaguacuccuggaagaccugggggaaggcgaagaucgugaccgccgagacccagaacagcuccuucaucaucgacggccccaacacgcccgagugccccagcgccucccgggccuggaacgugugggaggucgaggacuacggguucggcguguucaccaccaacaucuggcugaagcuccgcgagguguacacccagagcugcgaccaccggcugaugagcgcggccaucaaggacgagcgcgccguccacgccgacaugggcuacuggaucgagucccagaagaacgggagcuggaagcuggagaaggccuccuucaucgaggugaagaccugcacguggccgaagagccacacccucugguccaacggcgugcuggagagcgacaugaucauccccaagucccuggcggggcccaucagccagcacaaccaccggccgggcuaccacacccagaccgccgggcccuggcaccucggcaagcuggagcuggacuucaacuacugcgagggcacgaccgucgugaucaccgagaacugcgggacccgcggccccucccuccggacgaccaccgugagcgggaagcugauccacgaguggugcugccgcuccugcacccugcccccgcuccgguacaugggcgaggacgggugcugguacggcauggagauccgccccaucaacgagaaggaggagaacauggucaagagccugguguccgccggcagcgggaagguggacaacuucacgaugggcguccugugccucgccauccuguucgaggaggugaugcgggggaaguucggcaagaagcacaugaucgccggggugcuguucaccuucguccuccugcuguccggccagaucaccuggcgcgacauggcgcacacccucaucaugaucggcagcaacgccuccgaccggauggggaugggcgugacguaccuggcccugaucgccaccuucaagauccagcccuuccucgcccugggguucuuccugcgcaagcucaccagccgggagaaccugcugcucggcgugggccuggcgauggccaccacgcugcagcuccccgaggacaucgagcagauggccaacgggaucgcccugggccugaugacccucaagcugaucacccaguucgagaccuaccagcuguggacggcgcucgucagccugaccugcuccaacaccaucuucacccugacgguggccuggcgcaccgccacccucauccuggccggggucagccugcucccgcugugccaguccagcuccaugcggaagaccgacuggcugcccaugacgguggccgcgaugggcgugcccccccucccgcuguucaucuucagccugaaggacacccccaagcgccgcuccuggccccucaacgagggggucauggccgugggccuggugagcauccuggccuccagccuccugcggaacgacguccccauggccggcccgcugguggccgggggccuccugaucgcgugcuacgugaucaccgggaccuccgccgaccugacggucgagaaggccgccgacgugaccugggaggaggaggccgagcagaccggcgugagccacaaccucaugaucaccgucgacgacgacgggaccaugcgcaucaaggacgacgagacggagaacauccugaccgugcugcucaagaccgcgcugcugaucguguccggcaucuuccccuacagcauccccgccacccuccuggucuggcacacguggcagaagcagacccagcgguccggcgugcugugggacgugcccagcccgcccgagacccagaaggccgagcucgaggagggggucuaccgcaucaagcagcagggcaucuucgggaagacccaggugggcguggggguccagaaggagggcguguuccacacgauguggcacgugacccggggcgccguccugacccacaacgggaagcgccuggagcccaacugggccuccgugaagaaggaccucaucagcuacggcgggggcuggcggcuguccgcgcaguggcagaagggggaggaggugcaggucaucgccguggagcccggcaagaacccgaagaacuuccagaccaugcccggcaucuuccagacgaccaccggggagaucggcgccaucgcccuggacuucaagcccgggaccagcggcagcccgaucaucaaccgcgagggcaagguggucgggcuguacggcaacgggguggugacgaagaacggcggguacgucuccggcaucgcgcagaccaacgccgagcccgacggccccacccccgagcucgaggaggagauguucaagaagcggaaccugaccaucauggaccugcacccggggagcggcaagacgcgcaaguaccuccccgccaucgugcgggaggccaucaagcgccggcugcgcacccugauccucgcccccacccggguggucgcggccgagauggaggaggcccugaaggggcugcccauccgcuaccagaccacggccaccaaguccgagcacaccggccgggagaucguggaccucaugugccacgccaccuucacgaugcgccugcugagcccggugcggguccccaacuacaaccucaucaucauggacgaggcgcacuucaccgaccccgccuccaucgccgcccgcggguacaucagcacccgggugggcaugggcgaggccgcggccaucuucaugaccgccacgcccccggggaccgccgaggcguucccccaguccaacgcccccauccaggacgaggagcgcgacauccccgagcgcagcuggaacuccggcaacgaguggaucaccgacuucguggggaagaccgucugguucgugccgagcaucaaggccggcaacgacaucgccaacugccugcggaagaacgggaagaaggugauccagcugucccgcaagacguucgacaccgaguaccagaagacccggcucaacgacugggacuucgucgugaccacggacaucagcgagaugggcgccaacuucaaggcggaccgcgugaucgacccccggcgcugccugaagcccgucauccugaccgacggccccgagcgggugauccucgccgggccgaugcccgugaccgccgccuccgccgcgcagcgccggggccgcgucgggcggaacccccagaaggagaacgaccaguacaucuucaccggccagccccugaacaacgacgaggaccacgcccacuggaccgaggccaagaugcugcucgacaacaucaacacgccggaggggaucauccccgcccuguucgagcccgagcgcgagaagagcgccgcgaucgacggcgaguaccggcugaagggcgagucccgcaagaccuucguggagcucaugcggcgcggggaccugcccgucuggcuggcccacaagguggccagcgagggcaucaaguacaccgaccggaaguggugcuucgacggggagcgcaacaaccagauccucgaggagaacauggacguggagaucuggaccaaggagggcgagcggaagaagcugcgcccgcgcuggcuggacgcccggacguacuccgacccccucgcgcugaaggaguucaaggacuucgccgccggccgcaagagcaucgcccuggaccucgucaccgagaucgggcgggugcccucccaccuggccuaccgcacccggaacgcgcuggacaaccucgugaugcugcacaccagcgagcacggcgggcgcgccuaccggcacgccgucgaggagcugccggagacgauggagacccuccugcugcucggccugaugauccugcucaccgggggcgccaugcuguuccugaucagcggcaaggggaucggcaagaccuccaucgggcucaucugcgugaucgugagcuccggcaugcuguggauggccgacgucccccugcaguggaucgcgagcgccaucgugcucgaguucuucaugauggugcugcugauccccgagcccgagaagcagcgcacgccgcaggacaaccagcucgccuacgucgugaucgggauccugacccuggccgccaucguggcggccaacgagaugggccuccuggagaccaccaagcgggaccugggcauguccaaggagcccggggucgugagccccacguccuaccucgacguggaccugcaccccgccagcgccuggacccuguacgccgucgcgaccaccgugaucacgccgaugcuccgccacaccaucgagaacuccaccgccaacgugagccuggccgccaucgcgaaccaggccgucgugcugaugggccucgacaagggguggcccaucuccaagauggaccugggcgugccccugcucgcccuggggugcuacagccaggucaacccccugacccucacggccgccgugcugcugcucgugacccacuacgcgaucaucggcccgggccugcaggccaaggccacccgggaggcccagaagcgcaccgccgcggggaucaugaagaaccccacggucgacggcaucaugaccaucgaccuggaccccgugaucuacgacuccaaguucgagaagcagcucgggcaggugaugcugcugguccucugcgccgugcagcugcugcucaugcggaccagcugggcccugugcgaggcccugacccucgccacgggccccaucaccacccugugggagggcuccccggggaaguucuggaacaccacgaucgcggugagcauggccaacaucuuccgcggcuccuaccuggccggggccggccucgcguucagcaucaugaaguccgucgggaccggccggcgcggcaccgggagccagggcgagacccugggggagaaguggaagaagaagcugaaccagcucagccggaaggaguucgaccuguacaagaaguccggcaucaccgagguggaccgcacggaggccaaggaggggcugaagcggggcgagaccacccaccacgccgugagccgcggcuccgccaagcuccagugguucgucgagcggaacauggugauccccgaggggcgcgugaucgaccugggcugcgggcgcggcggguggagcuacuacugcgccggccugaagaaggucaccgaggugcggggcuacacgaaggggggccccgggcacgaggagcccgugccgauguccaccuacggcuggaacaucgucaagcucaugagcgggaaggacguguucuaccugccccccgagaagugcgacacccugcugugcgacaucggcgaguccagccccuccccgaccguggaggagagccgcacgauccggguccucaagaugguggagcccuggcugaagaacaaccaguucugcaucaaggugcugaaccccuacaugcccaccgucaucgagcaccucgagcgccugcagcggaaguacggcgggaugcuggugcgcaacccgcucucccggaacagcacccacgagauguacuggaucuccaacggcaccgggaacaucgugagcuccgucaacauggugagccgccugcugcucaaccgguucacgaugacccaccgccggcccaccaucgagaaggacgucgaccugggcgcgggcacccgccacgugaacgccgagcccgagacgccgaacauggacgugaucggggagcggaucaagcgcaucaaggaggagcacuccagcaccuggcacuacgacgacgagaaccccuacaagaccugggccuaccacggcuccuacgaggucaaggccaccgggagcgccagcuccaugaucaacggcguggugaagcugcucacgaagcccugggacgucgugcccauggugacccagauggcgaugaccgacaccacgccguucgggcagcagcgggucuucaaggagaagguggacacccgcaccccccggcccaugcccggcacccgcaaggugauggagaucacggccgaguggcuguggcggacccugggccgcaacaagaagccgcgccucugcacccgggaggaguucaccaagaagguccgcacgaacgccgccaugggggccguguucaccgaggagaaccagugggacagcgcgcgggccgccguggaggacgaggaguucuggaagcuggucgaccgcgagcgggagcugcacaagcucggcaagugcggguccugcguguacaacaugaugggcaagcgcgagaagaagcugggggaguucggcaaggccaagggcagccgggcgaucugguacauguggcugggggcccgcuaccucgaguucgaggcccugggcuuccugaacgaggaccacugguucucccgggagaacagcuacuccgggguggagggcgaggggcuccacaagcugggcuacauccugcgcgacaucagcaagauccccggcggggccauguacgccgacgacaccgcgggcugggacacccggaucacggaggacgaccuccacaacgaggagaagaucacccagcagauggaccccgagcaccgccagcuggccaacgccaucuucaagcugaccuaccagaacaaggucgugaaggugcagcggcccaccccgaaggggaccgucauggacaucaucucccgcaaggaccagcggggcagcggccagguggggacguacggccucaacaccuucaccaacauggaggcccagcuggugcgccagauggagggggagggcguccuguccaaggccgaccucgagaacccccaccugcuggagaagaagaucacccaguggcucgagacgaaggggguggagcggcugaagcgcauggcgaucagcggcgacgacugcguggucaagcccaucgacgaccgguucgccaacgcccugcucgcccugaacgacaugggcaaggugcgcaaggacaucccccaguggcagccguccaagggguggcacgacuggcagcaggugcccuucugcagccaccacuuccacgagcugaucaugaaggacggccggaagcucgucgugcccugccgcccccaggacgagcugaucgggcgcgcccggaucucccagggcgcgggguggagccugaaggagaccgccugccucggcaaggccuacgcccagauguggucccugauguacuuccaccgccgggaccugcgccucgccagcaacgcgaucugcuccgccgugccgguccacuggauccccaccagccggaccacguggagcauccacgcccaccaccaguggaugaccaccgaggacaugcugaccguguggaaccgcguguggaucgaggacaaccccuggauggaggacaagacgcccgucaccaccugggaggacgugccguaccugggcaagcgggaggaccaguggugcgggucccucaucggccugaccagccgcgccacgugggcgcagaacauccugaccgccauccagcaggugcggucccucaucggggacgaggaguuccuggacuacaugcccagcaugaagcgcuuccggaaggaggaggaguccgagggcgccaucugguga

SEQ ID NO: 10298 - RNA, 9873 nt, Artificial Sequence
  derived and/or modified CDS sequence (opt1) from DENV-3__EU482457__SS-prME
accagcuucugccucaugaugaugcuccccgccacccuggccuuccaccugaccagccgggacggcgagccgcggaugaucguggggaagaacgagcggggcaagagccuccuguucaagaccgcguccgggaucaacaugugcacccugaucgccauggaccucggcgagaugugcgacgacaccgucaccuacaagugcccccugaucgccgagguggagcccgaggacaucgacugcuggugcaaccugaccagcaccugggugaccuacgggaccugcaaccaggccggcgagcaccggcgcgacaagcgguccgucgcccucgcgccccacgugggcauggggcuggacacccgcacccagaccuggaugagcgccgagggcgccuggcgccagguggagaaggucgagaccugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgacacccagggggugacggucgagaucacgccccaggccagcaccguggaggccgugcugcccgaguacggcauccuggggcucgagugcuccccgcgcaccggccuggacuucaacgagaugauccugcucaccaugaagaacaaggcguggaugguccaccggcagugguucuucgaccugccccugcccuggacgagcggcgccaccaccgagacccccacguggaaccgcaaggagcuccuggugaccuucaagaacgcccacgccaagaagcaggagguggucgugcuggggucccaggagggcgccaugcacaccgcgcucaccggggccacggagauccagaacagcggcgggaccuccaucuucgccggccaccugaagugccggcugaagauggaccgccucgagcugaagggcaugagcuacgccaugugccugaacaccuucgugcucaagaaggaggucuccgagacccagcacgggacgauccugaucaagguggaguacaagggcgaggacgccccgugcaagauccccuucagcaccgaggacgggcagggcaaggcgcacaacggccggcugaucaccgccaaccccguggucaccaagaaggaggagcccgugaacaucgaggccgagccgcccuucggggagagcaacaucgugaucggcaucggggacaaggcccugaagaucaacugguacaagaagggcuccagcaucgggaagauguucgaggcgacggcccgcggcgcccggcgcauggccauccucggcgacaccgccugggacuucggguccgucggcggggugcugaacagccugggcaagauggugcaccagaucuucggguccgcguacaccgcccucuucagcggcgucuccuggaucaugaagaucggcaucggggugcugcugaccuggaucggccucaacagcaagaacacguccaugagcuucuccugcaucgugaucgggaucaucacccuguaccugggcgccgucgugcaggccgacauggggugcgugaucaacuggaagggcaaggagcucaagugcggcagcgggaucuucgucaccaacgaggugcacaccuggacggagcaguacaaguuccaggccgacucccccaagcgccuggcgaccgccaucgccggcgccugggagaacggggugugcggcauccggagcaccacccgcauggagaaccugcucuggaagcagaucgccaacgagcugaacuacauccugugggagaacaacaucaagcucacggucguggugggggacaccaucggcguccuggagcagggcaagcggacccugacgccccagccgauggagcucaaguacuccuggaagacgugggggaaggcgaagaucgugaccgccgagacccagaacagcuccuucaucaucgacggccccaacacccccgagugccccagcgccucccgcgccuggaacgugugggaggucgaggacuacggguucggcguguucacgaccaacaucuggcugaagcugcgggagguguacacccagagcugcgaccaccgccucaugagcgcggccaucaaggacgagcgggccguccacgccgacaugggcuacuggaucgagucccagaagaacgggagcuggaagcuggagaaggccuccuucaucgaggugaagaccugcaccuggcccaagagccacacgcugugguccaacggcgugcucgagagcgacaugaucauccccaagucccuggcggggcccaucagccagcacaaccaccgcccgggcuaccacacccagaccgccgggcccuggcaccugggcaagcucgagcuggacuucaacuacugcgagggcaccacggucgugaucaccgagaacugcgggacccggggccccucccugcgcaccacgaccgugagcgggaagcucauccacgaguggugcugccgguccugcacccugcccccgcugcgcuacaugggcgaggacgggugcugguacggcauggagauccggcccaucaacgagaaggaggagaacauggucaagagccucguguccgccggcagcgggaagguggacaacuucaccaugggcguccugugccuggccauccucuucgaggaggugaugcgcgggaaguucggcaagaagcacaugaucgccggggugcuguucacguucguccugcuccuguccggccagaucaccuggcgggacauggcgcacacccugaucaugaucggcagcaacgccuccgaccgcauggggaugggcgugaccuaccucgcccugaucgccacguucaagauccagcccuuccuggcccucggguucuuccugcggaagcugaccagccgcgagaaccuccugcugggcgugggccucgcgauggccaccacccugcagcugcccgaggacaucgagcagauggccaacgggaucgcccucggccugaugacgcugaagcucaucacccaguucgagaccuaccagcuguggaccgcgcuggucagccucacgugcuccaacaccaucuucacccugaccguggccuggcggacggccacccugauccucgccggggucagccugcugccgcucugccaguccagcuccaugcgcaagaccgacuggcugcccaugaccguggccgcgaugggcgugccgccccucccccucuucaucuucagccugaaggacacgcccaagcgccgguccuggccccugaacgagggggucauggccgugggccucgugagcauccuggccuccagccugcuccgcaacgacguccccauggccggcccgcugguggccgggggccugcucaucgcgugcuacgugaucaccgggaccuccgccgaccugaccgucgagaaggccgccgacgugacgugggaggaggaggccgagcagaccggcgugagccacaaccugauggucaccguggacgacgacgggaccaugcggaucaaggacgacgagaccgagaacauccucacggugcugcugaagaccgcgcuccugaucgucuccggcaucuuccccuacagcauccccgccacccugcucguguggcacaccuggcagaagcagacgcagcgcuccggcgugcugugggacguccccagcccgcccgagacccagaaggccgagcuggaggaggggguguaccggaucaagcagcagggcaucuucgggaagacccaggugggcgucggggugcagaaggagggcguguuccacaccauguggcacgucacgcgcggcgccgugcucacccacaacgggaagcggcuggagcccaacugggccuccgugaagaaggaccugaucagcuacggcgggggcuggcgccucuccgcgcaguggcagaagggggaggagguccaggugaucgccguggagcccggcaagaacccgaagaacuuccagaccaugcccggcaucuuccagaccacgaccggggagaucggcgccaucgcccuggacuucaagcccgggaccagcggcagcccgaucaucaaccgggagggcaaggucguggggcuguacggcaacgggguggucaccaagaacggcggguacguguccggcaucgcgcagacgaacgccgagcccgacggccccacccccgagcuggaggaggagauguucaagaagcgcaaccucaccaucauggaccugcacccggggagcggcaagacccggaaguaccugcccgccaucgugcgcgaggccaucaagcggcgccuccggacgcugauccuggcccccacccgcgucguggcggccgagauggaggaggcccucaaggggcugcccauccgguaccagaccaccgccacgaaguccgagcacaccggccgcgagaucguggaccugaugugccacgccaccuucaccaugcggcuccugagcccgguccgcgugcccaacuacaaccugaucaucauggacgaggcgcacuucacggaccccgccuccaucgccgcccggggguacaucagcacccgcgugggcaugggcgaggccgcggccaucuucaugaccgccacgcccccggggacggccgaggcguucccccaguccaacgcccccauccaggacgaggagcgcgacauccccgagcggagcuggaacuccggcaacgaguggaucaccgacuucgucgggaagaccgugugguucgugccgagcaucaaggccggcaacgacaucgccaacugccuccgcaagaacgggaagaaggucauccagcugucccggaagaccuucgacacggaguaccagaagacccgccugaacgacugggacuucguggugaccaccgacaucagcgagaugggcgccaacuucaaggcggaccgggucaucgacccccgccggugccucaagcccgugauccugacggacggccccgagcgcgugauccuggccgggccgaugcccgucaccgccgccuccgccgcgcagcggcgcggccggguggggcgcaacccccagaaggagaacgaccaguacaucuucaccggccagccccucaacaacgacgaggaccacgcccacuggaccgaggccaagaugcugcuggacaacaucaacaccccggaggggaucauccccgcccucuucggccccgagcgggagaaguccgccgcgaucgacggcgaguaccgccugaagggggagucccggaagacguucgucgagcugaugcgccggggcgaccuccccguguggcuggccuacaagguggccagcgaggggaucaaguacaccgaccgcaaguggugcuucgacggcgagcggaacaaccagauccuggaggagaacauggacgucgagaucuggaccaaggagggcgagcgcaagaagcuccgcccgcgguggcuggacgcccgcaccuacuccgacccccuggcgcucaaggaguucaaggacuucgccgccgggcgcaagagcaucgcccuggaccuggugacggagaucggccgcgugcccucccaccucgcccaccggacccgcaacgcgcuggacaaccuggucaugcuccacaccagcgagcacgggggccgggccuaccgccacgccguggaggagcugccggagaccauggagacgcugcuccugcuggggcucaugauccugcugaccggcggcgccaugcuguuccugaucagcgggaagggcaucgggaagaccuccaucggccugaucugcgugaucgucagcuccgggaugcucuggauggccgacgugccccugcaguggaucgcgagcgccaucgugcuggaguucuucaugaugguccuccugauccccgagcccgagaagcagcggaccccgcaggacaaccagcuggccuacguggugaucggcauccucacgcuggccgccaucgucgcggccaacgagaugggccugcucgagaccaccaagcgcgaccuggggauguccaaggagcccggcguggugagccccaccuccuaccuggacgucgaccuccaccccgccagcgccuggacgcuguacgccguggcgaccaccgugaucaccccgaugcugcggcacacgaucgagaacuccaccgccaacgucagccucgccgccaucgcgaaccaggccguggugcugauggggcuggacaagggcuggcccaucuccaagauggaccucggggucccccugcuggcccucggcugcuacagccaggugaacccccugacccugaccgccgccgugcuccugcuggucacgcacuacgcgaucaucggcccggggcuccaggccaaggccacccgcgaggcccagaagcggaccgccgcgggcaucaugaagaaccccaccguggacgggaucaugacgaucgaccuggaccccgugaucuacgacuccaaguucgagaagcagcugggccaggucaugcuccuggugcugugcgccgugcagcuccugcugaugcgcaccagcugggcccucugcgaggcccugacccuggccaccggccccaucacgacccucugggagggguccccgggcaaguucuggaacaccaccaucgcggucagcauggccaacaucuuccggggguccuaccuggccggcgccgggcuggcguucagcaucaugaaguccgugggcacgggccgccgggggaccggcagccagggggagacccucggcgagaaguggaagaagaagcugaaccagcugagccgcaaggaguucgaccucuacaagaaguccgggaucaccgagguggaccggaccgaggccaaggagggccugaagcgcggcgagacgacccaccacgccgucagccggggguccgccaagcugcagugguucguggagcgcaacauggugauccccgagggccgcgucaucgaccucgggugcggccgcggcggguggagcuacuacugcgccgggcugaagaaggugaccgaggugcgcggguacaccaagggcgggcccggccacgaggagcccgucccgauguccacguacggguggaacaucgugaagcugaugagcggcaaggacguguucuaccugccgcccgagaagugcgacacccugcugugcgacaucggcgaguccagccccuccccgaccgucgaggagagccggaccauccgcgugcugaagaugguggagcccuggcucaagaacaaccaguucugcaucaagguccugaaccccuacaugcccacggugaucgagcaccuggagcggcuccagcgcaaguacgggggcaugcuggugcggaacccgcugucccgcaacagcacccacgagauguacuggaucuccaacgggaccggcaacaucgucagcuccgugaacauggucagccggcuccugcugaaccgcuucaccaugacgcaccggcgccccaccaucgagaaggacguggaccucggcgcggggacccggcacgugaacgccgagcccgagaccccgaacauggacgucaucggcgagcgcaucaagcggaucaaggaggagcacuccagcacguggcacuacgacgacgagaaccccuacaagaccugggccuaccacggguccuacgaggugaaggccaccggcagcgccagcuccaugaucaacgggguggucaagcugcugaccaagcccugggacguggugcccauggucacgcagauggcgaugaccgacaccaccccguucggccagcagcgcguguucaaggagaagguggacacgcggacgccccggcccaugcccggcacccggaaggucauggagaucaccgccgaguggcucuggcgcacgcuggggcgcaacaagaagccgcggcugugcacccgcgaggaguucaccaagaaggugcggaccaacgccgccaugggcgccguguucacggaggagaaccagugggacaacgcgcgcgccgccgucgaggacgaggaguucuggaagcucguggaccgggagcgcgagcugcacaagcuggggaagugcggcagcugcguguacaacaugauggggaagcgggagaagaagcucggcgaguucggcaaggccaaggggucccgcgcgaucugguacauguggcugggcgcccgguaccuggaguucgaggcccucggguuccugaacgaggaccacugguucagccgcgagaacuccuacagcggcgucgagggggagggccugcacaagcucggcuacauccugcgggacaucuccaagauccccgggggcgccauguacgccgacgacaccgcggggugggacacccgcaucaccgaggacgaccugcacaacgaggagaagaucacgcagcagauggaccccgagcaccggcagcucgccaacgccaucuucaagcugaccuaccagaacaagguggugaagguccagcgccccaccccgaagggcaccgugauggacaucaucagccggaaggaccagcgcggcuccggccaggugggcaccuacgggcugaacacguucaccaacauggaggcccagcucguccggcagauggagggcgagggggugcugagcaaggccgaccuggagaacccccaccuccuggagaagaagaucacccaguggcuggagaccaagggcguggagcgccucaagcggauggcgaucuccggcgacgacugcgucgugaagcccaucgacgaccgcuucgccaacgcccugcuggcccucaacgacauggggaaggugcggaaggacaucccccaguggcagccgagcaagggcuggcacgacuggcagcagguccccuucugcucccaccacuuccacgagcugaucaugaaggacgggcgcaagcugguggugcccugccgcccccaggacgagcucaucggccgggcccgcaucagccagggggcgggcuggucccugaaggagacggccugccugggcaaggccuacgcccagauguggagccucauguacuuccaccggcgcgaccugcggcuggccuccaacgcgaucugcagcgccgucccggugcacuggauccccaccucccgcaccaccuggagcauccacgcccaccaccaguggaugacgaccgaggacaugcucaccguguggaaccgggucuggaucgaggacaaccccuggauggaggacaagacccccgugacgaccugggaggacgugccguaccuggggaagcgcgaggaccaguggugcggcagccugaucgggcucaccucccgggccaccugggcgcagaacauccugacggccauccagcagguccgcagccugaucggcgacgaggaguuccucgacuacaugcccuccaugaagcgguuccgcaaggaggaggagagcgagggggccaucugguga

SEQ ID NO: 10299 - RNA, 9873 nt, Artificial Sequence
  derived and/or modified CDS sequence (opt1) from DENV-3__EU482458__SS-prME
accagccugugccucaugaugaugcugcccgcgacccuggccuuccaccucaccagccgcgacggcgagccgcggaugaucguggggaagaacgagcgcggcaagagccugcuguucaagaccgcguccgggaucaacaugugcacccucaucgccauggaccugggcgagaugugcgacgacaccgugacguacaagugcccccugaucgccgagguggagcccgaggacaucgacugcuggugcaaccucaccagcaccugggugaccuacgggacgugcaaccaggccggcgagcaccggcgcgacaagcgguccguggcccuggcgccccacgugggcauggggcuggacacccgcacccagaccuggaugagcgccgagggcgccuggcggcaggucgagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgugugcaagcacaccuacgucgaccggggguggggcaacgggugcggccuguucgggaagggcucccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccagcaccguggaggccgugcugcccgaguacggcacccucgggcuggagugcuccccgcgcaccggccuggacuucaacgagaugauccuccugaccaugaagaacaaggcguggaugguccaccggcagugguucuucgaccugccccuccccuggacgagcggcgccaccaccgagacccccacguggaaccgcaaggagcugcugaccaccuucaagaacgcccacgccaagaagcaggagguggugguccucgggucccaggagggcgccaugcacaccgcgcugacgggggccaccgagauccagaacagcggcgggaccuccaucuucgccggccaccugaagugccggcucaagauggacaagcuggagcugaagggcaugagcuacgccaugugccucaacaccuucgugcugaagaaggagguguccgagacgcagcacgggaccauccugaucaaggucgaguacaagggcgaggacgccccgugcaagauccccuucagcaccgaggacgggcagggcaaggcgcacaacggccgccugaucaccgccaaccccguggugacgaagaaggaggagcccgucaacaucgaggccgagccgcccuucggggagagcaacaucgugaucggcaucggggacaaggcccucaagaucaacugguacaagaagggcuccagcaucgggaagauguucgaggcgaccgcccggggcgcccgccggauggccauccugggcgacaccgccugggacuucggguccgugggcgggguccugaacagccucggcaagauggugcaccagaucuucggguccgcguacaccgcccuguucagcggcguguccuggaucaugaagaucggcaucgggguccugcucacguggaucggccugaacagcaagaacaccuccaugagcuucuccugcaucgugaucgggaucaucacccuguaccucggcgccgugguccaggccgacauggggugcgccaucaacuggaagggcaaggagcugaagugcggcagcgggaucuucgugaccaacgaggugcacacguggaccgagcaguacaaguuccaggcggacucccccaagcgccuggccaccgccaucgccggcgccugggagaacggggucugcggcauccgcagcaccacgcggauggagaaccuccuguggaagcagaucgcgaacgagcugaacuacauccucugggagaacaacaucaagcugaccgugguggucggggacaucaucggcgugcuggagcagggcaagcgcacccucacgccccagccgauggagcugaaguacuccuggaagacgugggggaaggccaagaucgugaccgccgagacccagaacagcuccuucaucaucgacggccccaacacccccgagugccccagcgccucccgggcguggaacgucugggagguggaggacuacggguucggcguguucacgaccaacaucuggcugaagcuccgcgaggucuacacccagagcugcgaccaccggcugaugagcgccgccaucaaggacgagcgcgccgugcacgccgacaugggcuacuggaucgagucccagaagaacgggagcuggaagcuggagaaggcguccuucaucgaggugaagaccugcaccuggcccaagagccacacgcucugguccaacggcguccuggagagcgacaugaucauccccaagucccuggccgggcccaucagccagcacaaccaccggccgggcuaccacacccagaccgccgggcccuggcaccucggcaagcuggagcuggacuucaacuacugcgagggcaccacgguggugaucaccgagaacugcgggaugcgcggccccucccuccggaccaccacggucagcgggaagcugauccacgaguggugcugccgcuccugcacccugcccccgcuccgguacaugggcgaggacgggugcugguacggcauggagauccgccccaucaacgagaaggaggagaacauggucaagagccugguguccgccggcagcgggaaggucgacaacuucaccaugggcgugcugugccucgccauccuguucgaggaggugaugcgggggaaguucggcaagaagcacaugaucgcggggguccuguucaccuucgugcuccugcuguccggccagaucacguggcgcgacauggcccacacccucaucaugaucggcagcaacgccuccgaccggauggggaugggcgugaccuaccuggcccugaucgccaccuucaagauccagcccuuccucgcgcugggguucuuccugcgcaagcucacgagccgggagaaccugcugcucggcgucggccuggccauggccaccacccugcagcuccccgaggacaucgagcagauggccaacgggaucgcgcugggccugaugacccucaagcugaucacgcaguucgagaccuaccagcuguggaccgcccucgugagccugaccugcuccaacacgaucuucacccugaccguggccuggcgcaccgccacgcucauccuggccggggucagccugcucccgcugugccaguccagcuccaugcggaagaccgacuggcugcccaugaccguggcggccaugggcgugccgccccugccgcuguucaucuucagccugaaggacacccccaagcgccgcuccuggccccucaacgagggggugauggccgugggccuggucagcauccuggccuccagccuccugcggaacgacgugcccauggccggcccgcugguggccggcgggcuccugaucgccugcuacgucaucacggggaccuccgccgaccugaccguggagaaggccgccgacgugaccugggaggaggaggcggagcagacgggggucagccacaaccucaugaucaccguggacgacgacgggaccaugcgcaucaaggacgacgagaccgagaacauccugaccgugcugcucaagacggcccugcugaucgucuccggcaucuuccccuacagcauccccgccacccuccugguguggcacaccuggcagaagcagacccagcgguccggcgugcugugggacguccccagcccgcccgagacgcagaaggccgagcucgaggaggggguguaccgcaucaagcagcagggcaucuucgggaagacccaggugggcgucggggugcagaaggagggcguguuccacaccauguggcacgucacccggggcgccgugcugacgcacaacgggaagcgccuggagcccaacugggcguccgugaagaaggaccucaucagcuacggcgggggcuggcggcuguccgcccaguggcagaagggggaggagguccaggugaucgccguggagcccggcaagaacccgaagaacuuccagaccaugcccggcaucuuccagaccaccacgggggagaucggcgccaucgcgcuggacuucaagcccgggaccagcggcagcccgaucaucaaccgcgagggcaaggucguggggcuguacggcaacgggguggucaccaagaacggcggguacguguccggcaucgcccagaccaacgccgagcccgacggccccacgcccgagcucgaggaggagauguucaagaagcggaaccugaccaucauggaccugcacccggggagcggcaagacccgcaaguaccuccccgccaucgugcgggaggccaucaagcgccggcugcgcacccugauccucgcgcccacgcgggucguggccgccgagauggaggaggcccugaaggggcugcccauccgcuaccagaccaccgccaccaaguccgagcacacgggccgggagaucguggaccucaugugccacgcgaccuucaccaugcgccugcugagcccgguccgggugcccaacuacaaccucaucaucauggacgaggcccacuucaccgaccccgccuccaucgccgcccgcggguacaucagcacgcgggugggcaugggcgaggcggccgccaucuucaugaccgccacgccgcccgggaccgcggaggccuucccccaguccaacgcccccauccaggacgaggagcgcgacauccccgagcgcagcuggaacuccggcaacgaguggaucacggacuucgucgggaagaccgugugguucgugcccagcaucaaggccggcaacgacaucgccaacugccugcggaagaacgggaagaaggucauccagcugucccgcaagaccuucgacaccgaguaccagaagacgcggcucaacgacugggacuucguggugaccaccgacaucagcgagaugggcgcgaacuucaaggccgaccgcgucaucgacccccggcgcugccugaagcccgugauccugaccgacggccccgagcgggugauccucgccgggccgaugcccgucacggccgccuccgcggcccagcgccggggccgcguggggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgcggccaucgacggcgaguaccggcugaagggcgagucccgcaagaccuucguggagcucaugcggcgcggggaccugcccgucuggcuggcccacaagguggccagcgagggcaucaaguacacggaccggaaguggugcuucgacggggagcgcaacaaccagauccucgaggagaacauggacgucgagaucuggaccaaggagggcgagcggaagaagcugcgcccgcgcuggcuggacgcgcggaccuacuccgacccccucgcccugaaggaguucaaggacuucgccgccggccgcaagagcaucgcccuggaccucgugaccgagaucgggcgggugcccucccaccuggcguaccgcacgcggaacgcccuggacaaccucgucaugcugcacaccagcgagcacggcgggcgcgccuaccggcacgccguggaggagcugccggagaccauggagacccuccugcugcucggccugaugauccugcucaccgggggcgccaugcuguuccugaucagcggcaaggggaucggcaagaccuccaucgggcucaucugcgugaucgucagcuccggcaugcuguggauggcggacgugccccugcaguggaucgccagcgccaucgugcucgaguucuucaugaugguccugcugauccccgagcccgagaagcagcgcaccccgcaggacaaccagcucgccuacguggugaucgggauccugacccuggccgcgaucgucgccgccaacgagaugggccuccuggagacgaccaagcgggaccugggcauguccaaggagcccgggguggugagccccaccuccuaccucgacgucgaccugcaccccgccagcgccuggacccuguacgcgguggccacgaccgugaucaccccgaugcuccgccacaccaucgagaacuccacggccaacgucagccuggccgcgaucgccaaccaggccguggugcugaugggccucgacaagggguggcccaucuccaagauggaccugggcgucccccugcucgcccuggggugcuacagccaggugaacccccugacccucaccgccgcggugcugcugcucgucacccacuacgccaucaucggcccgggccugcaggccaaggccacgcgggaggcccagaagcgcaccgcggccgggaucaugaagaaccccaccguggacggcaucaugaccaucgaccuggaccccgugaucuacgacuccaaguucgagaagcagcucgggcaggucaugcugcuggugcucugcgccgugcagcugcugcucaugcggacgagcugggcccugugcgaggcccugacccucgcgaccggccccaucaccacgcugugggagggcuccccggggaaguucuggaacaccaccaucgccgucagcauggccaacaucuuccgcggcuccuaccuggccggggcgggccucgccuucagcaucaugaaguccguggggaccggccggcgcggcacggggagccagggcgagacccugggggagaaguggaagaagaagcugaaccagcucagccggaaggaguucgaccuguacaagaaguccggcaucaccgagguggaccgcaccgaggccaaggaggggcugaagcggggcgagaccacgcaccacgccgucagccgcggcuccgccaagcuccagugguucguggagcggaacauggugauccccgaggggcgcgucaucgaccugggcugcgggcgcggcggguggagcuacuacugcgcgggccugaagaaggugaccgaggugcggggcuacaccaagggcggccccgggcacgaggagcccgucccgauguccaccuacggcuggaacaucgugaagcucaugagcgggaaggacguguucuaccugccgcccgagaagugcgacacgcugcugugcgacaucggcgaguccagccccuccccgaccgucgaggagagccgcaccauccgggugcucaagaugguggagcccuggcugaagaacaaccaguucugcaucaagguccugaaccccuacaugcccaccgugaucgagcaccucgagcgccugcagcggaaguacggcgggaugcuggugcgcaacccgcucucccggaacagcacgcacgagauguacuggaucuccaacggcaccgggaacaucgucagcuccgugaacauggugagccgccugcugcucaaccgguucaccaugacccaccgccggcccacgaucgagaaggacgucgaccugggcgccggcacccgccacgugaacgccgagcccgagaccccgaacauggacgucaucggggagcggaucaagcgcaucaaggaggagcacuccagcaccuggcacuacgacgacgagaaccccuacaagacgugggccuaccacggcuccuacgaggugaaggccaccgggagcgcgagcuccaugaucaacggcguggucaagcugcucaccaagcccugggacguggugcccauggucacccagauggccaugacggacaccaccccguucgggcagcagcggguguucaaggagaagguggacacccgcacgccccggcccaugcccggcacccgcaaggucauggagaucaccgccgaguggcuguggcggacccugggccgcaacaagaagccgcgccucugcacgcgggaggaguucaccaagaaggugcgcaccaacgccgccaugggggcgguguucaccgaggagaaccagugggacagcgcccgggccgccgucgaggacgaggaguucuggaagcugguggaccgcgagcgggagcugcacaagcucggcaagugcggguccugcguguacaacaugaugggcaagcgcgagaagaagcugggggaguucggcaaggcgaagggcagccgggccaucugguacauguggcugggggcccgcuaccucgaguucgaggcccugggcuuccugaacgaggaccacugguucucccgggagaacagcuacuccggggucgagggcgaggggcuccacaagcugggcuacauccugcgcgacaucagcaagauccccggcggggccauguacgcggacgacacggccggcugggacacccggaucaccgaggacgaccuccacaacgaggagaagaucacccagcagauggaccccgagcaccgccagcuggccaacgccaucuucaagcugacguaccagaacaagguggugaagguccagcggcccaccccgaaggggaccgugauggacaucaucucccgcaaggaccagcggggcagcggccagguggggaccuacggccucaacaccuucacgaacauggaggcccagcugguccgccagauggagggggagggcgugcuguccaaggcggaccucgagaacccccaccuccuggagaagaagaucacccaguggcucgagaccaaggggguggagcggcugaagcgcauggccaucagcggcgacgacugcgucgugaagcccaucgacgaccgguucgccaacgcccugcucgcccugaacgacaugggcaaggugcgcaaggacaucccccaguggcagccguccaagggguggcacgacuggcagcagguccccuucugcagccaccacuuccacgagcugaucaugaaggacggccggaagcucguggugcccugccgcccccaggacgagcugaucgggcgcgcgcggaucucccagggcgccggguggagccugaaggagaccgccugccucggcaaggccuacgcccagauguggucccugauguacuuccaccgccgggaccugcgccucgcgagcaacgccaucugcuccgccgucccggugcacuggauccccacgagccggaccaccuggagcauccacgcccaccaccaguggaugaccacggaggacaugcugaccguguggaaccgcgucuggaucgaggacaaccccuggauggaggacaagacccccaucaccacgugggaggacgugccguaccugggcaagcgggaggaccaguggugcgggucccucaucggccugaccagccgcgcgaccugggcccagaacauccugaccgccauccagcagguccggucccucaucggggacgaggaguuccuggacuacaugcccagcaugaagcgcuuccggaaggaggaggaguccgagggcgccaucugguga

SEQ ID NO: 10300 - RNA, 9873 nt, Artificial Sequence
  derived and/or modified CDS sequence (opt1) from DENV-3__EU482459__SS-prME
accagccugugccucaugaugaugcugcccgcgacccuggccuuccaccucaccagccgggacggcgagccgcggaugaucguggggaagaacgagcgcggcaagagccugcuguucaagaccgcguccgggaucaacaugugcacccucaucgccauggaccugggcgagaugugcgacgacaccgugacguacaagugcccccugaucgccgagguggagcccgaggacaucgacugcuggugcaaccucaccagcaccugggugaccuacgggacgugcaaccaggccggcgagcaccggcgcgacaagcgguccguggcccuggcgccccacgugggcauggggcuggacacccgcacccagaccuggaugagcgccgagggcgccuggcgccagguggagaagguggagacgugggcccuccgccacccgggguucaccauccuggcgcuguuccucgcccacuacaucggcaccucccugacccagaagguggugaucuucauccugcucaugcuggugacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgugugcaagcacaccuacgucgaccggggguggggcaacgggugcggccuguucgggaagggcucccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccagcaccguggaggccgugcugcccgaguacggcacccucgggcuggagugcuccccgcgcaccggccuggacuucaacgagaugauccuccugaccaugaagaacaaggcguggaugguccaccggcagugguucuucgaccugccccuccccuggacgagcggcgccaccaccgagacccccacguggaaccgcaaggagcugcuggugaccuucaagaacgcccacgccaagaagcaggagguggucgugcucgggucccaggagggcgccaugcacaccgcgcugaccggggccacggagauccagaacagcggcgggaccuccaucuucgccggccaccugaagugccggcucaagauggacaagcuggagcugaagggcaugagcuacgccaugugccucaacaccuucgugcugaagaaggaggucuccgagacccagcacgggacgauccugaucaagguggaguacaagggcgaggacgccccgugcaagauccccuucagcaccgaggacgggcagggcaaggcgcacaacggccgccugaucaccgccaaccccguggucaccaagaaggaggagcccgugaacaucgaggccgagccgcccuucggggagagcaacaucgugaucggcaucggggacaaggcccucaagaucaacugguacaagaagggcuccagcaucgggaagauguucgaggcgacggcccggggcgcccgccggauggccauccugggcgacaccgccugggacuucggguccgucggcggggugcugaacagccucggcaagauggugcaccagaucuucggguccgcguacaccgcccuguucagcggcgucuccuggaucaugaagaucggcaucggggugcugcucaccuggaucggccugaacagcaagaacacguccaugagcuucuccugcaucgugaucgggaucaucacccuguaccucggcgccgucgugcaggccgacauggggugcgccaucaacuggaagggcaaggagcugaagugcggcagcgggaucuucgugaccaacgagguccacaccuggacggagcaguacaaguuccaggcggacucccccaagcgccuggccaccgccaucgccggcgccugggagaacggggugugcggcauccgcagcaccacccggauggagaaccuccuguggaagcagaucgcgaacgagcugaacuacauccucugggagaacaacaucaagcugacgguggucgugggggacaucaucggcgugcuggagcagggcaagcgcacccucacgccccagccgauggagcugaaguacuccuggaagaccugggggaaggccaagaucgucacggccgagacccagaacagcuccuucaucaucgacggccccaacacccccgagugccccagcgccucccgggcguggaacgugugggagguggaggacuacggguucggcgucuucaccacgaacaucuggcugaagcuccgcgagguguacacccagagcugcgaccaccggcugaugagcgccgccaucaaggacgagcgcgccgugcacgccgacaugggcuacuggaucgagucccagaagaacgggagcuggaagcuggagaaggcguccuucaucgaggucaagaccugcaccuggcccaagagccacacccucugguccaacggcgugcuggagagcgacaugaucauccccaagucccuggccgggcccaucagccagcacaaccaccggccgggcuaccacacgcagaccgccgggcccuggcaccucggcaagcuggagcuggacuucaacuacugcgagggcaccaccguggucaucacggagaacugcgggacccgcggccccucccuccggaccaccacggugagcgggaagcugauccacgaguggugcugccgcuccugcacccugcccccgcuccgguacaugggcgaggacgggugcugguacggcauggagauccgccccaucaacgagaaggaggagaacauggucaagagccuggucuccgccggcagcgggaagguggacaacuucaccaugggcgugcugugccucgccauccuguucgaggaggucaugcgggggaaguucggcaagaagcacaugaucgcgggggugcuguucaccuucgugcuccugcuguccggccagaucacguggcgcgacauggcccacacccucaucaugaucggcagcaacgccuccgaccggauggggaugggcgucaccuaccuggcccugaucgccaccuucaagauccagcccuuccucgcgcugggguucuuccugcgcaagcucacgagccgggagaaccugcugcucggcgugggccuggccauggccaccacccugcagcuccccgaggacaucgagcagauggccaacgggaucgcgcugggccugaugacccucaagcugaucacgcaguucgagaccuaccagcuguggaccgcccucgugagccugaccugcuccaacacgaucuucacccugaccgucgccuggcgcaccgccacgcucauccuggccggggugagccugcucccgcugugccaguccagcuccaugcggaagaccgacuggcugcccaugaccgucgcggccaugggcgugccgccccugccgcuguucaucuucagccugaaggacacccccaagcgccgcuccuggccccucaacgagggggugauggccgucggccuggugagcauccuggccuccagccuccugcggaacgacgugcccauggccggcccgcuggucgccggcgggcuccugaucgccugcuacgugaucacggggaccuccgccgaccugaccguggagaaggccgccgacgucaccugggaggaggaggcggagcagacgggggugagccacaaccucaugaucaccguggacgacgacgggaccaugcgcaucaaggacgacgagaccgagaacauccugaccguccugcucaagacggcccugcugaucguguccggcaucuuccccuacagcauccccgccacccuccugguguggcacaccuggcagaagcagacccagcgguccggcguccugugggacgugcccagcccgcccgagacgcagaaggccgagcucgaggaggggguguaccgcaucaagcagcagggcaucuucgggaagacccaggucggcgugggggugcagaaggagggcgucuuccacaccauguggcacgugacccggggcgccgugcugacgcacaacgggaagcgccuggagcccaacugggcguccgucaagaaggaccucaucagcuacggcgggggcuggcggcuguccgcccaguggcagaagggggaggagguccaggugaucgccgucgagcccggcaagaacccgaagaacuuccagaccaugcccggcaucuuccagaccaccacgggggagaucggcgccaucgcgcuggacuucaagcccgggaccagcggcagcccgaucaucaaccgcgagggcaaggugguggggcuguacggcaacggggucgugaccaagaacggcggguacguguccggcaucgcccagaccaacgccgagcccgacggccccacgcccgagcucgaggaggagauguucaagaagcggaaccugaccaucauggaccugcacccggggagcggcaagacccgcaaguaccuccccgccaucguccgggaggccaucaagcgccggcugcgcacccugauccucgcgcccacgcgggugguggccgccgagauggaggaggcccugaaggggcugcccauccgcuaccagaccaccgccaccaaguccgagcacacgggccgggagaucgucgaccucaugugccacgcgaccuucaccaugcgccugcugagcccggugcgggugcccaacuacaaccucaucaucauggacgaggcccacuucaccgaccccgccuccaucgccgcccgcggguacaucagcacgcgggucggcaugggcgaggcggccgccaucuucaugaccgccacgccgcccgggaccgcggaggccuucccccaguccaacgcccccauccaggacgaggagcgcgacauccccgagcgcagcuggaacuccggcaacgaguggaucacggacuucguggggaagaccgugugguucguccccagcaucaaggccggcaacgacaucgccaacugccugcggaagaacgggaagaaggugauccagcugucccgcaagaccuucgacaccgaguaccagaagacgcggcucaacgacugggacuucguggucaccaccgacaucagcgagaugggcgcgaacuucaaggccgaccgcgugaucgacccccggcgcugccugaagcccgugauccugaccgacggccccgagcgggucauccucgccgggccgaugcccgugacggccgccuccgcggcccagcgccggggccgcguggggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgcggccaucgacggcgaguaccggcugaagggcgagucccgcaagaccuucgucgagcucaugcggcgcggggaccugcccguguggcuggcccacaaggucgccagcgagggcaucaaguacacggaccggaaguggugcuucgacggggagcgcaacaaccagauccucgaggagaacauggacguggagaucuggaccaaggagggcgagcggaagaagcugcgcccgcgcuggcuggacgcgcggaccuacuccgacccccucgcccugaaggaguucaaggacuucgccgccggccgcaagagcaucgcccuggaccucgugaccgagaucgggcggguccccucccaccuggcguaccgcacgcggaacgcccuggacaaccucgugaugcugcacaccagcgagcacggcgggcgcgccuaccggcacgccguggaggagcugccggagaccauggagacccuccugcugcucggccugaugauccugcucaccggcggggccaugcuguuccugaucagcgggaaggggaucggcaagaccuccaucgggcucaucugcgucaucgugagcuccggcaugcuguggauggcggacgugccccugcaguggaucgccagcgccaucguccucgaguucuucaugauggugcugcugauccccgagcccgagaagcagcgcaccccgcaggacaaccagcucgccuacguggucaucgggauccugacccuggccgcgaucguggccgccaacgagaugggccuccuggagacgaccaagcgggaccugggcauguccaaggagcccgggguggucagccccaccuccuaccucgacguggaccugcaccccgccagcgccuggacccuguacgcgguggccacgaccgucaucaccccgaugcuccgccacaccaucgagaacuccacggccaacgugagccuggccgcgaucgccaaccaggccgugguccugaugggccucgacaagggguggcccaucuccaagauggaccugggcgugccccugcucgcccuggggugcuacagccaggugaacccccugacccucaccgccgcgguccugcugcucgugacccacuacgccaucaucggcccgggccugcaggccaaggccacgcgggaggcccagaagcgcaccgcggccgggaucaugaagaaccccaccguggacggcaucaugaccaucgaccuggaccccgucaucuacgacuccaaguucgagaagcagcucggccaggugaugcugcuggugcucugcgccguccagcugcugcucaugcggacgagcugggcccugugcgaggcccugacccucgcgaccggccccaucaccacgcugugggagggcuccccggggaaguucuggaacaccaccaucgccgugagcauggccaacaucuuccgcggcuccuaccuggccggggcgggccucgccuucagcaucaugaaguccguggggaccggccggcgcggcacggggagccagggcgagacccugggggagaaguggaagaagaagcugaaccagcucagccggaaggaguucgaccuguacaagaaguccggcaucaccgaggucgaccgcaccgaggccaaggaggggcugaagcggggcgagaccacgcaccacgccgugagccgcggcuccgccaagcuccagugguucguggagcggaacauggucauccccgaggggcgcgugaucgaccugggcugcgggcgcggcggguggagcuacuacugcgcgggccugaagaaggugaccgagguccggggcuacaccaagggcggccccgggcacgaggagcccgugccgauguccaccuacggcuggaaccucgugaagcugaugagcgggaaggacgucuucuaccugccgcccgagaagugcgacacgcugcucugcgacaucggcgaguccagccccuccccgaccguggaggagagccgcaccauccgggugcugaagauggucgagcccuggcugaagaacaaccaguucugcaucaaggugcucaaccccuacaugcccaccgugaucgagcaccuggagcgccugcagcggaaguacggcgggaugcucguccgcaacccgcugucccggaacagcacgcacgagauguacuggaucuccaacggcaccgggaacaucgugagcuccgugaacauggucagccgccugcuccugaaccgguucaccaugacccaccgccggcccacgaucgagaaggacguggaccugggcgccggcacccgccacgucaacgccgagcccgagaccccgaacauggacgugaucggggagcggaucaagcgcaucaaggaggagcacuccagcaccuggcacuacgacgacgagaaccccuacaagacgugggccuaccacggcuccuacgaggugaaggccaccgggagcgcgagcuccaugaucaacggcgucgugaagcuccugaccaagcccugggacgugguccccauggugacccagauggccaugacggacaccaccccguucgggcagcagcggguguucaaggagaaggucgacacccgcacgccccggcccaugcccggcacccgcaaggugauggagaucaccgccgaguggcuguggcggacccucggccgcaacaagaagccgcgccugugcacgcgggaggaguucaccaagaaggugcgcaccaacgccgccaugggggcggucuucaccgaggagaaccagugggacagcgcccgggccgccguggaggacgaggaguucuggaagcugguggaccgcgagcgggagcuccacaagcugggcaagugcggguccugcgucuacaacaugaugggcaagcgcgagaagaagcugggggaguucggcaaggcgaagggcagccgggccaucugguacauguggcucggggcccgcuaccuggaguucgaggcccugggcuuccucaacgaggaccacugguucucccgggagaacagcuacuccgggguggagggcgaggggcugcacaagcugggcuacauccuccgcgacaucagcaagauccccggcggggccauguacgcggacgacacggccggcugggacacccggaucaccgaggacgaccugcacaacgaggagaagaucacccagcagauggaccccgagcaccgccagcuggccaacgccaucuucaagcucacguaccagaacaagguggucaaggugcagcggcccaccccgaaggggaccgugauggacaucaucucccgcaaggaccagcggggcagcggccaggucgggaccuacggccugaacaccuucacgaacauggaggcccagcuggugcgccagauggagggggagggcgugcucuccaaggcggaccuggagaacccccaccuccucgagaagaagaucacccaguggcuggagaccaagggggucgagcggcugaagcgcauggccaucagcggcgacgacugcguggugaagcccaucgacgaccgguucgccaacgcccuccuggcccugaacgacaugggcaagguccgcaaggacaucccccaguggcagccguccaagggguggcacgacuggcagcagguccccuucugcagccaccacuuccacgagcucaucaugaaggacggccggaagcuggugguccccugccgcccccaggacgagcugaucgggcgcgcgcggaucucccagggcgccggguggagccucaaggagaccgccugccugggcaaggccuacgcccagauguggucccugauguacuuccaccgccgggaccuccgccuggcgagcaacgccaucugcuccgccgugccggugcacuggauccccacgagccggaccaccuggagcauccacgcccaccaccaguggaugaccacggaggacaugcugaccgucuggaaccgcguguggaucgaggacaaccccuggauggaggacaagacccccgugaccacgugggaggacgucccguaccucggcaagcgggaggaccaguggugcgggucccugaucggccugaccagccgcgcgaccugggcccagaacauccucaccgccauccagcagguccggucccugaucggggacgaggaguuccuggacuacaugcccagcaugaagcgcuuccggaaggaggaggaguccgagggcgccaucugguga

SEQ ID NO: 10301 - RNA, 9873 nt, Artificial Sequence
  derived and/or modified CDS sequence (opt1) from DENV-3__EU482460__SS-prME
accagccugugccucaugaugaugcugcccgccaccuucgccuuccaccugacgucccgcgacggcgagccgcggaugaucguggggaagaacgagcgcggcaagagccuccuguucaagaccgcguccgggaucaacaugugcacccugaucgccauggaccucggcgagaugugcgacgacaccgucacguacaagugcccccugaucgccgagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccauccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacaccgugaucaucacggugcacaccggggaccagcaccaggucggcaacgacacccagggggugaccgucgagaucacgccccaggccagcaccguggaggccgugcugcccgaguacggcacccuggggcucgagugcuccccgcgcaccggccuggacuucaacgagaugauccugcucaccaugaagaacaaggcguggaugguccaccggcagugguucuucgaccugccccugcccuggacgagcggcaccaccaccgagacgcccaccuggaaccgcaaggagcuccuggugaccuucaagaacgcccacgccaagaagcaggagguggucgugcuggggucccaggagggcgccaugcacaccgcccucacgggggcgaccgagauccagaacagcggcgggaccuccaucuucgccggccaccugaagugccggcugaagauggacaagcucgagcugaagggcaugagcuacgccaugugccugaacaccuucgugcucaagaaggaggucuccgagacgcagcacgggaccauccugaucaagguggaguacaagggcgaggacgccccgugcaagauccccuucagcaccgaggacgggcagggcaaggcccacaacggccgccugaucaccgcgaaccccguggucacgaagaaggaggagcccgugaacaucgaggccgagccgcccuucggggagagcaacaucgugaucggcaucggggacaaggcccugaagaucaacugguacaagaagggcuccagcaucgggaagauguucgaggccaccgcgcggggcgcccgccggauggccauccucggcgacaccgccugggacuucggguccgucggcggggugcugaacagccugggcaagauggugcaccagaucuucggguccgccuacaccgcgcucuucagcggcgucuccuggaucaugaagaucggcaucggggugcugcugacguggaucggccucaacagcaagaacaccuccaugagcuucuccugcaucgugaucgggaucaucacccuguaccugggcgccgucgugcaggccgacauggggugcgccaucaacuggaagggcaaggagcucaagugcggcagcgggaucuucgugaccaacgagguccacacguggaccgagcaguaccgcuuccaggccgacucccccaagcgccuggcgaccgccaucgccggcgccugggagaacggggugugcggcauccggagcaccacgcgcauggagaaccugcucuggaagcagaucgccaacgagcugaacuacauccugugggagaacaacaucaagcucaccguggucgugggggacaucaucggcgugcuggagcagggcaagcgggcgcuggccccccagccgauggagcucaaguacuccuggaagaccugggggaaggccaagaucgucaccgccgagacgcagaacagcuccuucaucaucgacggccccaacacccccgagugccccagcgcgucccgcgccuggaacgugugggagguggaggacuacggguucggcgucuucaccaccaacaucuggcugaagcugcgggagguguacacgcagagcugcgaccaccgccucaugagcgccgccaucaaggacgagcgggccgugcacgcggacaugggcuacuggaucgagucccagaagaacgggagcuggaagcuggagaaggccuccuucaucgaggucaagaccugcaccuggccgaagagccacacccugugguccaacggcgugcucgagagcgacaugaucauccccaagucccuggccgggcccaucagccagcacaaccaccgcccgggcuaccacacccagacggccgggcccuggcaccugggcaagcucgagcuggacuucaacuacugcgagggcaccaccguggucaucaccgagaacugcgggacgcggggccccucccugcgcaccaccaccgugagcgggaagcucauccacgaguggugcugccgguccugcacgcugcccccgcugcgcuacaugggcgaggacgggugcugguacggcauggagauccggcccaucaacgagaaggaggagaacauggugaagagccucgucuccgccggcagcgggaagguggacaacuucaccaugggcgugcugugccuggcgauccucuucgaggaggucaugcgcgggaaguucggcaagaagcacaugaucgccggggugcuguucaccuucgugcugcuccuguccggccagaucaccuggcgggacauggcccacacgcugaucaugaucggcagcaacgccuccgaccgcauggggaugggcgucaccuaccucgcccugaucgcgaccuucaagauccagcccuuccuggcccucggguucuuccugcggaagcugaccagccgcgagaaccuccugcugggcgugggccucgccauggccacgacccugcagcugcccgaggacaucgagcagauggcgaacgggaucgcccucggccugaugacccugaagcucaucacccaguucgagacguaccagcuguggaccgcccuggugagccucaccugcuccaacaccaucuucacgcugaccgucgccuggcggaccgccacccugauccucgcgggggugagccugcugccgcucugccaguccagcuccaugcgcaagacggacuggcugcccaugaccgucgccgccaugggcgugcccccccugccgcucuucaucuucagccugaaggacacccccaagcgccgguccuggccccugaacgagggggugauggccgucggccucgugagcauccuggccuccagccugcuccgcaacgacgugcccauggcgggcccgcuggucgccgggggccugcucaucgccugcuacgugaucaccgggacguccgccgaccugaccguggagaaggccgcggacgucaccugggaggaggaggccgagcagaccggcgugagccacaaccugaugaucacgguggacgacgacgggaccaugcggaucaaggacgacgagaccgagaacauccucaccguccugcugaagaccgcccuccugaucguguccggcaucuuccccuacagcauccccgccacgcugcucguguggcacaccuggcagaagcagacccagcgcuccggcguccugugggacgugcccagcccgcccgagacccagaaggccgagcuggaggaggggguguaccggaucaagcagcagggcaucuucgggaagacgcaggucggcgugggggugcagaaggagggcgucuuccacaccauguggcacgugacccgcggcgcggugcucacccacaacgggaagcggcuggagcccaacugggccuccgucaagaaggaccugaucagcuacggcgggggcuggcgccucuccgcccaguggcagaagggggaggaggugcaggugaucgccgucgagcccggcaagaacccgaagaacuuccagacgaugcccggcaucuuccagaccaccaugggggagaucggcgcgaucgcccuggacuucaagcccgggaccagcggcagcccgaucaucaaccgggagggcaaggugguggggcuguacggcaacggggucgugacgaagaacggcggguacguguccggcaucgcccagaccaacgccgagcccgacggccccacccccgagcuggaggaggagauguucaagaagcgcaaccucaccaucauggaccugcacccggggagcggcaagacgcggaaguaccugcccgccaucguccgcgaggcgaucaagcggcgccuccggacccugauccuggcccccacccgcgugguggccgccgagauggaggaggcccucaaggggcugcccauccgguaccagaccacggcgaccaaguccgagcacaccggccgcgagaucgucgaccugaugugccacgccaccuucacgaugcggcuccugagcccggugcgcgugcccaacuacaaccugaucaucauggacgaggcccacuucaccgaccccgccuccaucgccgcgcggggguacaucagcacccgcgucggcaugggcgaggccgccgccaucuucaugaccgcgacgcccccggggaccgccgaggccuucccccaguccaacgcccccauccaggacgaggagcgcgacauccccgagcggagcuggaacuccggcaacgaguggaucaccgacuucguggggaagaccgugugguucgucccgagcaucaaggccggcaacgacaucgcgaacugccuccgcaagaacgggaagaaggugauccagcugucccggaagacguucgacaccgaguaccagaagacccgccugaacgacugggacuucguggucaccacggacaucagcgagaugggcgccaacuucaaggccgaccgggugaucgacccccgccggugccucaagcccgugauccugaccgacggccccgagcgcgucauccuggccgggccgaugcccgugaccgccgcguccgccgcccagcggcgcggccggguggggcgcaacccccagaaggagaacgaccaguacaucuucaccggccagccccucaacaacgacgaggaccacgcccacuggacggaggccaagaugcugcuggacaacaucaacaccccggaggggaucauccccgcgcucuucgagcccgagcgggagaagagcgccgccaucgacggcgaguaccgccugaagggcgagucccggaagaccuucgucgagcugaugcgccggggggaccuccccguguggcuggcccacaaggucgcgagcgagggcaucaaguacaccgaccgcaaguggugcuucgacggggagcggaacaaccagauccuggaggagaacauggacguggagaucuggaccaaggagggcgagcgcaagaagcuccgcccgcgguggcuggacgcccgcacguacuccgacccccuggcccucaaggaguucaaggacuucgccgccggccggaagagcaucgcgcuggaccuggugaccgagaucgggcgcguccccucccaccucgccuaccggacccgcaacgcccuggacaaccuggugaugcuccacaccagcgagcacggcgggcgggccuaccgccacgccguggaggagcugccggagacgauggagacccugcuccugcugggccucaugauccugcugaccgggggcgcgaugcucuuccugaucagcggcaaggggaucggcaagaccuccaucgggcugaucugcgucaucgugagcuccggcaugcucuggauggccgacgugccccugcaguggaucgccagcgccaucguccuggaguucuucaugauggugcuccugauccccgagcccgagaagcagcggacgccgcaggacaaccagcuggccuacguggucaucgggauccucacccuggcggccaucguggccgccaacgagaugggccugcucgagaccaccaagcgcgaccugggcauguccaaggagcccgggguggucagccccacguccuaccuggacguggaccuccaccccgccagcgcguggacccuguacgccguggccaccaccgucaucacgccgaugcugcggcacaccaucgagaacuccaccgccaacgugagccucgcggccaucgccaaccaggccgugguccugaugggccuggacaagggguggcccaucuccaagauggaccucggcgugccccugcuggcccucgggugcuacagccaggugaacccccugacccugacggcggccguccuccugcuggugacccacuacgccaucaucggcccgggccuccaggccaaggccacccgcgaggcgcagaagcggaccgccgccgggaucaugaagaaccccacgguggacggcaucaugaccaucgaccuggaccccgucaucuacgaccccaaguucgagaagcagcuggggcaggugaugcuccuggugcugugcgccguccagcuccugcugaugcgcaccuccugggcccucugcgaggcgcugacccuggccacgggcccgaucaccacccucugggagggcagccccgggaaguucuggaacaccacgaucgccguguccauggccaacaucuuccggggcagcuaccuggcgggggccggccuggccuucuccaucaugaagagcguggggaccggccgccggggcaccgggucccagggcgagacccucggggagaaguggaagaagaagcugaaccagcugagccgcaaggaguucgaccucuacaagaagagcggcaucacggaggucgaccggaccgaggccaaggaggggcugaagcgcggcgagaccacccaccacgccgugucccggggcagcgcgaagcugcagugguucguggagcgcaacauggucauccccgaggggcgcgugaucgaccucggcugcgggcggggcgggugguccuacuacugcgccggccugaagaaggugaccgagguccgcggcuacacgaaggggggccccgggcacgaggagccggugcccaugagcaccuacggcuggaacaucgugaagcugauguccgggaaggacgucuucuaccucccccccgagaagugcgacacccugcugugcgacaucggcgagagcuccccgagccccaccguggaggagucccggacgauccgcgugcugaagauggucgagcccuggcucaagaacaaccaguucugcaucaaggugcugaaccccuacaugccgaccgugaucgagcaccuggagcggcuccagcgcaaguacggcgggaugcugguccggaacccccugagccgcaacuccacccacgagauguacuggaucagcaacggcaccgggaacaucguguccagcgugaacauggucucccggcuccugcugaaccgcuucacgaugacccaccggcgccccaccaucgagaaggacguggaccucggcgccggcacccggcacgucaacgccgagccggagacgcccaacauggacgugaucggggagcgcaucaagcggaucaaggaggagcacagcuccaccuggcacuacgacgacgagaaccccuacaagaccugggccuaccacggcagcuacgaggugaaggcgaccggguccgccagcagcaugaucaacggcgucgugaagcugcugacgaagcccugggacguggucccgauggugacccagauggccaugaccgacaccacgcccuucgggcagcagcgcguguucaaggagaaggucgacacccggaccccccgccccaugccgggcacccggaaggugauggagaucacggccgaguggcucuggcgcacccugggccgcaacaagaagccccggcugugcacccgcgaggaguucaccaagaaggugcggacgaacgccgcgaugggggccgucuucaccgaggagaaccagugggacuccgcccgcgccgcgguggaggacgaggaguucuggaagcucguggaccgggagcgcgagcugcacaagcugggcaagugcgggagcugcgucuacaacaugaugggcaagcgggagaagaagcucggggaguucggcaaggccaagggcucccgcgccaucugguacauguggcugggggcccgguaccuggaguucgaggcccucggcuuccugaacgaggaccacugguucagccgcgagaacuccuacagcgggguggagggcgaggggcugcacaagcucggcuacauccugcgggacaucuccaagauccccggcggggcgauguacgccgacgacaccgccggcugggacacccgcaucacggaggacgaccugcacaacgaggagaagaucacccagcagauggaccccgagcaccggcagcucgccaacgccaucuucaagcugaccuaccagaacaagguggucaaggugcagcgcccgacccccaaggggacggugauggacaucaucagccggaaggaccagcgcggcuccggccaggucgggaccuacggccugaacaccuucaccaacauggaggcgcagcucgugcggcagauggagggggagggcgugcugagcaaggccgaccuggagaacccccaccuccuggagaagaagaucacccaguggcuggagacgaagggggucgagcgccucaagcggauggccaucuccggcgacgacugcguggugaagcccaucgacgaccgcuucgccaacgcccugcuggcgcucaacgacaugggcaagguccggaaggacaucccgcaguggcagcccagcaagggguggcacgacuggcagcaggugcccuucugcucccaccacuuccacgagcugaucaugaaggacggccgcaagcuggugguccccugccgcccgcaggacgagcucaucgggcgggcccgcaucagccagggcgccggguggucccugaaggagaccgccugccugggcaaggccuacgcgcagauguggagccucauguacuuccaccggcgcgaccugcggcuggccuccaacgccaucugcagcgccgugcccgugcacuggauccccaccucccgcaccacguggagcauccacgcgcaccaccaguggaugaccaccgaggacaugcucaccgucuggaaccggguguggaucgaggacaaccccuggauggaggacaagacgccggugaccaccugggaggacguccccuaccugggcaagcgcgaggaccaguggugcgggagccugaucggccucaccucccgggccacgugggcccagaacauccugaccgccauccagcaggugcgcagccugaucggggacgaggaguuccucgacuacaugcccuccaugaagcgguuccgcaaggaggaggagagcgagggcgccaucugguga

SEQ ID NO: 10302 - RNA, 9873 nt, Artificial Sequence
  derived and/or modified CDS sequence (opt1) from DENV-3__EU482461__SS-prME
accagccugugccucaugaugaugcugcccgcgacccuggccuuccaccucaccagccgggacggcgagccgcggaugaucguggggaagaacgagcgcggcaagagccugcuguucaagaccgcguccgggaucaacaugugcacccucaucgccauggaccugggcgagaugugcgacgacaccgugacguacaagugcccccugaucgccgagguggagcccgaggacaucgacugcuggugcaaccucaccagcaccugggugaccuacgggacgugcaaccaggccggcgagcaccggcgcgacaagcgguccguggcccuggcgccccacgugggcauggggcuggacacccgcacccagaccuggaugagcgccgagggcgccuggcgccagguggagaagguggagacgugggcccuccgccacccgggguucaccauccuggcgcuguuccucgcccacuacaucggcaccucccugacccagaagguggugaucuucauccugcucaugcuggugacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgugugcaagcacaccuacgucgaccggggguggggcaacgggugcggccuguucgggaagggcucccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccagcaccguggaggccgugcugcccgaguacggcacccucgggcuggagugcuccccgcgcaccggccuggacuucaacgagaugauccuccugaccaugaagaacaaggcguggaugguccaccggcagugguucuucgaccugccccuccccuggacgagcggcgccaccaccgagacccccacguggaaccgcaaggagcugcuggugaccuucaagaacgcccacgccaagaagcaggagguggucgugcucgggucccaggagggcgccaugcacaccgcgcugaccggggccacggagauccagaacagcggcgggaccuccaucuucgccggccaccugaagugccggcucaagauggacaagcuggagcugaagggcaugagcuacgccaugugccucaacaccuucgugcugaagaaggaggucuccgagacccagcacgggacgauccugaucaagguggaguacaagggcgaggacgccccgugcaagauccccuucagcaccgaggacgggcagggcaaggcgcacaacggccgccugaucaccgccaaccccguggucaccaagaaggaggagcccgugaacaucgaggccgagccgcccuucggggagagcaacaucgugaucggcaucggggacaaggcccucaagaucaacugguacaagaagggcuccagcaucgggaagauguucgaggcgacggcccggggcgcccgccggauggccauccugggcgacaccgccugggacuucggguccgucggcggggugcugaacagccucggcaagauggugcaccagaucuucggguccgcguacaccgcccuguucagcggcgucuccuggaucaugaagaucggcaucggggugcugcucaccuggaucggccugaacagcaagaacacguccaugagcuucuccugcaucgugaucgggaucaucacccuguaccucggcgccgucgugcaggccgacauggggugcgccaucaacuggaagggcaaggagcugaagugcggcagcgggaucuucgugaccaacgagguccacaccuggacggagcaguacaaguuccaggcggacucccccaagcgccuggccaccgccaucgccggcgccugggagaacggggugugcggcauccgcagcaccacccggauggagaaccuccuguggaagcagaucgcgaacgagcugaacuacauccucugggagaacaacaucaagcugacgguggucgugggggacaucaucggcgugcuggagcagggcaagcgcacccucacgccccagccgauggagcugaaguacuccuggaagaccugggggaaggccaagaucgucacggccgagacccagaacagcuccuucaucaucgacggccccaacacccccgagugccccagcgccucccgggcguggaacgugugggagguggaggacuacggguucggcgucuucaccacgaacaucuggcugaagcuccgcgagguguacacccagagcugcgaccaccggcugaugagcgccgccaucaaggacgagcgcgccgugcacgccgacaugggcuacuggaucgagucccagaagaacgggagcuggaagcuggagaaggcguccuucaucgaggucaagaccugcaccuggcccaagagccacacccucugguccaacggcgugcuggagagcgacaugaucauccccaagucccuggccgggcccaucagccagcacaaccaccggccgggcuaccacacgcagaccgccgggcccuggcaccucggcaagcuggagcuggacuucaacuacugcgagggcaccaccguggucaucacggagaacugcgggacccgcggccccucccuccggaccaccacggugagcgggaagcugauccacgaguggugcugccgcuccugcacccugcccccgcuccgguacaugggcgaggacgggugcugguacggcauggagauccgccccaucaacgagaaggaggagaacauggucaagagccuggucuccgccggcagcgggaagguggacaacuucaccaugggcgugcugugccucgccauccuguucgaggaggucaugcgggggaaguucggcaagaagcacaugaucgcgggggugcuguucaccuucgugcuccugcuguccggccagaucacguggcgcgacauggcccacacccucaucaugaucggcagcaacgccuccgaccggauggggaugggcgucaccuaccuggcccugaucgccaccuucaagauccagcccuuccucgcgcugggguucuuccugcgcaagcucacgagccgggagaaccugcugcucggcgugggccuggccauggccaccacccugcagcuccccgaggacaucgagcagauggccaacgggaucgcgcugggccugaugacccucaagcugaucacgcaguucgagaccuaccagcuguggaccgcccucgugagccugaccugcuccaacacgaucuucacccugaccgucgccuggcgcaccgccacgcucauccuggccggggugagccugcucccgcugugccaguccagcuccaugcggaagaccgacuggcugcccaugaccgucgcggccaugggcgugccgccccugccgcuguucaucuucagccugaaggacacccccaagcgccgcuccuggccccucaacgagggggugauggccgucggccuggugagcauccuggccuccagccuccugcggaacgacgugcccauggccggcccgcuggucgccggcgggcuccugaucgccugcuacgugaucacggggaccuccgccgaccugaccguggagaaggccgccgacgucaccugggaggaggaggcggagcagacgggggugagccacaaccucaugaucaccguggacgacgacgggaccaugcgcaucaaggacgacgagaccgagaacauccugaccguccugcucaagacggcccugcugaucguguccggcaucuuccccuacagcauccccgccacccuccugguguggcacaccuggcagaagcagacccagcgguccggcguccugugggacgugcccagcccgcccgagacgcagaaggccgagcucgaggaggggguguaccgcaucaagcagcagggcaucuucgggaagacccaggucggcgugggggugcagaaggagggcgucuuccacaccauguggcacgugacccggggcgccgugcugacgcacaacgggaagcgccuggagcccaacugggcguccgucaagaaggaccucaucagcuacggcgggggcuggcggcuguccgcccaguggcagaagggggaggagguccaggugaucgccgucgagcccggcaagaacccgaagaacuuccagaccaugcccggcaucuuccagaccaccacgggggagaucggcgccaucgcgcuggacuucaagcccgggaccagcggcagcccgaucaucaaccgcgagggcaaggugguggggcuguacggcaacggggucgugaccaagaacggcggguacguguccggcaucgcccagaccaacgccgagcccgacggccccacgcccgagcucgaggaggagauguucaagaagcggaaccugaccaucauggaccugcacccggggagcggcaagacccgcaaguaccuccccgccaucguccgggaggccaucaagcgccggcugcgcacccugauccucgcgcccacgcgggugguggccgccgagauggaggaggcccugaaggggcugcccauccgcuaccagaccaccgccaccaaguccgagcacacgggccgggagaucgucgaccucaugugccacgcgaccuucaccaugcgccugcugagcccggugcgggugcccaacuacaaccucgucaucauggacgaggcccacuucaccgaccccgccuccaucgccgcccgcggguacaucagcacgcgggugggcaugggcgaggcggccgccaucuucaugaccgccacgccgcccgggaccgcggaggccuucccccaguccaacgcccccauccaggacgaggagcgcgacauccccgagcgcagcuggaacuccggcaacgaguggaucacggacuucguggggaagaccgucugguucgugcccagcaucaaggccggcaacgacaucgccaacugccugcggaagaacgggaagaaggugauccagcugucccgcaagaccuucgacaccgaguaccagaagacgcggcucaacgacugggacuucgucgugaccaccgacaucagcgagaugggcgcgaacuucaaggccgaccgcgugaucgacccccggcgcugccugaagcccgucauccugaccgacggccccgagcgggugauccucgccgggccgaugcccgugacggccgccuccgcggcccagcgccggggccgcgucgggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgcggccaucgacggcgaguaccggcugaagggcgagucccgcaagaccuucguggagcucaugcggcgcggggaccugcccgucuggcuggcccacaagguggccagcgagggcaucaaguacacggaccggaaguggugcuucgacggggagcgcaacaaccagauccucgaggagaacauggacguggagaucuggaccaaggagggcgagcggaagaagcugcgcccgcgcuggcuggacgcgcggaccuacuccgacccccucgcccugaaggaguucaaggacuucgccgccggccgcaagagcaucgcccuggaccucgucaccgagaucgggcgggugcccucccaccuggcguaccgcacgcggaacgcccuggacaaccucgugaugcugcacaccagcgagcacggcgggcgcgccuaccggcacgccgucgaggagcugccggagaccauggagacccuccugcugcucggccugaugauccugcucaccggcggggccaugcuguuccugaucagcgggaaggggaucggcaagaccuccaucgggcucaucugcgugaucgugagcuccggcaugcuguggauggcggacgucccccugcaguggaucgccagcgccaucgugcucgaguucuucaugauggugcugcugauccccgagcccgagaagcagcgcaccccgcaggacaaccagcucgccuacgucgugaucgggauccugacccuggccgcgaucguggccgccaacgagaugggccuccuggagacgaccaagcgggaccugggcauguccaaggagcccggggucgugagccccaccuccuaccucgacguggaccugcaccccgccagcgccuggacccuguacgcggucgccacgaccgugaucaccccgaugcuccgccacaccaucgagaacuccacggccaacgugagccuggccgcgaucgccaaccaggccgucgugcugaugggccucgacaagggguggcccaucuccaagauggaccugggcgugccccugcucgcccuggggugcuacagccaggucaacccccugacccucaccgccgcggugcugcugcucgugacccacuacgccaucaucggcccgggccugcaggccaaggccacgcgggaggcccagaagcgcaccgcggccgggaucaugaagaaccccaccgucgacggcaucaugaccaucgaccuggaccccgugaucuacgacuccaaguucgagaagcagcucggccaggugaugcugcugguccucugcgccgugcagcugcugcucaugcggacgagcugggcccugugcgaggcccugacccucgcgaccggccccaucaccacgcugugggagggcuccccggggaaguucuggaacaccaccaucgccgugagcauggccaacaucuuccgcggcuccuaccuggccggggcgggccucgccuucagcaucaugaaguccgucgggaccggccggcgcggcacggggagccagggcgagacccugggggagaaguggaagaagaagcugaaccagcucagccggaaggaguucgaccuguacaagaaguccggcaucaccgagguggaccgcaccgaggccaaggaggggcugaagcggggcgagaccacgcaccacgccgugagccgcggcuccgccaagcuccagugguucgucgagcggaacauggugauccccgaggggcgcgugaucgaccugggcugcgggcgcggcggguggagcuacuacugcgcgggccugaagaaggucaccgaggugcggggcuacaccaagggcggccccgggcacgaggagcccgugccgauguccaccuacggcuggaaccucgucaagcugaugagcgggaaggacguguucuaccugccgcccgagaagugcgacacgcugcucugcgacaucggcgaguccagccccuccccgaccguggaggagagccgcaccauccggguccugaagaugguggagcccuggcugaagaacaaccaguucugcaucaaggugcucaaccccuacaugcccaccgucaucgagcaccuggagcgccugcagcggaaguacggcgggaugcucgugcgcaacccgcugucccggaacagcacgcacgagauguacuggaucuccaacggcaccgggaacaucgugagcuccgucaacauggugagccgccugcuccugaaccgguucaccaugacccaccgccggcccacgaucgagaaggacgucgaccugggcgccggcacccgccacgugaacgccgagcccgagaccccgaacauggacgugaucggggagcggaucaagcgcaucaaggaggagcacuccagcaccuggcacuacgacgacgagaaccccuacaagacgugggccuaccacggcuccuacgaggucaaggccaccgggagcgcgagcuccaugaucaacggcguggugaagcuccugaccaagcccugggacgucgugcccauggugacccagauggccaugacggacaccaccccguucgggcagcagcgggucuucaaggagaagguggacacccgcacgccccggcccaugcccggcacccgcaaggugauggagaucaccgccgaguggcuguggcggacccucggccgcaacaagaagccgcgccugugcacgcgggaggaguucaccaagaagguccgcaccaacgccgccaugggggcgguguucaccgaggagaaccagugggacagcgcccgggccgccguggaggacgaggaguucuggaagcuggucgaccgcgagcgggagcuccacaagcugggcaagugcggguccugcguguacaacaugaugggcaagcgcgagaagaagcugggggaguucggcaaggcgaagggcagccgggccaucugguacauguggcucggggcccgcuaccuggaguucgaggcccugggcuuccucaacgaggaccacugguucucccgggagaacagcuacuccgggguggagggcgaggggcugcacaagcugggcuacauccuccgcgacaucagcaagauccccggcggggccauguacgcggacgacacggccggcugggacacccggaucaccgaggacgaccugcacaacgaggagaagaucacccagcagauggaccccgagcaccgccagcuggccaacgccaucuucaagcucacguaccagaacaaggucgugaaggugcagcggcccaccccgaaggggaccgucauggacaucaucucccgcaaggaccagcggggcagcggccagguggggaccuacggccugaacaccuucacgaacauggaggcccagcuggugcgccagauggagggggagggcguccucuccaaggcggaccuggagaacccccaccuccucgagaagaagaucacccaguggcuggagaccaaggggguggagcggcugaagcgcauggccaucagcggcgacgacugcguggucaagcccaucgacgaccgguucgccaacgcccuccuggcccugaacgacaugggcaaggugcgcaaggacaucccccaguggcagccguccaagggguggcacgacuggcagcagguccccuucugcagccaccacuuccacgagcucaucaugaaggacggccggaagcuggucgugcccugccgcccccaggacgagcugaucgggcgcgcgcggaucucccagggcgccggguggagccucaaggagaccgccugccugggcaaggccuacgcccagauguggucccugauguacuuccaccgccgggaccuccgccuggcgagcaacgccaucugcuccgccgugccgguccacuggauccccacgagccggaccaccuggagcauccacgcccaccaccaguggaugaccacggaggacaugcugaccguguggaaccgcguguggaucgaggacaaccccuggauggaggacaagacccccgucaccacgugggaggacgugccguaccucggcaagcgggaggaccaguggugcgggucccugaucggccugaccagccgcgcgaccugggcccagaacauccucaccgccauccagcagguccggucccugaucggggacgaggaguuccuggacuacaugcccagcaugaagcgcuuccggaaggaggaggaguccgagggcgccaucugguga

SEQ ID NO: 10303 - RNA, 9873 nt, Artificial Sequence
  derived and/or modified CDS sequence (opt1) from DENV-3__EU482462__SS-prME
accagccucugccucaugaugaugcuccccgcgacccuggccuuccaccucacgagccgggacggcgagccgcggaugaucguggggaagaacgagcgcggcaagagccugcuguucaagaccgcguccgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggacgugcaaccaggccggcgagcaccggcgcgacaagcgguccguggcccuggcgccccacgugggcauggggcuggacacccgcacccagaccuggaugagcgccgagggcgccuggcgccagguggagaagguggagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggcccggaacaagcccacccuggacaucgagcugcagaagaccgaggccacccagcucgcgacgcugcgcaagcugugcaucgagggcaagaucaccaacaucaccaccgacagccggugccccacgcagggcgaggccauccucccggaggagcaggaccagaacuacgugugcaagcacaccuacgucgaccgcggguggggcaacgggugcggccuguucgggaagggcucccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccagcaccguggaggccgugcugcccgaguacggcacccucgggcuggagugcuccccgcggaccggccuggacuucaacgagaugauccuccugaccaugaagaacaaggcguggaugguccaccgccagugguucuucgaccugccccuccccuggacgagcggcgccaccaccgagacccccacguggaaccggaaggagcugcuggugaccuucaagaacgcccacgccaagaagcaggagguggucgugcucgggucccaggagggcgccaugcacaccgcgcugaccggggccacggagauccagaacagcggcgggaccuccaucuucgccggccaccugaagugccgccucaagauggacaagcuggagcugaagggcaugagcuacgccaugugccucaacaccuucgugcugaagaaggaggucuccgagacccagcacgggacgauccugaucaagguggaguacaagggcgaggacgccccgugcaagauccccuucagcaccgaggacgggcagggcaaggcgcacaacggccggcugaucaccgccaaccccguggucaccaagaaggaggagcccgugaacaucgaggccgagccgcccuucggggagagcaacaucgugaucggcaucggggacaaggcccucaagaucaacugguacaagaagggcuccagcaucgggaagauguucgaggcgacggcccgcggcgcccggcgcauggccauccugggcgacaccgccugggacuucggguccgucggcggggugcugaacagccucggcaagauggugcaccagaucuucggguccgcguacaccgcccuguucagcggcgucuccuggaucaugaagaucggcaucggggugcugcucaccuggaucggccugaacagcaagaacacguccaugagcuucuccugcaucgugaucgggaucaucacccuguaccucggcgccgucgugcaggccgacauggggugcgccaucaacuggaagggcaaggagcugaagugcggcagcgggaucuucgugaccaacgagguccacaccuggacggagcaguacaaguuccaggcggacucccccaagcgccuggccaccgccaucgccggcgccugggagaacggggugugcggcauccggagcaccacccgcauggagaaccuccuguggaagcagaucgcgaacgagcugaacuacauccucugggagaacaacaucaagcugacgguggucgugggggacaucaucggcgugcuggagcagggcaagcggacccucacgccccagccgauggaccugaaguacuccuggaagaccugggggaaggccaagaucgucacggccgagacccagaacagcuccuucaucaucgacggccccaacacccccgagugccccagcgccucccgcgcguggaacgugugggagguggaggacuacggguucggcgucuucaccacgaacaucuggcugaagcuccgggagguguacacccagagcugcgaccaccgccugaugagcgccgccaucaaggacgagcgggccgugcacgccgacaugggcuacuggaucgagucccagaagaacgggagcuggaagcuggagaaggcguccuucaucgaggucaagaccugcaccuggcccaagagccacacccucugguccaacggcgugcuggagagcgacaugaucauccccaagucccuggccgggcccaucagccagcacaaccaccgcccgggcuaccacacgcagaccgccgggcccuggcaccucggcaagcuggagcuggacuucaacuacugcgagggcaccaccguggucaucacggagaacugcgggacccggggccccucccuccgcaccaccacggugagcgggaagcugauccacgaguggugcugccgguccugcacccugcccccgcuccgcuacaugggcgaggacgggugcugguacggcauggagauccggcccaucaacgagaaggaggagaacauggucaagagccuggucuccgccggcagcgggaagguggacaacuucaccaugggcgugcugugccucgccauccuguucgaggaggucaugcgcgggaaguucggcaagaagcacaugaucgcgggggugcuguucaccuucgugcuccugcuguccggccagaucacguggaaggacauggcccacaccuucaucaugaucggcagcaacgccuccgaccggauggggaugggcgucaccuaccucgcccugaucgccaccuucaagauccagcccuuccuggcgcucggguucuuccugcgcaagcugacgagccgggagaaccuccugcugggcgugggccucgccauggccaccacccugcagcugcccgaggacaucgagcagauggccaacgggaucgcgcucggccugaugacccugaagcucaucacgcaguucgagaccuaccagcuguggaccgcccuggugagccugaccugcuccaacacgaucuucacccugaccgucgccuggcgcaccgccacgcuggugcucgccggggucagccugcugccgcucugccaguccagcuccaugcggaagaccgacuggcugcccaugaccguggcggccaugggcgugccgccccucccccucuucaucuucagccugaaggacacccccaagcgccgcuccuggccccugaacgagggggucauggccgugggccucgugagcauccuggccuccagccugcuccggaacgacguccccauggccggcccgcugguggccggcgggcugcucaucgccugcuacgugaucacggggaccuccgccgaccugaccgucgagaaggccgccgacgugaccugggaggaggaggcggagcagacgggggugagccacaaccugaugaucaccgucgacgacgacgggaccaugcgcaucaaggacgacgagaccgagaacauccucaccgugcugcugaagacggcccuccugaucguguccggcaucuuccccuacagcauccccgccacccugcucgucuggcacaccuggcagaagcagacccagcgguccggcgugcugugggacgugcccagcccgcccgagacgcagaaggccgagcuggaggagggggucuaccgcaucaagcagcagggcaucuucgggaagacccaggugggcguggggguccagaaggagggcguguuccacaccauguggcacgugacccggggcgccguccucacgcacaacgggaagcgccuggagcccaacugggcguccgugaagaaggaccugaucagcuacggcgggggcuggcggcucuccgcccaguggcagaagggggaggaggugcaggucaucgccguggagcccggcaagaacccgaagaacuuccagaccaugcccggcaucuuccagaccaccacgggggagaucggcgccaucgcgcuggacuucaagcccgggaccagcggcagcccgaucaucaaccgcgagggcaagguggucgggcuguacggcaacgggguggugaccaagaacggcggguacgucuccggcaucgcccagaccaacgccgagcccgacggccccacgcccgagcuggaggaggagauguucaagaagcggaaccucaccaucauggaccugcacccggggagcggcaagacccgcaaguaccugcccgccaucgugcgggaggccaucaagcgccggcuccgcacccugauccuggcgcccacgcggguggucgccgccgagauggaggaggcccucaaggggcugcccauccgcuaccagaccaccgccaccaaguccgagcacacgggccgggagaucguggaccugaugugccacgcgaccuucaccaugcgccuccugagcccggugcggguccccaacuacaaccugaucaucauggacgaggcccacuucaccgaccccgccuccaucgccgcccgcggguacaucagcacgcgggugggcaugggcgaggcggccgccaucuucaugaccgccacgcccccggggaccgcggaggccuucccccaguccaacgcccccauccaggacgaggagcgcgacauccccgagcgcagcuggaacuccggcaacgaguggaucacggacuucguggggaagaccgucugguucgugccgagcaucaaggccggcaacgacaucgccaacugccuccggaagaacgggaagaaggugauccagcugucccgcaagaccuucgacaccgaguaccagaagacgcggcugaacgacugggacuucgucgugaccaccgacaucagcgagaugggcgcgaacuucaaggccgaccgcgugaucgacccccggcgcugccucaagcccgucauccugaccgacggccccgagcgggugauccuggccgggccgaugcccgugacggccgccuccgcggcccagcgccggggccgcgucgggcggaacccccagaaggagaacgaccaguacaucuucaccggccagccccucaacaacgacgaggaccacgcccacuggaccgaggccaagaugcugcuggacaacaucaacaccccggaggggaucauccccgcccucuucgagcccgagcgcgagaaguccgcggccaucgacggcgaguaccggcugaagggcgagucccgcaagaccuucguggagcugaugcggcgcggggaccuccccgucuggcuggcccacaagguggccagcgagggcaucaaguacacggaccggaaguggugcuucgacggggagcgcaacaaccagauccuggaggagaacauggacguggagaucuggaccaaggagggcgagcggaagaagcuccgcccgcgcuggcuggacgcgcggaccuacuccgacccccuggcccucaaggaguucaaggacuucgccgccggccgcaagagcaucgcccuggaccuggucaccgagaucgggcgggugcccucccaccucgcguaccgcacgcggaacgcccuggacaaccuggugaugcuccacaccagcgagcacggcgggcgcgccuaccggcacgccgucgaggagcugccggagaccauggagacccugcuccugcugggccucaugauccugcugaccggcggggccaugcuguuccugaucagcgggaaggggaucggcaagaccuccaucgggcugaucugcgugaucgugagcuccggcaugcucuggauggcggacgucccccugcaguggaucgccagcgccaucgugcuggaguucuucaugauggugcuccugauccccgagcccgagaagcagcgcaccccgcaggacaaccagcuggccuacgucgugaucgggauccucacccuggccgcgaucguggccgccaacgagaugggccugcucgagacgaccaagcgggaccugggcauguccaaggagcccggggucgugagccccaccuccuaccuggacguggaccuccaccccgccagcgccuggacccuguacgcggucgccacgaccgugaucaccccgaugcugcgccacaccaucgagaacuccacggccaacgugagccucgccgcgaucgccaaccaggccgucgugcugaugggccuggacaagggguggcccaucuccaagauggaccucggcgugccccugcuggcccucgggugcuacagccaggucaacccccugacccugaccgccgcggugcuccugcuggugacccacuacgccaucaucggcccgggccuccaggccaaggccacgcgggaggcccagaagcgcaccgcggccgggaucaugaagaaccccaccgucgacggcaucaugaccaucgaccuggaccccgugaucuacgacuccaaguucgagaagcagcugggccaggugaugcuccugguccugugcgccgugcagcuccugcugaugcggacgagcugggcccucugcgaggcccugacccuggcgaccggccccaucaccacgcucugggagggcuccccggggaaguucuggaacaccaccaucgccgugagcauggccaacaucuuccgcggcuccuaccuggccggggcgggccuggccuucagcaucaugaaguccgucgggaccggccggcgcggcacggggagccagggcgagacccucggggagaaguggaagaagaagcugaaccagcugagccggaaggaguucgaccucuacaagaaguccggcaucaccgagguggaccgcaccgaggccaaggaggggcugaagcggggcgagaccacgcaccacgccgugagccgcggcuccgccaagcugcagugguucgucgagcggaacauggugauccccgaggggcgcgugaucgaccucggcugcgggcgcggcggguggagcuacuacugcgcgggccugaagaaggucaccgaggugcggggcuacaccaagggcggccccgggcacgaggagcccgugccgauguccaccuacggcuggaacaucgucaagcugaugagcgggaaggacguguucuaccugccgcccgagaagugcgacacgcugcugugcgacaucggcgaguccagccccuccccgaccguggaggagagccgcaccauccggguccugaagaugguggagcccuggcucaagaacaaccaguucugcaucaaggugcugaaccccuacaugcccaccgucaucgagcaccuggagcgccuccagcggaaguacggcgggaugcuggugcgcaacccgcugucccggaacagcacgcacgagauguacuggaucuccaacggcaccgggaacaucgugagcuccgucaacauggugagccgccuccugcugaaccgguucaccaugacccaccgccggcccacgaucgagaaggacgucgaccucggcgccggcacccgccacgugaacgccgagcccgagaccccgaacauggacgugaucggggagcggaucaagcgcaucaaggaggagcacuccagcaccuggcacuacgacgacgagaaccccuacaagacgugggccuaccacggcuccuacgaggucaaggccaccgggagcgcgagcuccaugaucaacggcguggugaagcugcugaccaagcccugggacgucgugcccauggugacccagauggccaugacggacaccaccccguucgggcagcagcgggucuucaaggagaagguggacacccgcacgccccggcccaugcccggcacccgcaaggugauggagaucaccgccgaguggcucuggcggacccugggccgcaacaagaagccgcgccugugcacgcgggaggaguucaccaagaagguccgcaccaacgccgccaugggggcgguguucaccgaggagaaccagugggacagcgcccgggccgccguggaggacgaggaguucuggaagcucgucgaccgcgagcgggagcugcacaagcugggcaagugcggguccugcguguacaacaugaugggcaagcgcgagaagaagcucggggaguucggcaaggcgaagggcagccgggccaucugguacauguggcugggggcccgcuaccuggaguucgaggcccucggcuuccugaacgaggaccacugguucucccgggagaacagcuacuccgggguggagggcgaggggcugcacaagcucggcuacauccugcgcgacaucagcaagauccccggcggggccauguacgcggacgacacggccggcugggacacccggaucaccgaggacgaccugcacaacgaggagaagaucacccagcagauggaccccgagcaccgccagcucgccaacgccaucuucaagcugacguaccagaacaaggucgugaaggugcagcggcccaccccgaaggggaccgucauggacaucaucucccgcaaggaccagcggggcagcggccagguggggaccuacggccugaacaccuucacgaacauggaggcccagcucgugcgccagauggagggggagggcguccuguccaaggcggaccuggagaacccccaccuccuggagaagaagaucacccaguggcuggagaccaaggggguggagcggcucaagcgcauggccaucagcggcgacgacugcguggucaagcccaucgacgaccgguucgccaacgcccugcuggcccucaacgacaugggcaaggugcgcaaggacaucccccaguggcagccguccaagggguggcacgacuggcagcagguccccuucugcagccaccacuuccacgagcugaucaugaaggacggccggaagcuggucgugcccugccgcccccaggacgagcucaucgggcgcgcgcggaucucccagggcgccggguggagccugaaggagaccgccugccugggcaaggccuacgcccagauguggucccucauguacuuccaccgccgggaccugcgccuggcgagcaacgccaucugcuccgccgugccgguccacuggauccccaucagccggacgaccuggagcauccacgcccaccaccaguggaugaccaccgaggacaugcucacgguguggaaccgcguguggaucgaggacaaccccuggauggaggacaagacccccgucaccaccugggaggacgugccguaccugggcaagcgggaggaccaguggugcgggucccugaucggccucacgagccgcgcgaccugggcccagaacauccugaccgccauccagcagguccggucccugaucggggacgaggaguuccucgacuacaugcccagcaugaagcgcuuccggaaggaggaggaguccgagggcgccaucugguga

SEQ ID NO: 10304 - RNA, 9873 nt, Artificial Sequence
  derived and/or modified CDS sequence (opt1) from DENV-3__EU660407__SS-prME
accagccugugccucaugaugaugcugcccgccacccuggccuuccaccucaccagccgggacggcgagccgcggaugaucguggggaagaacgagcggggcaagagccugcuguucaagaccgcgagcgggaucaacaugugcacccucaucgccauggaccugggcgagaugugcgacgacaccgugacguacaagugcccccugaucgccgagguggagcccgaggacaucgacugcuggugcaaccucaccagcaccugggugaccuacgggacgugcaaccaggccggcgagcaccggcgcgacaagcgguccguggcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgugugcaagcacaccuacgucgaccggggguggggcaacgggugcggccuguucgggaagggcucccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccagcaccguggaggccgugcugcccgaguacggcacccucgggcuggagugcuccccgcgcaccggccuggacuucaacgagaugauccuccugaccaugaagaacaaggcguggaugguccaccggcagugguucuucgaccugccccuccccuggacgagcggcgccaccaccgagacccccacguggaaccgcaaggagcugcuggugaccuucaagaacgcccacgccaagaagcaggagguggucgugcucgggucccaggagggcgccaugcacaccgcgcugaccggggccacggagauccagaacagcggcgggaccuccaucuucgccggccaccugaagugccggcucaagauggacaagcuggagcugaagggcaugagcuacgccaugugccucaacaccuucgugcugaagaaggaggucuccgagacccagcacgggacgauccugaucaagguggaguacaagggcgaggacgccccgugcaagauccccuucagcaccgaggacgggcagggcaaggcgcacaacggccgccugaucaccgccaaccccguggucaccaagaaggaggagcccgugaacaucgaggccgagccgcccuucggggagagcaacaucgugaucggcaucggggacaaggcccucaagaucaacugguacaagaagggcuccagcaucgggaagauguucgaggcgacggcccggggcgcccgccggauggccauccugggcgacaccgccugggacuucggguccgucggcggggugcugaacagccucggcaagauggugcaccagaucuucggguccgcguacaccgcccuguucagcggcgucuccuggaucaugaagaucggcaucggggugcugcucaccuggaucggccugaacagcaagaacacguccaugagcuucuccugcaucgugaucgggaucaucacccuguaccucggcgccgucgugcaggccgacauggggugcgugaucaacuggaagggcaaggagcugaagugcggcagcgggaucuucgucaccaacgaggugcacaccuggacggagcaguacaaguuccaggccgacucccccaagcgccuggcgaccgccaucgccggcgccugggagaacggggugugcggcauccgcagcaccacccggauggagaaccuccuguggaagcagaucgccaacgagcugaacuacauccucugggagaacaacaucaagcugacggucguggugggggacaucaucggcguccuggagcagggcaagcgcacccucacgccccagccgauggagcugaaguacuccuggaagaccugggggaaggcgaagaucgugacggccgagacccagaacagcuccuucaucaucgacggccccaacacccccgagugccccagcgccucccgggccuggaacgugugggaggucgaggacuacggguucggcguguucaccacgaacaucuggcugaagcuccgcgagguguacacccagagcugcgaccaccggcugaugagcgcggccaucaaggacgagcgcgccguccacgccgacaugggcuacuggaucgagucccagaagaacgggagcuggaagcuggagaaggccuccuucaucgaggugaagaccugcaccuggcccaagagccacacccucugguccaacggcgugcuggagaacgacaugaucauccccaagagccuggcggggcccaucucccagcacaaccaccggccgggcuaccacacgcagaccgccgggcccuggcaccucggcaagcuggagcuggacuucaacuacugcgagggcaccaccgucgugaucacggagaacugcgggacccgcggccccagccuccggaccaccacgguguccgggaagcugauccacgaguggugcugccgcagcugcacccugcccccgcuccgguacaugggcgaggacgggugcugguacggcauggagauccgccccaucaacgagaaggaggagaacauggucaagucccuggugagcgccggcuccgggaagguggacaacuucaccaugggcguccugugccucgccauccuguucgaggaggugaugcgggggaaguucggcaagaagcacaugaucgccggggugcuguucaccuucguccuccugcugagcggccagaucacguggcgcgacauggcgcacacccucaucaugaucggcuccaacgccagcgaccggauggggaugggcgugaccuaccuggcccugaucgccaccuucaagauccagcccuuccucgcccugggguucuuccugcgcaagcucacgucccgggagaaccugcugcucggcgugggccuggcgauggccaccacccugcagcuccccgaggacaucgagcagauggccaacgggaucgcccugggccugaugacccucaagcugaucacgcaguucgagaccuaccagcuguggaccgcgcucgucagccugaccugcagcaacacgaucuucacccugaccguggccuggcgcaccgccacgcucauccuggccggggucucccugcucccgcugugccagagcuccagcaugcggaagaccgacuggcugcccaugaccguggccgcgaugggcgugccgccccugccgcuguucaucuucucccugaaggacacccccaagcgccgcagcuggccccucaacgagggggucauggccgugggccugguguccauccuggccagcucccuccugcggaacgacguccccauggccggcccgcugguggccgggggccuccugaucgcgugcuacgugaucacggggaccagcgccgaccugaccgucgagaaggccgccgacgugaccugggaggaggaggccgagcagacgggcgugucccacaaccucaugaucaccgucgacgacgacgggaccaugcgcaucaaggacgacgagaccgagaacauccugaccgugcugcucaagacggcgcugcugaucgugagcggcaucuuccccuacuccauccccgccacccuccuggucuggcacaccuggcagaagcagacccagcggagcggcgugcugugggacgugcccuccccgcccgagacgcagaaggccgagcucgaggagggggucuaccgcaucaagcagcagggcaucuucgggaagacccaggugggcguggggguccagaaggagggcguguuccacaccauguggcacgugacccggggcgccguccugacgcacaacgggaagcgccuggagcccaacugggccagcgugaagaaggaccucaucuccuacggcgggggcuggcggcugagcgcgcaguggcagaagggggaggaggugcaggucaucgccguggagcccggcaagaacccgaagaacuuccagaccaugcccggcaucuuccagaccaccacgggggagaucggcgccaucgcccuggacuucaagcccgggaccuccggcagcccgaucaucaaccgcgagggcaagguggucgggcuguacggcaacgggguggugaccaagaacggcggguacgucagcggcaucgcgcagaccaacgccgagcccgacggccccacgcccgagcucgaggaggagauguucaagaagcggaaccugaccaucauggaccugcacccgggguccggcaagacccgcaaguaccuccccgccaucgugcgggaggccaucaagcgccggcugcgcacccugauccucgcccccacgcggguggucgcggccgagauggaggaggcccugaaggggcugcccauccgcuaccagaccaccgccaccaagagcgagcacacgggccgggagaucguggaccucaugugccacgccaccuucaccaugcgccugcuguccccggugcggguccccaacuacaaccucaucaucauggacgaggcgcacuucaccgaccccgccagcaucgccgcccgcggguacaucuccacgcgggugggcaugggcgaggccgcggccaucuucaugaccgccacgccgcccgggaccgccgaggcguucccccagagcaacgcccccauccaggacgaggagcgcgacauccccgagcgcuccuggaacagcggcaacgaguggaucacggacuucguggggaagaccgucugguucgugcccuccaucaaggccggcaacgacaucgccaacugccugcggaagaacgggaagaaggugauccagcugagccgcaagaccuucgacaccgaguaccagaagacgaagcucaacgacugggacuucgucgugaccaccgacaucuccgagaugggcgccaacuucaaggcggaccgggugaucgacccccgccggugccugaagcccgucauccugaccgacggccccgagcgcgugauccucgccgggccgaugcccgugacggccgccagcgccgcgcagcggcgcggccgggucgggcgcaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgggagaaguccgccgcgaucgacggcgaguaccgccugaagggcgagagccggaagaccuucguggagcucaugcgccgcggggaccugcccgucuggcuggcccacaagguggccuccgagggcaucaaguacacggaccgcaaguggugcuucgacggggagcggaacaaccagauccucgaggagaacauggacguggagaucuggaccaaggagggcgagcgcaagaagcugcggccgcgcuggcuggacgcccgcaccuacagcgacccccucgcgcugaaggaguucaaggacuucgccgccggccggaaguccaucgcccuggaccucgucaccgagaucgggcgcgugcccagccaccuggccuaccggacgcgcaacgcgcuggacaaccucgugaugcugcacaccuccgagcacggcgggcgggccuaccgccacgccgucgaggagcugccggagaccauggagacccuccugcugcucggccugaugauccugcucaccggcggggccaugcuguuccugaucagcgggaaggggaucggcaagaccagcaucgggcucaucugcgugaucguguccagcggcaugcuguggauggccgacgucccccugcaguggaucgcguccgccaucgugcucgaguucuucaugauggugcugcugauccccgagcccgagaagcagcggaccccgcaggacaaccagcucgccuacgucgugaucgggauccugacccuggccgccaucguggcggccaacgagaugggccuccuggagacgaccaagcgcgaccugggcaugagcaaggagcccggggucgugucccccaccagcuaccucgacguggaccugcaccccgccuccgccuggacccuguacgccgucgcgacgaccgugaucaccccgaugcuccggcacaccaucgagaacagcacggccaacgugucccuggccgccaucgcgaaccaggccgucgugcugaugggccucgacaagggguggcccaucagcaagauggaccugggcgugccccugcucgcccuggggugcuacucccaggucaacccccugacccucaccgccgccgugcugcugcucgugacccacuacgcgaucaucggcccgggccugcaggccaaggccacgcgcgaggcccagaagcggaccgccgcggggaucaugaagaaccccaccgucgacggcaucaugaccaucgaccuggaccccgugaucuacgacagcaaguucgagaagcagcucggccaggugaugcugcugguccucugcgccgugcagcugcugcucaugcgcacguccugggcccugugcgaggcccugacccucgccaccggccccaucaccacgcugugggagggcagcccggggaaguucuggaacaccaccaucgcgguguccauggccaacaucuuccggggcagcuaccuggccggggccggccucgcguucuccaucaugaaguccgucgggaccggccgccggggcacggggucccagggcgagacccugggggagaaguggaagaagaagcugaaccagcucagccgcaaggaguucgaccuguacaagaaguccggcaucaccgagguggaccggaccgaggccaaggaggggcugaagcgcggcgagaccacgcaccacgccgugucccggggcagcgccaagcuccagugguucgucgagcgcaacauggugauccccgaggggcgggugaucgaccugggcugcgggcgcggcgggugguccuacuacugcgccggccugaagcgcgucaccgaggugcggggcuacaccaagggcgggcccgggcacgaggagcccgugccgaugagcaccuacggcuggaacaucgucaagcucauguccgggaaggacguguucuaccugccgcccgagaagugcgacacgcugcugugcgacaucggcgagagcucccccagcccgaccguggaggagucccgcaccauccggguccucaagaugguggagcccuggcugaagaacaaccaguucugcaucaaggugcugaaccccuacaugcccaccgucaucgagcaccucgagcgccugcagcggaaguacggcgggaugcuggugcgcaacccgcucagccggaacuccacgcacgagauguacuggaucagcaacggcaccgggaacaucguguccagcgucaacauggugucccgccugcugcucaaccgguucaccaugacccaccgccggcccacgaucgagaaggacgucgaccugggcgcgggcacccgccacgugaacgccgagcccgagaccccgaacauggacgugaucggggagcggaucaagcgcaucaaggaggagcacagcuccaccuggcacuacgacgacgagaaccccuacaagacgugggccuaccacggcagcuacgaggucaaggccaccggguccgccagcagcaugaucaacggcguggugaagcugcucaccaagcccugggacgucgugcccauggugacccagauggcgaugacggacaccaccccguucgggcagcagcgggucuucaaggagaagguggacacccgcacgccccggcccaugcccggcacccgcaaggugauggagaucaccgccgaguggcuguggcggacccugggccgcaacaagaagccgcgccucugcacgcgggaggaguucaccaagaagguccgcaccaacgccgccaugggggccguguucaccgaggagaaccagugggacuccgcgcgggccgccguggaggacgaggaguucuggaagcuggucgaccgcgagcgggagcugcacaagcucggcaagugcgggagcugcguguacaacaugaugggcaagcgcgagaagaagcugggggaguucggcaaggccaagggcucccgggcgaucugguacauguggcugggggcccgcuaccucgaguucgaggcccugggcuuccugaacgaggaccacugguucagccgggagaacuccuacagcgggguggagggcgaggggcuccacaagcugggcuacauccugcgcgacaucuccaagauccccggcggggccauguacgccgacgacacggcgggcugggacacccggaucaccgaggacgaccuccacaacgaggagaagaucacccagcagauggaccccgagcaccgccagcuggccaacgccaucuucaagcugacguaccagaacaaggucgugaaggugcagcggcccaccccgaaggggaccgucauggacaucaucagccgcaaggaccagcggggcuccggccagguggggaccuacggccucaacaccuucacgaacauggaggcccagcuggugcgccagauggagggggagggcguccugagcaaggccgaccucgagaacccccaccuccuggagaagaagaucacccaguggcucgagaccaaggggguggagcggcugaagcgcauggcgaucuccggcgacgacugcguggucaagcccaucgacgaccgguucgccaacgcccugcucgcccugaacgacaugggcaaggugcgcaaggacaucccccaguggcagccgagcaagggguggcacgacuggcagcagguccccuucugcucccaccacuuccacgagcugaucaugaaggacggccggaagcucgucgugcccugccgcccccaggacgagcugaucgggcgcgcccggaucagccagggcgcgggguggucccugaaggagaccgccugccucggcaaggccuacgcccagauguggagccugauguacuuccaccgccgggaccugcgccucgccuccaacgcgaucugcagcgccgugccgguccacuggauccccacgucccggaccaccuggagcauccacgcccaccaccaguggaugaccacggaggacaugcugaccguguggaaccgcguguggaucgaggacaaccccuggauggaggacaagacccccgucaccacgugggaggacgugccguaccugggcaagcgggaggaccaguggugcgggagccucaucggccugaccucccgcgccaccugggcgcagaacauccugaccgccauccagcagguccggagccucaucggggacgaggaguuccuggacuacaugcccuccaugaagcgcuuccggaaggaggaggagagcgagggcgccaucugguga

SEQ ID NO: 10305 - RNA, 9873 nt, Artificial Sequence
  derived and/or modified CDS sequence (opt1) from DENV-3__EU660409__SS-prME
accagccugugccucaugaugaugcugcccgccacccuggccuuccaccucaccagccgggacggcgagccccggaugaucguggggaagaacgagcggggcaagagccugcuguucaagaccgcguccgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggacgugcaaccaggccggcgagcaccggcgggacaagcgguccgucgcccuggcgccccacgugggcauggggcuggacacccgcacccagaccuggaugagcgccgagggcgccuggcgccagguggagaaggucgagacgugggcccuccgccaccccggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccggcucgcgacgcugcgcaagcugugcaucgagggcaagaucaccaacaucaccaccgacagccggugccccacgcagggcgaggccauccucccggaggagcaggaccagaacuacgugugcaagcacaccuacgucgaccgcggguggggcaacgggugcggccuguucgggaagggcucccuggugaccugcgccaaguuccagugccucgagcugaucgagggcaaggugguccaguacgagaaccugaaguacaccgugaucaucacggugcacaccggggaccagcaccaggucggcaacgacacccagggggccaccguggagaucacgccccaggccagcaccgucgaggcggugcuccccgaguacggcacccuggggcuggagugcagcccccggaccggccucgacuucaacgagaugauccugcugaccaugaagaacaaggccuggauggugcaccgccagugguucuucgaccucccgcugcccuggacgagcggcgccaccaccgagacccccacguggaaccggaaggagcugcucgucaccuucaagaacgcccacgccaagaagcaggagguggugguccuggggucccaggagggcgcgaugcacaccgcccugaccggggccacggagauccagaacagcggcgggaccuccaucuucgccggccaccucaagugccgccugaagauggacaagcuggagcucaagggcaugagcuacgccaugugccugaacaccuucgugcugaagaaggagguguccgagacccagcacgggacgauccugaucaaggucgaguacaagggcgaggacgcgcccugcaagaucccguucagcaccgaggacgggcagggcaaggcccacaacggccggcucaucaccgccaaccccguggugaccaagaaggaggagcccgucaacaucgaggccgagcccccguucggggagagcaacaucgugaucggcaucggggacaaggcgcugaagaucaacugguacaagaagggcuccagcaucgggaagauguucgaggccacggcccgcggcgcccggcgcauggccauccugggcgacaccgcgugggacuucggguccgugggcgggguccucaacagccugggcaagauggugcaccagaucuucggguccgccuacaccgcccuguucagcggcguguccuggaucaugaagaucggcaucgggguccuccugaccuggaucggccugaacagcaagaacacguccaugagcuucuccugcaucgccaucgggaucaucacccucuaccugggcgccguggugcaggcggacauggggugcgucaucaacuggaagggcaaggagcugaagugcggcagcgggaucuucgugaccaacgaggugcacaccuggacggagcaguacaaguuccaggccgacucccccaagcgccucgccaccgccaucgccggcgcgugggagaacggggucugcggcauccggagcaccacccgcauggagaaccugcuguggaagcagaucgccaacgagcucaacuacauccugugggagaacaacaucaagcugacggugguggucggggacaucaucggcgugcucgagcagggcaagcggacccugacgccccagcccauggagcugaaguacuccuggaagaccugggggaaggccaagaucgugacggccgagacccagaacagcuccuucaucaucgacggcccgaacacccccgagugccccagcgcgucccgcgccuggaacgucugggagguggaggacuacggguucggcguguucaccacgaacaucuggcucaagcugcgggaggucuacacccagagcugcgaccaccgccugaugagcgccgccaucaaggacgagcgggccgugcacgcggacaugggcuacuggaucgagucccagaagaacgggagcuggaagcucgagaaggccuccuucaucgaggugaagaccugcaccuggcccaagagccacacccugugguccaacggcguccuggagagcgacaugaucaucccgaagucccucgccgggcccaucagccagcacaaccaccgccccggcuaccacacgcagaccgccgggccguggcaccugggcaagcuggagcucgacuucaacuacugcgagggcaccaccguggugaucacggagaacugcgggacccggggccccucccugcgcaccaccacggucagcgggaagcugauccacgaguggugcugccgguccugcacccugccgccccuccgcuacaugggcgaggacgggugcugguacggcauggagauccggccgaucaacgagaaggaggagaacauggugaagucccugguguccgccggcagcgggaaggucgacaacuucaccaugggcgcgcucugccuggccauccuguucgaggaggugaugcgcgggaaguucggcaagaagcacaugaucgccgggguccuguucaccuucguccugcugcucuccggccagaucacguggcgggacauggcccacacccugaucaugaucggcagcaacgccuccgaccgcauggggaugggcgugaccuaccuggcgcucaucgccaccuucaagauccagcccuuccuggcccugggguucuuccuccggaagcugacgagccgcgagaaccugcuccugggcgugggccuggccauggcgaccacccuccagcugcccgaggacaucgagcagauggccaacgggaucgcccugggccucaugacccugaagcugaucacgcaguucgagaccuaccagcucuggaccgcccuggucagccugaccugcuccaacacgaucuucacccucaccguggccuggcggaccgcgacgcugauccuggccggggugagccuccugccccugugccaguccagcuccaugcgcaagaccgacuggcucccgauggccgucgccgccaugggcgugccgccccugccccuguucaucuucagccucaaggacaccccgaagcgccgguccuggccccugaacgagggggucauggcggugggccuggugagcauccucgccuccagccugcugcgcaacgacguccccauggccggcccccucguggccgggggccugcugaucgccugcuacgugaucaccgggacguccgcggaccucaccgucgagaagguggccgacgugaccugggaggaggaggccgagcagaccggcgucagccacaaccugaugaucacgguggacgacgacgggaccaugcggaucaaggacgacgagaccgagaacauccugaccgugcuccugaagaccgcccugcucaucgucuccggcaucuucccguacagcauccccgccacgcugcugguguggcacaccuggcagaagcagacccagcgcuccggcgugcucugggacguccccagcccgcccgagacccagaaggcggagcuggaggaggggguguaccggaucaagcagcagggcaucuucgggaagacccaggugggcgucggggugcagaaggagggcguguuccacaccauguggcacgucacccgcggcgccgugcugacccacaacgggaagcggcucgagcccaacugggccuccgugaagaaggaccugaucagcuacggcgggggcuggcgccuguccgcccaguggcagaagggggaggagguccaggugaucgcgguggagcccggcaagaaccccaagaacuuccagacgaugcccggcaucuuccagaccaccaccggggagaucggcgccaucgcccuggacuucaagcccgggacgagcggcagccccaucaucaaccgggagggcaaggucguggggcucuacggcaacgggguggucaccaagaacggcggguacguguccggcaucgcccagaccaacgccgagccggacggccccacccccgagcuggaggaggagauguucaagaagcgcaaccugacgaucauggaccuccaccccgggagcggcaagacccggaaguaccugccggcgaucgugcgcgaggccaucaagcggcgccugcggacccucauccuggcccccacccgcgucguggccgccgagauggaggaggcgcugaaggggcuccccauccgguaccagacgaccgccaccaaguccgagcacaccggccgcgagaucguggaccugaugugccacgccacguucaccaugcggcugcucagccccguccgcgugccgaacuacaaccugaucaucauggacgaggcccacuucaccgaccccgccuccaucgcggcccggggguacaucagcacccgcgugggcaugggcgaggccgccgcgaucuucaugacggccacgccgcccgggaccgccgaggccuucccgcaguccaacgcccccauccaggacgaggagcgcgacauccccgagcggagcuggaacuccggcaacgaguggaucaccgacuucgucgggaagacggugugguucgugcccagcaucaaggcgggcaacgacaucgccaacugccugcgcaagaacgggaagaaggucauccagcucucccggaagaccuucgacaccgaguaccagaagacccgccugaacgacugggacuucguggugacgaccgacaucagcgagaugggcgccaacuucaaggccgaccgggucaucgacccgcgccggugccugaagcccgugauccucaccgacggccccgagcgcgugauccuggccgggcccaugccggucaccgcggccuccgccgcccagcggcgcggccggguggggcgcaacccccagaaggagaacgaccaguacaucuucacgggccagccccugaacaacgacgaggaccacgcccacuggaccgaggcgaagaugcuccuggacaacaucaacacccccgaggggaucaucccggcccuguucgagcccgagcgggagaaguccgccgccaucgacggcgaguaccgccucaagggcgagucccggaagaccuucguggagcugaugcgccgcggggaccugcccgucuggcucgcgcacaagguggccagcgagggcaucaaguacaccgaccgcaaguggugcuucgacggggagcggaacaaccagauccuggaggagaacauggacgucgagaucuggacgaaggagggcgagcgcaagaagcugcgcccccgguggcucgacgcccgcaccuacuccgacccgcuggcccugaaggaguucaaggacuucgccgcgggccgcaagagcaucgcccucgaccuggugaccgagaucgggcgcgugcccucccaccuggccuaccggacccgcaacgcccucgacaaccuggucaugcugcacacgagcgagcacggcgggcgggccuaccgccacgcgguggaggagcuccccgagaccauggagacccugcugcuccugggccugaugauccuccugaccgggggcgccaugcuguuccucaucagcggcaaggggaucggcaagacguccaucgggcugaucugcgugaccgucagcuccggcaugcuguggauggccgacgugccgcuccaguggaucgccagcgccaucgugcuggaguucuucaugaugguccugcucauccccgagcccgagaagcagcggacgccccaggacaaccagcuggcguacguggugaucgggauccugacccucgccgccaucgucgccgccaacgagaugggccugcuggagacgaccaagcgcgaccucggcauguccaaggagccggggguggugagccccaccuccuaccuggacgucgaccugcaccccgcgagcgccuggacccucuacgccguggccacgaccgugaucacccccaugcugcggcacaccaucgagaacuccacggcgaacgucagccuggccgccaucgccaaccaggccguggugcucaugggccuggacaagggguggccgaucuccaagauggaccugggcgucccccuccuggcgcuggggugcuacagccaggugaacccccucacccugaccgccgccgugcugcuccuggucacccacuacgccaucaucggccccggccugcaggccaaggcgacgcgcgaggcccagaagcggaccgccgccgggaucaugaagaacccgaccguggacggcaucaugaccaucgaccucgaccccgugaucuacgacuccaaguucgagaagcagcuggggcaggucaugcugcucgugcugugcgccgugcagcugcuccugaugcgcacgagcugggcgcugugcgaggcccucacccuggccaccggccccaucaccacgcugugggagggcucccccgggaaguucuggaacaccaccaucgccgucagcauggcgaacaucuuccggggcuccuaccucgccggggccggccuggccuucagcaucaugaaguccguggggaccggccgccggggcacggggagccagggcgagacccugggggagaaguggaagaagaagcucaaccagcugagccgcaaggaguucgaccuguacaagaaguccggcaucaccgagguggaccggaccgaggccaaggaggggcucaagcgcggcgagaccacgcaccacgcggucagccggggcuccgccaagcugcagugguucguggagcgcaacauggugaucccggaggggcgcgucaucgaccugggcugcgggcggggcggguggagcuacuacugcgccggccucaagaaggugaccgaggugcgcggcuacaccaagggcgggcccgggcacgaggagcccguccccauguccaccuacggcuggaacaucgugaagcugaugagcgggaaggacguguucuaccugccgcccgagaagugcgacacgcugcucugcgacaucggcgaguccagccccucccccaccgucgaggagagccggaccauccgcgugcugaagaugguggagccguggcugaagaacaaccaguucugcaucaagguccucaaccccuacaugcccaccgugaucgagcaccuggagcggcugcagcgcaaguacggcgggaugcucgugcggaacccccugucccgcaacagcacgcacgagauguacuggaucuccaacggcaccgggaacaucgucagcuccgugaacauggugagccggcugcuccugaaccgcuucaccaugacccaccggcgcccgacgaucgagaaggacgucgaccugggcgccggcacccggcacgugaacgccgagcccgagacccccaacauggacgucaucggggagcgcaucaagcggaucaaggaggagcacuccagcaccuggcacuacgacgacgagaacccguacaagacgugggcguaccacggcuccuacgaggugaaggccaccgggagcgccagcuccaugaucaacggcguggucaagcuccugaccaagcccugggacguggugcccauggucacccagauggccaugacggacaccacccccuucgggcagcagcgcguguucaaggagaagguggacacccggacgccgcgccccaugcccggcacccggaaggucauggagaucaccgccgaguggcuguggcgcacccucggccgcaacaagaagccccggcugugcacgcgcgaggaguucaccaagaaggugcggaccaacgcggccaugggggccguguucaccgaggagaaccagugggacagcgcccgcgcggccgucgaggacgaggaguucuggaagcugguggaccgggagcgcgagcuccacaagcugggcaagugcggguccugcguguacaacaugaugggcaagcgggagaagaagcugggggaguucggcaaggccaagggcagccgcgccaucugguacauguggcucggggcccgguaccuggaguucgaggcgcugggcuuccucaacgaggaccacugguucucccgcgagaacagcuacuccggggucgagggcgaggggcugcacaagcugggcuacauccuccgggacaucagcaagaucccgggcggggccauguacgccgacgacacggccggcugggacacccgcaucaccgaggacgaccugcacaacgaggagaagaucacccagcagauggaccccgagcaccggcagcuggccaacgcgaucuucaagcucacguaccagaacaagguggugaagguccagcgccccacccccaaggggaccgugauggacaucaucucccggaaggaccagcgcggcagcggccagguggggaccuacggccugaacaccuucacgaacauggaggcccagcugguccggcagauggagggggagggcgugcucuccaaggccgaccuggagaacccgcaccuccucgagaagaagaucacccaguggcuggagaccaaggggguggagcgccugaagcggauggccaucagcggcgacgacugcgucgugaagcccaucgacgaccgcuucgccaacgcgcuccuggcccugaacgacaugggcaaggugcggaaggacaucccccaguggcagcccuccaagggguggcacgacuggcagcaggucccguucugcagccaccacuuccacgagcucaucaugaaggacggccgcaagcugguggugcccugccgcccccaggacgagcugaucgggcgggcccgcaucucccagggcgccggguggagccucaaggagaccgccugccugggcaaggcguacgcccagauguggucccugauguacuuccaccggcgcgaccuccggcuggccagcaacgccaucugcuccgcgguccccgugcacuggaucccgacgagccgcaccaccuggagcauccacgcccaccaccaguggaugaccacggaggacaugcugaccguguggaaccgggucuggaucgaggacaaccccuggauggaggacaagacccccgugaccacgugggaggacgugcccuaccucggcaagcgcgaggaccaguggugcgggucccugaucggccugaccagccgggccaccugggcccagaacauccucaccgccauccagcagguccgcucccugaucggggacgaggaguuccuggacuacaugccgagcaugaagcgguuccgcaaggaggaggaguccgagggcgcgaucugguga

SEQ ID NO: 10306 - RNA, 9873 nt, Artificial Sequence
  derived and/or modified CDS sequence (opt1) from DENV-3__EU660410__SS-prME
accagccucugccucaugaugaugcugcccgccacccuggccuuccaccucacgagccgggacggcgagccgcggaugaucguggggaagaacgagcggggcaagagccugcuguucaagaccgcguccgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggacgugcaaccaggccggcgagcaccggcgggacaagcgguccguggcccuggcgccccacgugggcauggggcuggacacccgcacccagaccuggaugagcgccgagggcgccuggcgccagguggagaagguggagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggcccggaacaagcccacccuggacaucgagcugcagaagaccgaggccacccagcucgcgacgcugcgcaagcugugcaucgagggcaagaucaccaacaucaccaccgacagccggugccccacgcagggcgaggccauccucccggaggagcaggaccagaacuacgugugcaagcacaccuacgucgaccgcggguggggcaacgggugcggccuguucgggaagggcucccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccagcaccguggaggccgugcugcccgaguacggcacccucgggcuggagugcuccccgcggaccggccuggacuucaacgagaugauccuccugaccaugaagaacaaggcguggaugguccaccgccagugguucuucgaccugccccuccccuggacgagcggcgccaccaccgagacccccacguggaaccggaaggagcugcuggugaccuucaagaacgcccacgccaagaagcaggagguggucgugcucgggucccaggagggcgccaugcacaccgcgcugaccggggccacggagauccagaacagcggcgggaccuccaucuucgccggccaccugaagugccgccucaagauggacaagcuggagcugaagggcaugagcuacgccaugugccucaacaccuucgugcugaagaaggaggucuccgagacccagcacgggacgauccugaucaagguggaguacaagggcgaggacgccccgugcaagauccccuucagcaccgaggacgggcagggcaaggcgcacaacggccggcugaucaccgccaaccccguggucaccaagaaggaggagcccgugaacaucgaggccgagccgcccuucggggagagcaacaucgugaucggcaucggggacaaggcccucaagaucaacugguacaagaagggcuccagcaucgggaagauguucgaggcgacggcccgcggcgcccggcgcauggccauccugggcgacaccgccugggacuucggguccgucggcggggugcugaacagccucggcaagauggugcaccagaucuucggguccgcguacaccgcccuguucagcggcgucuccuggaucaugaagaucggcaucggggugcugcucaccuggaucggccugaacagcaagaacacguccaugagcuucuccugcaucgugaucgggaucaucacccuguaccucggcgccgucgugcaggccgacauggggugcgccaucaacuggaagggcaaggagcugaagugcggcagcgggaucuucgugaccaacgagguccacaccuggacggagcaguacaaguuccaggcggacucccccaagcgccuggccaccgccaucgccggcgccugggagaacggggugugcggcauccggagcaccacccgcauggagaaccuccuguggaagcagaucgcgaacgagcugaacuacauccucugggagaacaacaucaagcugacgguggucgugggggacaucaucggcgugcuggagcagggcaagcggacccucacgccccagccgauggagcugaaguacuccuggaagaccugggggaaggccaagaucgucacggccgagacccagaacagcuccuucaucaucgacggccccaacacccccgagugccccagcgccucccgcgcguggaacgugugggagguggaggacuacggguucggcgucuucaccacgaacaucuggcugaagcuccgggagguguacacccagagcugcgaccaccgccugaugagcgccgccaucaaggacgagcgggccgugcacgccgacaugggcuacuggaucgagucccagaagaacgggagcuggaagcuggagaaggcguccuucaucgaggucaagaccugcaccuggcccaagagccacacccucugguccaacggcgugcuggagagcgacaugaucauccccaagucccuggccgggcccaucagccagcacaaccaccgcccgggcuaccacacgcagaccgccgggcccuggcaccucggcaagcuggagcuggacuucaacuacugcgagggcaccaccguggucaucacggagaacugcgggacccggggccccucccuccgcaccaccacggugagcgggaagcugauccacgaguggugcugccgguccugcacccugcccccgcuccgcuacaugggcgaggacgggugcugguacggcauggagauccggcccaucaacgagaaggaggagaacauggucaagagccuggucuccgccggcagcgggaagguggacaacuucaccaugggcgugcugugccucgccauccuguucgaggaggucaugcgcgggaaguucggcaagaagcacaugaucgcgggggugcuguucaccuucgugcuccugcuguccggccagaucacguggcgggacauggcccacaccuucaucaugaucggcagcaacgccuccgaccgcauggggaugggcgucaccuaccucgcccugaucgccaccuucaagauccagcccuuccuggcgcucggguucuuccugcggaagcugacgagccgcgagaaccuccugcugggcgugggccucgccauggccaccacccugcagcugcccgaggacaucgagcagauggccaacgggaucgcgcucggccugaugacccugaagcucaucacgcaguucgagaccuaccagcuguggaccgcccuggugagccugaccugcuccaacacgaucuucacccugaccgucgccuggcggaccgccacgcuggugcucgccggggucagccugcugccgcucugccaguccagcuccaugcgcaagaccgacuggcugcccaugaccguggcggccaugggcgugccgccccucccccucuucaucuucagccugaaggacacccccaagcgccgguccuggccccugaacgagggggucauggccgugggccucgugagcauccuggccuccagccugcuccgcaacgacguccccauggccggcccgcugguggccggcgggcugcucaucgccugcuacgugaucacggggaccuccgccgaccugaccgucgagaaggccgccgacgugaccugggaggaggaggcggagcagacgggggugagccacaaccugaugaucaccgucgacgacgacgggaccaugcggaucaaggacgacgagaccgagaacauccucaccgugcugcugaagacggcccuccugaucguguccggcaucuuccccuacagcauccccgccacccugcucgucuggcacaccuggcagaagcagacccagcgcuccggcgugcugugggacgugcccagcccgcccgagacgcagaaggccgagcuggaggagggggucuaccggaucaagcagcagggcaucuucgggaagacccaggugggcguggggguccagaaggagggcguguuccacaccauguggcacgugacccgcggcgccguccucacgcacaacgggaagcggcuggagcccaacugggcguccgugaagaaggaccugaucagcuacggcgggggcuggcgccucuccgcccaguggcagaagggggaggaggugcaggucaucgccguggagcccggcaagaacccgaagaacuuccagaccaugcccggcaucuuccagaccaccacgggggagaucggcgccaucgcgcuggacuucaagcccgggaccagcggcagcccgaucaucaaccgggagggcaagguggucgggcuguacggcaacgggguggugaccaagaacggcggguacgucuccggcaucgcccagaccaacgccgagcccgacggccccacgcccgagcuggaggaggagauguucaagaagcgcaaccucaccaucauggaccugcacccggggagcggcaagacccggaaguaccugcccgccaucgugcgcgaggccaucaagcggcgccuccggacccugauccuggcgcccacgcgcguggucgccgccgagauggaggaggcccucaaggggcugcccauccgguaccagaccaccgccaccaaguccgagcacacgggccgcgagaucguggaccugaugugccacgcgaccuucaccaugcggcuccugagcccggugcgcguccccaacuacaaccugaucaucauggacgaggcccacuucaccgaccccgccuccaucgccgcccggggguacaucagcacgcgcgugggcaugggcgaggcggccgccaucuucaugaccgccacgcccccggggaccgcggaggccuucccccaguccaacgcccccauccaggacgaggagcgcgacauccccgagcggagcuggaacuccggcaacgaguggaucacggacuucguggggaagaccgucugguucgugccgagcaucaaggccggcaacgacaucgccaacugccuccgcaagaacgggaagaaggugauccagcugucccggaagaccuucgacaccgaguaccagaagacgcgccugaacgacugggacuucgucgugaccaccgacaucagcgagaugggcgcgaacuucaaggccgaccgggugaucgacccccgccggugccucaagcccgucauccugaccgacggccccgagcgcgugauccuggccgggccgaugcccgugacggccgccuccgcggcccagcggcgcggccgggucgggcgcaacccccagaaggagaacgaccaguacaucuucaccggccagccccucaacaacgacgaggaccacgcccacuggaccgaggccaagaugcugcuggacaacaucaacaccccggaggggaucauccccgcccucuucgagcccgagcgggagaaguccgcggccaucgacggcgaguaccgccugaagggcgagucccggaagaccuucguggagcugaugcgccgcggggaccuccccgucuggcuggcccacaagguggccagcgagggcaucaaguacacggaccgcaaguggugcuucgacggggagcggaacaaccagauccuggaggagaacauggacguggagaucuggaccaaggagggcgagcgcaagaagcuccgcccgcgguggcuggacgcgcgcaccuacuccgacccccuggcccucaaggaguucaaggacuucgccgccggccgcaagagcaucgcccuggaccuggucaccgagaucgggcgcgugcccucccaccucgcguaccggacgcgcaacgcccuggacaaccuggugaugcuccacaccagcgagcacggcgggcgggccuaccgccacgccgucgaggagcugccggagaccauggagacccugcuccugcugggccucaugauccugcugaccggcggggccaugcuguuccugaucagcgggaaggggaucggcaagaccuccaucgggcugaucugcgugaucgugagcuccggcaugcucuggauggcggacgucccccugcaguggaucgccagcgccaucgugcuggaguucuucaugauggugcuccugauccccgagcccgagaagcagcggaccccgcaggacaaccagcuggccuacgucgugaucgggauccucacccuggccgcgaucguggccgccaacgagaugggccugcucgagacgaccaagcgcgaccugggcauguccaaggagcccggggucgugagccccaccuccuaccuggacguggaccuccaccccgccagcgccuggacccuguacgcggucgccacgaccgugaucaccccgaugcugcggcacaccaucgagaacuccacggccaacgugagccucgccgcgaucgccaaccaggccgucgugcugaugggccuggacaagggguggcccaucuccaagauggaccucggcgcgccccuccuggcccucgggugcuacagccaggugaacccccugacccugaccgcggccguccuccugcuggugacccacuacgccaucaucggcccgggccuccaggccaaggccacgcgcgaggcgcagaagcggaccgccgccgggaucaugaagaaccccaccguggacggcaucaugaccaucgaccuggaccccgucaucuacgacuccaaguucgagaagcagcugggccaggugaugcuccuggugcugugcgccguccagcuccugcugaugcgcacgagcugggcccucugcgaggcgcugacccuggccaccggccccaucaccacgcucugggagggcuccccggggaaguucuggaacaccaccaucgccgugagcauggccaacaucuuccggggcuccuaccuggcgggggccggccuggccuucagcaucaugaaguccguggggaccggccgccggggcacggggagccagggcgagacccucggggagaaguggaagaagaagcugaaccagcugagccgcaaggaguucgaccucuacaagaaguccggcaucaccgaggucgaccggaccgaggccaaggaggggcugaagcgcggcgagaccacgcaccacgccgugagccggggcuccgcgaagcugcagugguucguggagcgcaacauggucauccccgaggggcgcgugaucgaccucggcugcgggcggggcggguggagcuacuacugcgccggccugaagaaggugaccgagguccgcggcuacaccaagggcggccccgggcacgaggagcccgugccgauguccaccuacggcuggaacaucgugaagcugaugagcgggaaggacgucuucuaccugccgcccgagaagugcgacacgcugcugugcgacaucggcgaguccagccccuccccgaccguggaggagagccggaccauccgcgugcugaagauggucgagcccuggcucaagaacaaccaguucugcaucaaggugcugaaccccuacaugcccaccgugaucgagcaccuggagcggcuccagcgcaaguacggcgggaugcugguccggaacccgcugucccgcaacagcacgcacgagauguacuggaucuccaacggcaccgggaacaucgugagcuccgugaacauggucagccggcuccugcugaaccgcuucaccaugacccaccggcgccccacgaucgagaaggacguggaccucggcgccggcacccggcacgucaacgccgagcccgagaccccgaacauggacgugaucggggagcgcaucaagcggaucaaggaggagcacuccagcaccuggcacuacgacgacgagaaccccuacaagacgugggccuaccacggcuccuacgaggugaaggcgaccgggagcgccagcuccaugaucaacggcgucgugaagcugcugaccaagcccugggacgugguccccauggugacccagauggccaugacggacaccaccccguucgggcagcagcgcguguucaaggagaaggucgacacccggacgccccgccccaugcccggcacccggaaggugauggagaucaccgccgaguggcucuggcgcacccugggccgcaacaagaagccgcggcugugcacgcgcgaggaguucaccaagaaggugcggaccaacgccgcgaugggggccgucuucaccgaggagaaccagugggacagcgcccgcgccgcgguggaggacgaggaguucuggaagcucguggaccgggagcgcgagcugcacaagcugggcaagugcggguccugcgucuacaacaugaugggcaagcgggagaagaagcucggggaguucggcaaggccaagggcagccgcgccaucugguacauguggcugggggcccgguaccuggaguucgaggcccucggcuuccugaacgaggaccacugguucucccgcgagaacagcuacuccgggguggagggcgaggggcugcacaagcucggcuacauccugcgggacaucagcaagauccccggcggggcgauguacgccgacgacacggccggcugggacacccgcaucaccgaggacgaccugcacaacgaggagaagaucacccagcagauggaccccgagcaccggcagcucgccaacgccaucuucaagcugacguaccagaacaagguggucaaggugcagcgccccaccccgaaggggaccgugauggacaucaucucccggaaggaccagcgcggcagcggccaggucgggaccuacggccugaacaccuucacgaacauggaggcgcagcucgugcggcagauggagggggagggcgugcuguccaaggccgaccuggagaacccccaccuccuggagaagaagaucacccaguggcuggagaccaagggggucgagcgccucaagcggauggccaucagcggcgacgacugcguggugaagcccaucgacgaccgcuucgccaacgcccugcuggcgcucaacgacaugggcaagguccggaaggacaucccccaguggcagccguccaagggguggcacgacuggcagcagguccccuucugcagccaccacuuccacgagcugaucaugaaggacggccgcaagcuggugguccccugccgcccccaggacgagcucaucgggcgggcccgcaucucccagggcgccggguggagccugaaggagaccgccugccugggcaaggccuacgcgcagauguggucccucauguacuuccaccggcgcgaccugcggcuggccagcaacgccaucugcuccgccgugccggugcacuggauccccaucagccgcacgaccuggagcauccacgcgcaccaccaguggaugaccaccgaggacaugcucacggucuggaaccggguguggaucgaggacaaccccuggauggaggacaagacccccgugaccaccugggaggacgucccguaccugggcaagcgcgaggaccaguggugcgggucccugaucggccucacgagccgggccaccugggcccagaacauccugaccgccauccagcagguccgcucccugaucggggacgaggaguuccucgacuacaugcccagcaugaagcgguuccgcaaggaggaggaguccgagggcgccaucugguga

SEQ ID NO: 10307 - RNA, 9873 nt, Artificial Sequence
  derived and/or modified CDS sequence (opt1) from DENV-3__EU660411__SS-prME
accagccugugccucaugaugaugcugcccgccacccuggccuuccaccucaccagccgggacggggagccgcggaugaucguggggaagaacgagcgcggcaagagccugcuguucaagaccgcguccgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgugugcaagcacaccuacgucgaccggggguggggcaacgggugcggccuguucgggaagggcucccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccagcaccguggaggccgugcugcccgaguacggcacccucgggcuggagugcuccccgcgcaccggccuggacuucaacgagaugauccuccugaccaugaagaacaaggcguggaugguccaccggcagugguucuucgaccugccccuccccuggacgagcggcgccaccaccgagacccccacguggaaccgcaaggagcugcuggugaccuucaagaacgcccacgccaagaagcaggagguggucgugcucgggucccaggagggcgccaugcacaccgcgcugaccggggccacggagauccagaacagcggcgggaccuccaucuucgccggccaccugaagugccggcucaagauggacaagcuggagcugaagggcaugagcuacgccaugugccucaacaccuucgugcugaagaaggaggucuccgagacccagcacgggacgauccugaucaagguggaguacaagggcgaggacgccccgugcaagauccccuucagcaccgaggacgggcagggcaaggcgcacaacggccgccugaucaccgccaaccccguggucaccaagaaggaggagcccgugaacaucgaggccgagccgcccuucggggagagcaacaucgugaucggcaucggggacaaggcccucaagaucaacugguacaagaagggcuccagcaucgggaagauguucgaggcgacggcccggggcgcccgccggauggccauccugggcgacaccgccugggacuucggguccgucggcggggugcugaacagccucggcaagauggugcaccagaucuucggguccgcguacaccgcccuguucagcggcgucuccuggaucaugaagaucggcaucggggugcugcucaccuggaucggccugaacagcaagaacacguccaugagcuucuccugcaucgugaucgggaucaucacccuguaccucggcgccgucgugcaggccgacauggggugcgugaucaacuggaagggcaaggagcugaagugcggcagcgggaucuucgucaccaacgaggugcacaccuggacggagcaguacaaguuccaggccgacucccccaagcgccuggcgaccgccaucgccggcgccugggagaacggggugugcggcauccgcagcaccacccggauggagaaccuccuguggaagcagaucgccaacgagcugaacuacauccucugggagaacaacaucaagcugacggucguggugggggacaucaucggcguccuggagcagggcaagcgcacccucacgccccagccgauggagcugaaguacuccuggaagaccugggggaaggcgaagaucgugacggccgagacccagaacagcuccuucaucaucgacggccccaacacccccgagugccccagcgccucccgggccuggaacgugugggaggucgaggacuacggguucggcguguucaccacgaacaucuggcugaagcuccgcgagguguacacccagagcugcgaccaccggcugaugagcgcggccaucaaggacgagcgcgccguccacgccgacaugggcuacuggaucgagucccagaagaacgggagcuggaagcuggagaaggccuccuucaucgaggugaagaccugcaccuggcccaagagccacacccucugguccaacggcgugcuggagagcgacaugaucauccccaagucccuggcggggcccaucagccagcacaaccaccggccgggcuaccacacgcagaccgccgggcccuggcaccucggcaagcuggagcuggacuucaacuacugcgagggcaccaccgucgugaucacggagaacugcgggacccgcggccccucccuccggaccaccacggugagcgggaagcugauccacgaguggugcugccgcuccugcacccugcccccgcuccgguacaugggcgaggacgggugcugguacggcauggagauccgccccaucaacgagaaggaggagaacauggucaagagccugguguccgccggcagcgggaagguggacaacuucaccaugggcguccugugccucgccauccuguucgaggaggugaugcgggggaaguucggcaagaagcacaugaucgccggggugcuguucaccuucguccuccugcuguccggccagaucacguggcgcgacauggcgcacacccucaucaugaucggcagcaacgccuccgaccggauggggaugggcgugaccuaccuggcccugaucgccaccuucaagauccagcccuuccucgcccugggguucuuccugcgcaagcucacgagccgggagaaccugcugcucggcgugggccuggcgauggccaccacccugcagcuccccgaggacaucgagcagauggccaacgggaucgcccugggccugaugacccucaagcugaucacgcaguucgagaccuaccagcuguggaccgcgcucgucagccugaccugcuccaacacgaucuucacccugaccguggccuggcgcaccgccacgcucauccuggccggggucagccugcucccgcugugccaguccagcuccaugcggaagaccgacuggcugcccaugaccguggccgcgaugggcgugccgccccugccgcuguucaucuucagccugaaggacacccccaagcgccgcuccuggccccucaacgagggggucauggccgugggccuggugagcauccuggccuccagccuccugcggaacgacguccccauggccggcccgcugguggccgggggccuccugaucgcgugcuacgugaucacggggaccuccgccgaccugaccgucgagaaggccgccgacgugaccugggaggaggaggccgagcagacgggcgugagccacaaccucaugaucaccgucgacgacgacgggaccaugcgcaucaaggacgacgagaccgagaacauccugaccgugcugcucaagacggcgcugcugaucguguccggcaucuuccccuacagcauccccgccacccuccuggucuggcacaccuggcagaagcagacccagcgguccggcgugcugugggacgugcccagcccgcccgagacgcagaaggccgagcucgaggagggggucuaccgcaucaagcagcagggcaucuucgggaagacccaggugggcguggggguccagaaggagggcguguuccacaccauguggcacgugacccggggcgccguccugacgcacaacgggaagcgccuggagcccaacugggccuccgugaagaaggaccucaucagcuacggcgggggcuggcggcuguccgcgcaguggcagaagggggaggaggugcaggucaucgccguggagcccggcaagaacccgaagaacuuccagaccaugcccggcaucuuccagaccaccacgggggagaucggcgccaucgcccuggacuucaagcccgggaccagcggcagcccgaucaucaaccgcgagggcaagaucguggggcuguacggcaacggggucgugaccaagaacggcggguacguguccggcaucgcgcagaccaacgccgagcccgacggccccacgcccgagcucgaggaggagauguucaagaagcggaaccugaccaucauggaccugcacccggggagcggcaagacccgcaaguaccuccccgccaucguccgggaggccaucaagcgccggcugcgcacccugauccucgcccccacgcgggugguggcggccgagauggaggaggcccugaaggggcugcccauccgcuaccagaccaccgccaucaaguccgagcacaccggccgggagaucgucgaccucaugugccacgccacguucaccaugcgccugcugagcccggugcgggugcccaacuacaaccucaucaucauggacgaggcgcacuucaccgaccccgccuccaucgccgcccgcggguacaucagcacccgggucggcaugggcgaggccgcggccaucuucaugacggccacgccgcccgggaccgccgaggcguucccccaguccaacgcccccauccaggacgaggagcgcgacauccccgagcgcagcuggaacuccggcaacgaguggaucaccgacuucguggggaagacggugugguucguccccagcaucaaggccggcaacgacaucgccaacugccugcggaagaacgggaagaaggugauccagcugucccgcaagaccuucgacaccgaguaccagaagacccggcucaacgacugggacuucguggucacgaccgacaucagcgagaugggcgccaacuucaaggcggaccgcgugaucgacccccggcgcugccugaagcccgugauccugaccgacggccccgagcgggucauccucgccgggccgaugcccgugaccgccgccuccgccgcgcagcgccggggccgcguggggcggaacccccagaaggagaacgaccaguacaucuucacgggccagccccugaacaacgacgaggaccacgcccacuggaccgaggccaagaugcugcucgacaacaucaacaccccggaggggaucauccccgcccuguucgagcccgagcgcgagaaguccgccgcgaucgacggcgaguaccggcugaagggcgagucccgcaagaccuucgucgagcucaugcggcgcggggaccugcccguguggcuggcccacaaggucgccagcgagggcaucaaguacaccgaccggaaguggugcuucgacggggagcgcaacaaccagauccucgaggagaacauggacguggagaucuggacgaaggagggcgagcggaagaagcugcgcccgcgcuggcuggacgcccggaccuacuccgacccccucgcgcugaaggaguucaaggacuucgccgccggccgcaagagcaucgcccuggaccucgugaccgagaucgggcggguccccucccaccuggccuaccgcacccggaacgcgcuggacaaccucgugaugcugcacacgagcgagcacggcgggcgcgccuaccggcacgccguggaggagcugccggagaccauggagacccuccugcugcucggccugaugauccugcucaccgggggcgccaugcuguuccugaucagcggcaaggggaucggcaagacguccaucgggcucaucugcgucaucgugagcuccggcaugcuguggauggccgacgugccccugcaguggaucgcgagcgccaucguccucgaguucuucaugauggugcugcugauccccgagcccgagaagcagcgcaccccgcaggacaaccagcucgccuacguggucaucgggauccugacccuggccgccaucguggcggccaacgagaugggccuccuggagaccacgaagcgggaccugggcauguccaaggagcccgggguggucagccccaccuccuaccucgacguggaccugcaccccgccagcgccuggacccuguacgccguggcgaccacggucaucaccccgaugcuccgccacaccaucgagaacuccaccgccaacgugagccuggccgccaucgcgaaccaggccgugguccugaugggccucgacaagggguggcccaucuccaagauggaccugggcgugccccugcucgcccuggggugcuacagccaggugaacccccugacgcucaccgccgccguccugcugcucgugacccacuacgcgaucaucggcccgggccugcaggccaaggccacccgggaggcccagaagcgcacggccgcggggaucaugaagaaccccaccguggacggcaucaugaccaucgaccuggaccccgucaucuacgacuccaaguucgagaagcagcucggccaggugaugcugcuggugcucugcgccguccagcugcugcucaugcggaccagcugggcccugugcgaggcccugacgcucgccaccggccccaucaccacccugugggagggcuccccggggaaguucuggaacacgaccaucgcggugagcauggccaacaucuuccgcggcuccuaccuggccggggccggccucgcguucagcaucaugaaguccguggggaccggccggcgcggcaccgggagccagggcgagacgcugggggagaaguggaagaagaagcugaaccagcucagccggaaggaguucgaccuguacaagaaguccggcaucaccgaggucgaccgcaccgaggccaaggaggggcugaagcggggcgagaccacccaccacgccgugagccgcggcuccgccaagcuccagugguucguggagcggaacauggucauccccgaggggcgcgugaucgaccugggcugcgggcgcggcggguggagcuacuacugcgccggccugaagaaggugacggagguccggggcuacaccaagggcgggcccgggcacgaggagcccgugccgauguccaccuacggcuggaacaucgugaagcucaugagcgggaaggacgucuucuaccugccgcccgagaagugcgacacccugcugugcgacaucggcgaguccagccccuccccgacgguggaggagagccgcaccauccgggugcucaagauggucgagcccuggcugaagaacaaccaguucugcaucaaggugcugaaccccuacaugcccaccgugaucgagcaccucgagcgccugcagcggaaguacggcgggaugcugguccgcaacccgcucucccggaacagcacccacgagauguacuggaucuccaacggcacggggaacaucgugagcuccgugaacauggucagccgccugcugcucaaccgguucaccaugacccaccgccggcccaccaucgagaaggacguggaccugggcgcgggcacgcgccacgucaacgccgagcccgagaccccgaacauggacgugaucggggagcggaucaagcgcaucaaggaggagcacuccagcaccuggcacuacgacgacgagaaccccuacaagaccugggccuaccacggcuccuacgaggugaaggccacggggagcgccagcuccaugaucaacggcgucgugaagcugcucaccaagcccugggacgugguccccauggugacccagauggcgaugaccgacacgaccccguucgggcagcagcggguguucaaggagaaggucgacacccgcacgccccggcccaugcccggcacgcgcaaggugauggagaucaccgccgaguggcuguggcggacccugggccgcaacaagaagccgcgccucugcacccgggaggaguucacgaagaaggugcgcaccaacgccgccaugggggccgucuucaccgaggagaaccagugggacagcgcgcgggccgccguggaggacgaggaguucuggaagcugguggaccgcgagcgggagcugcacaagcucggcaagugcggguccugcgucuacaacaugaugggcaagcgcgagaagaagcugggggaguucggcaaggccaagggcagccgggcgaucugguacauguggcugggggcccgcuaccucgaguucgaggcccugggcuuccugaacgaggaccacugguucucccgggagaacagcuacuccgggguggagggcgaggggcuccacaagcugggcuacauccugcgcgacaucagcaagauccccggcggggccauguacgccgacgacaccgcgggcugggacacgcggaucaccgaggacgaccuccacaacgaggagaagaucacccagcagauggaccccgagcaccgccagcuggccaacgccaucuucaagcugaccuaccagaacaagguggucaaggugcagcggcccacgccgaaggggaccgugauggacaucaucucccgcaaggaccagcggggcagcggccaggucgggaccuacggccucaacaccuucaccaacauggaggcccagcuggugcgccagauggagggggagggcgugcuguccaaggccgaccucgagaacccccaccuccuggagaagaagaucacgcaguggcucgagaccaagggggucgagcggcugaagcgcauggcgaucagcggcgacgacugcguggugaagcccaucgacgaccgguucgccaacgcccugcucgcccugaacgacaugggcaagguccgcaaggacaucccccaguggcagccguccaagggguggcacgacuggcagcagguccccuucugcagccaccacuuccacgagcugaucaugaaggacggccggaagcucgugguccccugccgcccccaggacgagcugaucgggcgcgcccggaucucccagggcgcgggguggagccugaaggagaccgccugccucggcaaggccuacgcccagauguggucccugauguacuuccaccgccgggaccugcgccucgccagcaacgcgaucugcuccgccgugccggugcacuggauccccaccagccggacgaccuggagcauccacgcccaccaccaguggaugaccaccgaggacaugcugacggucuggaaccgcguguggaucgaggacaaccccuggauggaggacaagacccccgugaccaccugggaggacgucccguaccugggcaagcgggaggaccaguggugcgggucccucaucggccugacgagccgcgccaccugggcgcagaacauccugaccgccauccagcagguccggucccucaucggggacgaggaguuccuggacuacaugcccagcaugaagcgcuuccggaaggaggaggaguccgagggcgccaucugguga

SEQ ID NO: 10308 - RNA, 9873 nt, Artificial Sequence
  derived and/or modified CDS sequence (opt1) from DENV-3__FJ432722__SS-prME
accagccugugccucaugaugaugcugcccgccacccuggccuuccaccucaccagccgggacggcgagccgcggaugaucguggggaagaacgagcggggcaagagccugcuguucaagaccgcguccgggaucaacaugugcacccucaucgccauggaccugggcgagaugugcgacgacaccgugacguacaagugcccccugaucgccgagguggagcccgaggacaucgacugcuggugcaaccucaccagcaccugggugaccuacgggacgugcaaccaggccggcgagcaccggcgggacaagcgguccguggcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgugugcaagcacaccuacgucgaccggggguggggcaacgggugcggccuguucgggaagggcucccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccagcaccguggaggccgugcugcccgaguacggcacccucgggcuggagugcuccccgcgcaccggccuggacuucaacgagaugauccuccugaccaugaagaacaaggcguggaugguccaccggcagugguucuucgaccugccccuccccuggacgagcggcgccaccaccgagacccccacguggaaccgcaaggagcugcuggugaccuucaagaacgcccacgccaagaagcaggagguggucgugcucgggucccaggagggcgccaugcacaccgcgcugaccggggccacggagauccagaacagcggcgggaccuccaucuucgccggccaccugaagugccggcucaagauggacaagcuggagcugaagggcaugagcuacgccaugugccucaacaccuucgugcugaagaaggaggucuccgagacccagcacgggacgauccugaucaagguggaguacaagggcgaggacgccccgugcaagauccccuucagcaccgaggacgggcagggcaaggcgcacaacggccgccugaucaccgccaaccccguggucaccaagaaggaggagcccgugaacaucgaggccgagccgcccuucggggagagcaacaucgugaucggcaucggggacaaggcccucaagaucaacugguacaagaagggcuccagcaucgggaagauguucgaggcgacggcccggggcgcccgccggauggccauccugggcgacaccgccugggacuucggguccgucggcggggugcugaacagccucggcaagauggugcaccagaucuucggguccgcguacaccgcccuguucagcggcgucuccuggaucaugaagaucggcaucggggugcugcucaccuggaucggccugaacagcaagaacacguccaugagcuucuccugcaucgugaucgggaucaucacccuguaccucggcgccgucgugcaggccgacauggggugcgugaucaacuggaagggcaaggagcugaagugcggcagcgggaucuucgucaccaacgaggugcacaccuggacggagcaguacaaguuccaggccgacucccccaagcgccuggcgaccgccaucgccggcgccugggagaacggggugugcggcauccgcagcaccacccggauggagaaccuccuguggaagcagaucgccaacgagcugaacuacauccucugggagaacaacaucaagcugacggucguggugggggacaucaucggcguccuggagcagggcaagcgcacccucacgccccagccgauggagcugaaguacuccuggaagaccugggggaaggcgaagaucgugacggccgagacccagaacagcuccuucaucaucgacggccccaacacccccgagugccccagcgccucccgggccuggaacgugugggaggucgaggacuacggguucggcguguucaccacgaacaucuggcugaagcuccgcgagguguacacccagagcugcgaccaccggcugaugagcgcggccaucaaggacgagcgcgccguccacgccgacaugggcuacuggaucgagucccagaagaacgggagcuggaagcuggagaaggccuccuucaucgaggugaagaccugcaccuggcccaagagccacacccucugguccaacggcgugcuggagagcgacaugaucauccccaagucccuggcggggcccaucagccagcacaaccaccggccgggcuaccacacgcagaccgccgggcccuggcaccucggcaagcuggagcuggacuucaacuacugcgagggcaccaccgucgugaucacggagaacugcgggacccgcggccccucccuccggaccaccacggugagcgggaagcugauccacgaguggugcugccgcuccugcacccugcccccgcuccgguacaugggcgaggacgggugcugguacggcauggagauccgccccaucaacgagaaggaggagaacauggucaagagccugguguccgccggcagcgggaagguggacaacuucaccaugggcguccugugccucgccauccuguucgaggaggugaugcgggggaaguucggcaagaagcacaugaucgccggggugcuguucaccuucguccuccugcuguccggccagaucacguggcgcgacauggcgcacacccucaucaugaucggcagcaacgccuccgaccggauggggaugggcgugaccuaccuggcccugaucgccaccuucaagauccagcccuuccucgcccugggguucuuccugcgcaagcucacgagccgggagaaccugcugcucggcgugggccuggcgauggccaccacccugcagcuccccgaggacaucgagcagauggccaacgggaucgcccugggccugaugacccucaagcugaucacgcaguucgagaccuaccagcuguggaccgcgcucgucagccugaccugcuccaacacgaucuucacccugaccguggccuggcgcaccgccacgcucauccuggccggggucagccugcucccgcugugccaguccagcuccaugcggaagaccgacuggcugcccaugaccguggccgcgaugggcgugccgccccugccgcuguucaucuucagccugaaggacacccccaagcgccgcuccuggccccucaacgagggggucauggccgugggccuggugagcauccuggccuccagccuccugcggaacgacguccccauggccggcccgcugguggccgggggccuccugaucgcgugcuacgugaucacggggaccuccgccgaccugaccgucgagaaggccgccgacgugaccugggaggaggaggccgagcagacgggcgugagccacaaccucaugaucaccgucgacgacgacgggaccaugcgcaucaaggacgacgagaccgagaacauccugaccgugcugcucaagacggcgcugcugaucguguccggcaucuuccccuacagcauccccgccacccuccuggucuggcacaccuggcagaagcagacccagcgguccggcgugcugugggacgugcccagcccgcccgagacgcagaaggccgagcucgaggagggggucuaccgcaucaagcagcagggcaucuucgggaagacccaggugggcguggggguccagaaggagggcguguuccacaccauguggcacgugacccggggcgccguccugacgcacaacgggaagcgccuggagcccaacugggccuccgugaagaaggaccucaucagcuacggcgggggcuggcggcuguccgcgcaguggcagaagggggaggaggugcaggucaucgccguggagcccggcaagaacccgaagaacuuccagaccaugcccggcaucuuccagaccaccacgggggagaucggcgccaucgcccuggacuucaagcccgggaccagcggcagcccgaucaucaaccgcgagggcaagguggucgggcuguacggcaacgggguggugaccaagaacggcggguacgucuccggcaucgcgcagaccaacgccgagcccgacggccccacgcccgagcucgaggaggagauguucaagaagcggaaccugaccaucauggaccugcacccggggagcggcaagacccgcaaguaccuccccgccaucgugcgggaggccaucaagcgccggcugcgcacccugauccucgcccccacgcggguggucgcggccgagauggaggaggcccugaaggggcugcccauccgcuaccagaccaccgccaccaaguccgagcacacgggccgggagaucguggaccucaugugccacgccaccuucaccaugcgccugcugagcccggugcggguccccaacuacaaccucaucaucauggacgaggcgcacuucaccgaccccgccuccaucgccgcccgcggguacaucagcacgcgggugggcaugggcgaggccgcggccaucuucaugaccgccacgccgcccgggaccgccgaggcguucccccaguccaacgcccccauccaggacgaggagcgcgacauccccgagcgcagcuggaacuccggcaacgaguggaucacggacuucguggggaagaccgucugguucgugcccagcaucaaggccggcaacgacaucgccaacugccugcggaagaacgggaagaaggugauccagcugucccgcaagaccuucgacaccgaguaccagaagacgaagcucaacgacugggacuucgucgugaccaccgacaucagcgagaugggcgccaacuucaaggcggaccgggugaucgacccccgccggugccugaagcccgucauccugaccgacggccccgagcgcgugauccucgccgggccgaugcccgugacggccgccuccgccgcgcagcggcgcggccgggucgggcgcaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgggagaaguccgccgcgaucgacggcgaguaccgccugaagggcgagucccggaagaccuucguggagcucaugcgccgcggggaccugcccgucuggcuggcccacaagguggccagcgagggcaucaaguacacggaccgcaaguggugcuucgacggggagcggaacaaccagauccucgaggagaacauggacguggagaucuggaccaaggagggcgagcgcaagaagcugcggccgcgcuggcuggacgcccgcaccuacuccgacccccucgcgcugaaggaguucaaggacuucgccgccggccgcaagagcaucgcccuggaccucgucaccgagaucgggcgcgugcccucccaccuggccuaccggacgcgcaacgcgcuggacaaccucgugaugcugcacaccagcgagcacggcgggcgggccuaccgccacgccgucgaggagcugccggagaccauggagacccuccugcugcucggccugaugauccugcucaccggcggggccaugcuguuccugaucagcgggaaggggaucggcaagaccuccaucgggcucaucugcgugaucgugagcuccggcaugcuguggauggccgacgucccccugcaguggaucgcgagcgccaucgugcucgaguucuucaugauggugcugcugauccccgagcccgagaagcagcggaccccgcaggacaaccagcucgccuacgucgugaucgggauccugacccuggccgccaucguggcggccaacgagaugggccuccuggagacgaccaagcgcgaccugggcauguccaaggagcccggggucgugagccccaccuccuaccucgacguggaccugcaccccgccagcgccuggacccuguacgccgucgcgacgaccgugaucaccccgaugcuccggcacaccaucgagaacuccacggccaacgugagccuggccgccaucgcgaaccaggccgucgugcugaugggccucgacaagggguggcccaucuccaagauggaccugggcgugccccugcucgcccuggggugcuacagccaggucaacccccugacccucaccgccgccgugcugcugcucgugacccacuacgcgaucaucggcccgggccugcaggccaaggccacgcgcgaggcccagaagcggaccgccgcggggaucaugaagaaccccaccgucgacggcaucaugaccaucgaccuggaccccgugaucuacgacuccaaguucgagaagcagcucggccaggugaugcugcugguccucugcgccgugcagcugcugcucaugcgcacgagcugggcccugugcgaggcccugacccucgccaccggccccaucaccacgcugugggagggcuccccggggaaguucuggaacaccaccaucgcggugagcauggccaacaucuuccggggcuccuaccuggccggggccggccucgcguucagcaucaugaaguccgucgggaccggccgccggggcacggggagccagggcgagacccugggggagaaguggaagaagaagcugaaccagcucagccgcaaggaguucgaccuguacaagaaguccggcaucaccgagguggaccggaccgaggccaaggaggggcugaagcgcggcgagaccacgcaccacgccgugagccggggcuccgccaagcuccagugguucgucgagcgcaacauggugauccccgaggggcgggugaucgaccugggcugcgggcgcggcggguggagcuacuacugcgccggccugaagaaggucaccgaggugcgcggcuacaccaagggcgggcccgggcacgaggagcccgugccgauguccaccuacggcuggaacaucgucaagcucaugagcgggaaggacguguucuaccugccgcccgagaagugcgacacgcugcugugcgacaucggcgaguccagccccuccccgaccguggaggagagccggaccauccgcguccucaagaugguggagcccuggcugaagaacaaccaguucugcaucaaggugcugaaccccuacaugcccaccgucaucgagcaccucgagcggcugcagcgcaaguacggcgggaugcuggugcggaacccgcucucccgcaacagcacgcacgagauguacuggaucuccaacggcaccgggaacaucgugagcuccgucaacauggugagccggcugcugcucaaccgcuucaccaugacccaccggcgccccacgaucgagaaggacgucgaccugggcgcgggcacccggcacgugaacgccgagcccgagaccccgaacauggacgugaucggggagcgcaucaagcggaucaaggaggagcacuccagcaccuggcacuacgacgacgagaaccccuacaagacgugggccuaccacggcuccuacgaggucaaggccaccgggagcgccagcuccaugaucaacggcguggugaagcugcucaccaagcccugggacgucgugcccauggugacccagauggcgaugacggacaccaccccguucgggcagcagcgcgucuucaaggagaagguggacacccggacgccccgccccaugcccggcacccggaaggugauggagaucaccgccgaguggcuguggcgcacccugggccggaacaagaagccgcgccucugcacgcgcgaggaguucaccaagaagguccggaccaacgccgccaugggggccguguucaccgaggagaaccagugggacagcgcgcgcgccgccguggaggacgaggaguucuggaagcuggucgaccgggagcgcgagcugcacaagcucggcaagugcggguccugcguguacaacaugaugggcaagcgggagaagaagcugggggaguucggcaaggccaagggcagccgcgcgaucugguacauguggcugggggcccgguaccucgaguucgaggcccugggcuuccugaacgaggaccacugguucucccgcgagaacagcuacuccgggguggagggcgaggggcuccacaagcugggcuacauccugcgggacaucagcaagauccccggcggggccauguacgccgacgacacggcgggcugggacacccgcaucaccgaggacgaccuccacaacgaggagaagaucacccagcagauggaccccgagcaccggcagcuggccaacgccaucuucaagcugacguaccagaacaaggucgugaaggugcagcgccccaccccgaaggggaccgucauggacaucaucucccggaaggaccagcgcggcagcggccagguggggaccuacggccucaacaccuucacgaacauggaggcccagcuggugcggcagauggagggggagggcguccuguccaaggccgaccucgagaacccccaccuccuggagaagaagaucacccaguggcucgagaccaaggggguggagcgccugaagcggauggcgaucagcggcgacgacugcguggucaagcccaucgacgaccgcuucgccaacgcccugcucgcccugaacgacaugggcaaggugcggaaggacaucccccaguggcagccguccaagggguggcacgacuggcagcagguccccuucugcagccaccacuuccacgagcugaucaugaaggacggccgcaagcucgucgugcccugccggccccaggacgagcugaucgggcgcgcccgcaucucccagggcgcgggguggagccugaaggagaccgccugccucggcaaggccuacgcccagauguggucccugauguacuuccaccggcgcgaccugcggcucgccagcaacgcgaucugcuccgccgugccgguccacuggauccccacgagccgcaccaccuggagcauccacgcccaccaccaguggaugaccacggaggacaugcugaccguguggaaccggguguggaucgaggacaaccccuggauggaggacaagacccccgucaccacgugggaggacgugccguaccugggcaagcgcgaggaccaguggugcgggucccucaucggccugaccagccgggccaccugggcgcagaacauccugaccgccauccagcagguccgcucccucaucggggacgaggaguuccuggacuacaugcccagcaugaagcgguuccgcaaggaggaggaguccgagggcgucaucugguga

SEQ ID NO: 10309 - RNA, 9873 nt, Artificial Sequence
  derived and/or modified CDS sequence (opt1) from DENV-3__FJ432728__SS-prME
accagccugugccucaugaugaugcugcccgcgacccuggccuuccaccucaccagccgggacggcgagccgcggaugaucguggggaagaacgagcgcggcaagagccugcuguucaagaccgcguccgggaucaacaugugcacccucaucgccauggaccugggcgagaugugcgacgacaccgugacguacaagugcccccugaucgccgagguggagcccgaggacaucgacugcuggugcaaccucaccagcaccugggugaccuacgggacgugcaaccaggccggcgagcaccggcgcgacaagcgguccguggcccuggcgccccacgugggcauggggcuggacacccgcacccagaccuggaugagcgccgagggcgccuggcgccagguggagaagguggagacgugggcccuccgccacccgggguucaccauccuggcgcuguuccucgcccacuacaucggcaccucccugacccagaagguggugaucuucauccugcucaugcuggugacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgugugcaagcacaccuacgucgaccggggguggggcaacgggugcggccuguucgggaagggcucccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccagcaccguggaggccgugcugcccgaguacggcacccucgggcuggagugcuccccgcgcaccggccuggacuucaacgagaugauccuccugaccaugaagaacaaggcguggaugguccaccggcagugguucuucgaccugccccuccccuggacgagcggcgccaccaccgagacccccacguggaaccgcaaggagcugcuggugaccuucaagaacgcccacgccaagaagcaggagguggucgugcucgggucccaggagggcgccaugcacaccgcgcugaccggggccacggagauccagaacagcggcgggaccuccaucuucgccggccaccugaagugccggcucaagauggacaagcuggagcugaagggcaugagcuacgccaugugccucaacaccuucgugcugaagaaggaggucuccgagacccagcacgggacgauccugaucaagguggaguacaagggcgaggacgccccgugcaagauccccuucagcaccgaggacgggcagggcaaggcgcacaacggccgccugaucaccgccaaccccguggucaccaagaaggaggagcccgugaacaucgaggccgagccgcccuucggggagagcaacaucgugaucggcaucggggacaaggcccucaagaucaacugguacaagaagggcuccagcaucgggaagauguucgaggcgacggcccggggcgcccgccggauggccauccugggcgacaccgccugggacuucggguccgucggcggggugcugaacagccucggcaagauggugcaccagaucuucggguccgcguacaccgcccuguucagcggcgucuccuggaucaugaagaucggcaucggggugcugcucaccuggaucggccugaacagcaagaacacguccaugagcuucuccugcaucgugaucgggaucaucacccuguaccucggcgccgucgugcaggccgacauggggugcgccaucaacuggaagggcaaggagcugaagugcggcagcgggaucuucgugaccaacgagguccacaccuggacggagcaguacaaguuccaggcggacucccccaagcgccuggccaccgccaucgccggcgccugggagaacggggugugcggcauccgcagcaccacccggauggagaaccuccuguggaagcagaucgcgaacgagcugaacuacauccucugggagaacaacaucaagcugacgguggucgugggggacaucaucggcgugcuggagcagggcaagcgcacccucacgccccagccgauggagcugaaguacuccuggaagaccugggggaaggccaagaucgucacggccgagacccagaacagcuccuucaucaucgacggccccaacacccccgagugccccagcgccucccgggcguggaacgugugggagguggaggacuacggguucggcgucuucaccacgaacaucuggcugaagcuccgcgagguguacacccagagcugcgaccaccggcugaugagcgccgccaucaaggacgagcgcgccgugcacgccgacaugggcuacuggaucgagucccagaagaacgggagcuggaagcuggagaaggcguccuucaucgaggucaagaccugcaccuggcccaagagccacacccucugguccaacggcgugcuggagagcgacaugaucauccccaagucccuggccgggcccaucagccagcacaaccaccggccgggcuaccacacgcagaccgccgggcccuggcaccucggcaagcuggagcuggacuucaacuacugcgagggcaccaccguggucaucacggaggacugcgggacccgcggccccucccuccggaccaccacggugagcgggaagcugauccacgaguggugcugccgcuccugcacccugcccccgcuccgguacaugggcgaggacgggugcugguacggcauggagauccgccccaucaacgagaaggaggagaacauggucaagagccuggucuccgccggcagcgggaagguggacaacuucaccaugggcgugcugugccucgccauccuguucgaggaggucaugcgggggaaguucggcaagaagcacaugaucgcgggggugcuguucaccuucgugcuccugcuguccggccagaucacguggcgcgacauggcccacacccucaucaugaucggcagcaacgccuccgaccggauggggaugggcgucaccuaccuggcccugaucgccaccuucaagauccagcccuuccucgcgcugggguucuuccugcgcaagcucacgagccgggagaaccugcugcucggcgugggccuggccauggccaccacccugcagcuccccgaggacaucgagcagauggccaacgggaucgcgcugggccugaugacccucaagcugaucacgcaguucgagaccuaccagcuguggaccgcccucgugagccugaccugcuccaacacgaucuucacccugaccgucgccuggcgcaccgccacgcucauccuggccggggugagccugcucccgcugugccaguccagcuccaugcggaagaccgacuggcugcccaugaccgucgcggccaugggcgugccgccccugccgcuguucaucuucagccugaaggacacccccaagcgccgcuccuggccccucaacgagggggugauggccgucggccuggugagcauccuggccuccagccuccugcggaacgacgugcccauggccggcccgcuggucgccggcgggcuccugaucgccugcuacgugaucacggggaccuccgccgaccugaccguggagaaggccgccgacgucaccugggaggaggaggcggagcagacgggggugagccacaaccucaugaucaccguggacgacgacgggaccaugcgcaucaaggacgacgagaccgagaacauccugaccguccugcucaagacggcccugcugaucguguccggcaucuuccccuacagcauccccgccacccuccugguguggcacaccuggcagaagcagacccagcgguccggcguccugugggacgugcccagcccgcccgagacgcagaaggccgagcucgaggaggggguguaccgcaucaagcagcagggcaucuucgggaagacccaggucggcgugggggugcagaaggagggcgucuuccacaccauguggcacgugacccggggcgccgugcugacgcacaacgggaagcgccuggagcccaacugggcguccgucaagaaggaccucaucagcuacggcgggggcuggcggcuguccgcccaguggcagaagggggaggagguccaggugaucgccgucgagcccggcaagaacccgaagaacuuccagaccaugcccggcaucuuccagaccaccacgggggagaucggcgccaucgcgcuggacuucaagcccgggaccagcggcagcccgaucaucaaccgcgagggcaaggugguggggcuguacggcaacggggucgugaccaagaacggcggguacguguccggcaucgcccagaccaacgccgagcccgacggccccacgcccgagcucgaggaggagauguucaagaagcggaaccugaccaucauggaccugcacccggggagcggcaagacccgcaaguaccuccccgccaucguccgggaggccaucaagcgccggcugcgcacccugauccucgcgcccacgcgggugguggccgccgagauggaggaggcccugaaggggcugcccauccgcuaccagaccaccgccaccaaguccgagcacacgggccgggagaucgucgaccucaugugccacgcgaccuucaccaugcgccugcugagcccggugcgggugcccaacuacaaccucaucaucauggacgaggcccacuucaccgaccccgccuccaucgccgcccgcggguacaucagcacgcgggucggcaugggcgaggcggccgccaucuucaugaccgccacgccgcccgggaccgcggaggccuucccccaguccaacgcccccauccaggacgaggagcgcgacauccccgagcgcagcuggaacuccggcaacgaguggaucacggacuucguggggaagaccgugugguucguccccagcaucaaggccggcaacgacaucgccaacugccugcggaagaacgggaagaaggugauccagcugucccgcaagaccuucgacaccgaguaccagaagacgcggcucaacgacugggacuucguggucaccaccgacaucagcgagaugggcgcgaacuucaaggccgaccgcgugaucgacccccggcgcugccugaagcccgugauccugaccgacggccccgagcgggucauccucgccgggccgaugcccgugacggccgccuccgcggcccagcgccggggccgcguggggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgcggccaucgacggcgaguaccggcugaagggcgagucccgcaagaccuucgucgagcucaugcggcgcggggaccugcccguguggcuggcccacaaggucgccagcgagggcaucaaguacacggaccggaaguggugcuucgacggggagcgcaacaaccagauccucgaggagaacauggacguggagaucuggaccaaggagggcgagcggaagaagcugcgcccgcgcuggcuggacgcgcggaccuacuccgacccccucgcccugaaggaguucaaggacuucgccgccggccgcaagagcaucgcccuggaccucgugaccgagaucgggcggguccccucccaccuggcguaccgcacgcggaacgcccuggacaaccucgugaugcugcacaccagcgagcacggcgggcgcgccuaccggcacgccguggaggagcugccggagaccauggagacccuccugcugcucggccugaugauccugcucaccggcggggccaugcuguuccugaucagcgggaaggggaucggcaagaccuccaucgggcucaucugcgucaucgugagcuccggcaugcuguggauggcggacgugccccugcaguggaucgccagcgccaucguccucgaguucuucaugauggugcugcugauccccgagcccgagaagcagcgcaccccgcaggacaaccagcucgccuacguggucaucgggauccugacccuggccgcgaucguggccgccaacgagaugggccuccuggagacgaccaagcgggaccugggcauguccaaggagcccgggguggucagccccaccuccuaccucgacguggaccugcaccccgccagcgccuggacccuguacgcgguggccacgaccgucaucaccccgaugcuccgccacaccaucgagaacuccacggccaacgugagccuggccgcgaucgccaaccaggccgugguccugaugggccucgacaagggguggcccaucuccaagauggaccugggcgugccccugcucgcccuggggugcuacagccaggugaacccccugacccucaccgccgcgguccugcugcucgugacccacuacgccaucaucggcccgggccugcaggccaaggccacgcgggaggcccagaagcgcaccgcggccgggaucaugaagaaccccaccguggacggcaucaugaccaucgaccuggaccccgucaucuacgacuccaaguucgagaagcagcucggccaggugaugcugcuggugcucugcgccguccagcugcugcucaugcggacgagcugggcccugugcgaggcccugacccucgcgaccggccccaucaccacgcugugggagggcuccccggggaaguucuggaacaccaccaucgccgugagcauggccaacaucuuccgcggcuccuaccuggccggggcgggccucgccuucagcaucaugaaguccguggggaccggccggcgcggcacggggagccagggcgagacccugggggagaaguggaagaagaagcugaaccagcucagccggaaggaguucgaccuguacaagaaguccggcaucaccgaggucgaccgcaccgaggccaaggaggggcugaagcggggcgagaccacgcaccacgccgugagccgcggcuccgccaagcuccagugguucguggagcggaacauggucauccccgaggggcgcgugaucgaccugggcugcgggcgcggcggguggagcuacuacugcgcgggccugaagaaggugaccgagguccggggcuacaccaagggcggccccgggcacgaggagcccgugccgauguccaccuacggcuggaaccucgugaagcugaugagcgggaaggacgucuucuaccugccgcccgagaagugcgacacgcugcucugcgacaucggcgaguccagccccuccccgaccguggaggagagccgcaccauccgggugcugaagauggucgagcccuggcugaagaacaaccaguucugcaucaaggugcucaaccccuacaugcccaccgugaucgagcaccuggagcgccugcagcggaaguacggcgggaugcucguccgcaacccgcugucccggaacagcacgcacgagauguacuggaucuccaacggcaccgggaacaucgugagcuccgugaacauggucagccgccugcuccugaaccgguucaccaugacccaccgccggcccacgaucgagaaggacguggaccugggcgccggcacccgccacgucaacgccgagcccgagaccccgaacauggacgugaucggggagcggaucaagcgcaucaaggaggagcacuccagcaccuggcacuacgacgacgagaaccccuacaagacgugggccuaccacggcuccuacgaggugaaggccaccgggagcgcgagcuccaugaucaacggcgucgugaagcuccugaccaagcccugggacgugguccccauggugacccagauggccaugacggacaccaccccguucgggcagcagcggguguucaaggagaaggucgacacccgcacgccccggcccaugcccggcacccgcaaggugauggagaucaccgccgaguggcuguggcggacccucggccgcaacaagaagccgcgccugugcacgcgggaggaguucaccaagaaggugcgcaccaacgccgccaugggggcggucuucaccgaggagaaccagugggacagcgcccgggccgccguggaggacgaggaguucuggaagcugguggaccgcgagcgggagcuccacaagcugggcaagugcggguccugcgucuacaacaugaugggcaagcgcgagaagaagcugggggaguucggcaaggcgaagggcagccgggccaucugguacauguggcucggggcccgcuaccuggaguucgaggcccugggcuuccucaacgaggaccacugguucucccgggagaacagcuacuccgggguggagggcgaggggcugcacaagcugggcuacauccuccgcgacaucagcaagauccccggcggggccauguacgcggacgacacggccggcugggacacccggaucaccgaggacgaccugcacaacgaggagaagaucacccagcagauggaccccgagcaccgccagcuggccaacgccaucuucaagcucacguaccagaacaagguggucaaggugcagcggcccaccccgaaggggaccgugauggacaucaucucccgcaaggaccagcggggcagcggccaggucgggaccuacggccugaacaccuucacgaacauggaggcccagcuggugcgccagauggagggggagggcgugcucuccaaggcggaccuggagaacccccaccuccucgagaagaagaucacccaguggcuggagaccaagggggucgagcggcugaagcgcauggccaucagcggcgacgacugcguggugaagcccaucgacgaccgguucgccaacgcccuccuggcccugaacgacaugggcaagguccgcaaggacaucccccaguggcagccguccaagggguggcacgacuggcagcagguccccuucugcagccaccacuuccacgagcucaucaugaaggacggccggaagcuggugguccccugccgcccccaggacgagcugaucgggcgcgcgcggaucucccagggcgccggguggagccucaaggagaccgccugccugggcaaggccuacgcccagauguggucccugauguacuuccaccgccgggaccuccgccuggcgagcaacgccaucugcuccgccgugccggugcacuggauccccacgagccggaccaccuggagcauccacgcccaccaccaguggaugaccacggaggacaugcugaccgucuggaaccgcguguggaucgaggacaaccccuggauggaggacaagacccccgugaccacgugggaggacgucccguaccucggcaagcgggaggaccaguggugcgggucccugaucggccugaccagccgcgcgaccugggcccagaacauccucaccgccauccagcagguccggucccugaucggggacgaggaguuccuggacuacaugcccagcaugaagcgcuuccggaaggaggaggaguccgagggcgccaucugguga

SEQ ID NO: 10310 - RNA, 9873 nt, Artificial Sequence
  derived and/or modified CDS sequence (opt1) from DENV-3__FJ432731__SS-prME
accagccugugccucaugaugaugcugcccgccacccuggccuuccaccucaccagccgggacggcgagccgcggaugaucguggggaagaacgagcgcggcaagagccugcuguucaagaccgcguccgggaucaacaugugcacccucaucgccauggaccugggcgagaugugcgacgacaccgugacguacaagugcccccugaucgccgagguggagcccgaggacaucgacugcuggugcaaccucaccagcaccugggugaccuacgggacgugcaaccaggccggcgagcaccggcgcgacaagcgguccguggcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgugugcaagcacaccuacgucgaccggggguggggcaacgggugcggccuguucgggaagggcucccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccagcaccguggaggccgugcugcccgaguacggcacccucgggcuggagugcuccccgcgcaccggccuggacuucaacgagaugauccuccugaccaugaagaacaaggcguggaugguccaccggcagugguucuucgaccugccccuccccuggacgagcggcgccaccaccgagacccccacguggaaccgcaaggagcugcuggugaccuucaagaacgcccacgccaagaagcaggagguggucgugcucgggucccaggagggcgccaugcacaccgcgcugaccggggccacggagauccagaacagcggcgggaccuccaucuucgccggccaccugaagugccggcucaagauggacaagcuggagcugaagggcaugagcuacgccaugugccucaacaccuucgugcugaagaaggaggucuccgagacccagcacgggacgauccugaucaagguggaguacaagggcgaggacgccccgugcaagauccccuucagcaccgaggacgggcagggcaaggcgcacaacggccgccugaucaccgccaaccccguggucaccaagaaggaggagcccgugaacaucgaggccgagccgcccuucggggagagcaacaucgugaucggcaucggggacaaggcccucaagaucaacugguacaagaagggcuccagcaucgggaagauguucgaggcgacggcccggggcgcccgccggauggccauccugggcgacaccgccugggacuucggguccgucggcggggugcugaacagccucggcaagauggugcaccagaucuucggguccgcguacaccgcccuguucagcggcgucuccuggaucaugaagaucggcaucggggugcugcucaccuggaucggccugaacagcaagaacacguccaugagcuucuccugcaucgugaucgggaucaucacccuguaccucggcgccgucgugcaggccgacauggggugcgccaucaacuggaagggcaaggagcugaagugcggcagcgggaucuucgugaccaacgagguccacaccuggacggagcaguacaaguuccaggcggacucccccaagcgccuggccaccgccaucgccggcgccugggagaacggggugugcggcauccgcagcaccacccggauggagaaccuccuguggaagcagaucgcgaacgagcugaacuacauccucugggagaacaacaucaagcugacgguggucgugggggacaucaucggcgugcuggagcagggcaagcgcacccucacgccccagccgauggagcugaaguacuccuggaagaccugggggaaggccaagaucgucacggccgagacccagaacagcuccuucaucaucgacggccccaacacccccgagugccccagcgccucccgggcguggaacgugugggagguggaggacuacggguucggcgucuucaccacgaacaucuggcugaagcuccgcgagguguacacccagagcugcgaccaccggcugaugagcgccgccaucaaggacgagcgcgccgugcacgccgacaugggcuacuggaucgagucccagaagaacgggagcuggaagcuggagaaggcguccuucaucgaggucaagaccugcaccuggcccaagagccacacccucugguccaacggcgugcuggagagcgacaugaucauccccaagucccuggccgggcccaucagccagcacaaccaccggccgggcuaccacacgcagaccgccgggcccuggcaccucggcaagcuggagcuggacuucaacuacugcgagggcaccaccguggucaucacggagaacugcgggacccgcggccccucccuccggaccaccacggugagcgggaagcugauccacgaguggugcugccgcuccugcacccugcccccgcuccgguacaugggcgaggacgggugcugguacggcauggagauccgccccaucaacgagaaggaggagaacauggucaagagccuggucuccgccggcagcgggaagguggacaacuucaccaugggcgugcugugccucgccauccuguucgaggaggucaugcgggggaaguucggcaagaagcacaugaucgcgggggugcuguucauguucgugcuccugcuguccggccagaucaccuggcgcgacauggcccagacgcucaucaugaucggcagcaacgccuccgaccggauggggaugggcgucaccuaccuggcccugaucgccaccuucaagauccagcccuuccucgcgcugggguucuuccugcgcaagcucaccagccgggagaaccugcugcucggcgugggccuggccaugacgaccacccugcagcuccccgaggacaucgagcagauggccaacgggaucgcccugggccugaugacccucaagcugaucacgcaguucgagaccuaccagcuguggaccgcgcucgugagccugaccugcuccaacacgaucuucacccugaccgucgccuggcgcaccgccacgcucauccuggccggggugagccugcucccgcugugccaguccagcuccaugcggaagaccgacuggcugcccaugaccgucgccgcgaugggcgugccgccccugccgcuguucaucuucagccugaaggacacccccaagcgccgcuccuggccccucaacgagggggugauggccgucggccuggugagcauccuggccuccagccuccugcggaacgacgugcccauggccggcccgcuggucgccgggggccuccugaucgcgugcuacgugaucacggggaccuccgccgaccugaccguggagaaggccgccgacgucaccugggaggaggaggccgagcagacgggcgugagccacaaccucaugaucaccguggacgacgacgggaccaugcgcaucaaggacgacgagaccgagaacauccugaccguccugcucaagacggcgcugcugaucguguccggcaucuuccccuacagcauccccgccacccuccugguguggcacaccuggcagaagcagacccagcgguccggcguccugugggacgugcccagcccgcccgagacgcagaaggccgagcucgaggaggggguguaccgcaucaagcagcagggcaucuucgggaagacccaggucggcgugggggugcagaaggagggcgucuuccacaccauguggcacgugacccggggcgccgugcugacgcacaacgggaagcgccuggagcccaacugggccuccgucaagaaggaccucaucagcuacggcgggggcuggcggcuguccgcgcaguggcagaagggggaggagguccaggugaucgccgucgagcccggcaagaacccgaagaacuuccagaccaugcccggcaucuuccagaccaccacgggggagaucggcgccaucgcccuggacuucaagcccgggaccagcggcagcccgaucaucaaccgcgagggcaaggugguggggcuguacggcaacggggucgugaccaagaacggcggguacguguccggcaucgcgcagaccaacgccgagcccgacggccccacgcccgagcucgaggaggagauguucaagaagcggaaccugaccaucauggaccugcacccggggagcggcaagacccgcaaguaccuccccgccaucguccgggaggccaucaagcgccggcugcgcacccugauccucgcccccacgcgggugguggcggccgagauggaggaggcccugaaggggcugcccauccgcuaccagaccaccgccaccaaguccgagcacacgggccgggagaucgucgaccucaugugccacgccaccuucaccaugcgccugcugagcccggugcgggugcccaacuacaaccucaucaucauggacgaggcgcacuucaccgaccccgccuccaucgccgcccgcggguacaucagcacgcgggucggcaugggcgaggccgcggccaucuucaugaccgccacgccgcccgggaccgccgaggcguucccccaguccaacgcccccauccaggacgaggagcgcgacauccccgagcgcagcuggaacuccggcaacgaguggaucacggacuucguggggaagaccgugugguucguccccagcaucaaggccggcaacgacaucgccaacugccugcggaagaacgggaagaaggugauccagcugucccgcaagaccuucgacaccgaguaccagaagacgcggcucaacgacugggacuucguggucaccaccgacaucagcgagaugggcgccaacuucaaggcggaccgcgugaucgacccccggcgcugccugaagcccgugauccugaccgacggccccgagcgggucauccucgccgggccgaugcccgugacggccgccuccgccgcgcagcgccggggccgcguggggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgccgcgaucgacggcgaguaccggcugaagggcgagucccgcaagaccuucgucgagcucaugcggcgcggggaccugcccguguggcuggcccacaaggucgccagcgagggcaucaaguacacggaccggaaguggugcuucgacggggagcgcaacaaccagauccucgaggagaacauggacguggagaucuggaccaaggagggcgagcggaagaagcugcgcccgcgcuggcuggacgcccggaccuacuccgacccccucgcgcugaaggaguucaaggacuucgccgccggccgcaagagcaucgcccuggaccucgugaccgagaucgggcggguccccucccaccuggccuaccgcacgcggaacgcgcuggacaaccucgugaugcugcacaccagcgagcacggcgggcgcgccuaccggcacgccguggaggagcugccggagaccauggagacccuccugcugcucggccugaugauccugcucaccggcggggccaugcuguuccugaucagcgggaaggggaucggcaagaccuccaucgggcucaucugcgucaucgugagcuccggcaugcuguggauggccgacgugccccugcaguggaucgcgagcgccaucauccucgaguucuucaugaugguccugcugauccccgagcccgagaagcagcgcaccccgcaggacaaccagcucgccuacguggugaucgggauccugacccuggccgccaucgucgcggccaacgagaugggccuccuggagacgaccaagcgggaccugggcauguccaaggagcccgggguggugagccccaccuccuaccucgacgucgaccugcaccccgccagcgccuggacccuguacgccguggcgacgaccgugaucaccccgaugcuccgccacaccaucgagaacuccacggccaacgucagccuggccgccaucgcgaaccaggccguggugcugaugggccucgacaagggguggcccaucuccaagauggaccugggcgucccccugcucgcccuggggugcuacagccaggugaacccccugacccucaccgccgccgugcugcugcucgucacccacuacgcgaucaucggcccgggccugcaggccaaggccacgcgggaggcccagaagcgcaccgccgcggggaucaugaagaaccccaccguggacggcaucaugaccaucgaccuggaccccgugaucuacgacuccaaguucgagaagcagcucgggcaggucaugcugcuggugcucugcgccgugcagcugcugcucaugcggacgagcugggcccugugcgaggcccugacccucgccaccggccccaucaccacgcugugggagggcuccccggggaaguucuggaacaccaccaucgcggucagcauggccaacaucuuccgcggcuccuaccuggccggggccggccucgcguucagcaucaugaaguccguggggaccggccggcgcggcacggggagccagggcgagacccugggggagaaguggaagaagaagcugaaccagcucagccggaaggaguucgaccuguacaagaaguccggcaucaccgagguggaccgcaccgaggccaaggaggggcugaagcggggcgagaccacgcaccacgccgucagccgcggcuccgccaagcuccagugguucguggagcggaacauggugauccccgaggggcgcgucaucgaccugggcugcgggcgcggcggguggagcuacuacugcgccggccugaagaaggugaccgaggugcggggcuacaccaagggcggccccgggcacgaggagcccgucccgauguccaccuacggcuggaaccucgugaagcugaugagcgggaaggacguguucuaccugccgcccgagaagugcgacacgcugcucugcgacaucggcgaguccagccccuccccgaccgucgaggagagccgcaccauccgggugcugaagaugguggagcccuggcugaagaacaaccaguucugcaucaagguccucaaccccuacaugcccaccgugaucgagcaccuggagcgccugcagcggaaguacggcgggaugcucgugcgcaacccgcugucccggaacagcacgcacgagauguacuggaucuccaacggcaccgggaacaucgucagcuccgugaacauggugagccgccugcuccugaaccgguucaccaugacccaccgccggcccacgaucgagaaggacgucgaccugggcgcgggcacccgccacgugaacgccgagcccgagaccccgaacauggacgucaucggggagcggaucaagcgcaucaaggaggagcacuccagcaccuggcacuacgacgacgagaaccccuacaagacgugggccuaccacggcuccuacgaggugaaggccaccgggagcgccagcuccaugaucaacggcguggucaagcuccugaccaagcccugggacguggugcccauggucacccagauggcgaugacggacaccaccccguucgggcagcagcggguguucaaggagaagguggacacccgcacgccccggcccaugcccggcacccgcaaggucauggagaucaccgccgaguggcuguggcggacccucggccgcaacaagaagccgcgccugugcacgcgggaggaguucaccaagaaggugcgcaccaacgccgccaugggggccguguucaccgaggagaaccagugggacagcgcgcgggccgccgucgaggacgaggaguucuggaagcugguggaccgcgagcgggagcuccacaagcugggcaagugcggguccugcguguacaacaugaugggcaagcgcgagaagaagcugggggaguucggcaaggccaagggcagccgggcgaucugguacauguggcucggggcccgcuaccuggaguucgaggcccugggcuuccucaacgaggaccacugguucucccgggagaacagcuacuccggggucgagggcgaggggcugcacaagcugggcuacauccuccgcgacaucagcaagauccccggcggggccauguacgccgacgacacggcgggcugggacacccggaucaccgaggacgaccugcacaacgaggagaagaucacccagcagauggaccccgagcaccgccagcuggccaacgccaucuucaagcucacguaccagaacaagguggugaagguccagcggcccaccccgaaggggaccgugauggacaucaucucccgcaaggaccagcggggcagcggccagguggggaccuacggccugaacaccuucacgaacauggaggcccagcugguccgccagauggagggggagggcgugcucuccaaggccgaccuggagaacccccaccuccucgagaagaagaucacccaguggcuggagaccaaggggguggagcggcugaagcgcauggcgaucagcggcgacgacugcgucgugaagcccaucgacgaccgguucgccaacgcccuccuggcccugaacgacaugggcaaggugcgcaaggacaucccccaguggcagccguccaagggguggcacgacuggcagcagguccccuucugcagccaccacuuccacgagcucaucaugaaggacggccggaagcugguggugcccugccgcccccaggacgagcugaucgggcgcgcccggaucucccagggcgcgggguggagccucaaggagaccgccugccugggcaaggccuacgcccagauguggucccugauguacuuccaccgccgggaccuccgccuggccagcaacgcgaucugcuccgccgucccggugcacuggauccccacgagccggaccaccuggagcauccacgcccaccaccaguggaugaccacggaggacaugcugaccguguggaaccgcgucuggaucgaggacaaccccuggauggaggacaagacccccgugaccacgugggaggacgugccguaccucggcaagcgggaggaccaguggugcgggucccugaucggccugaccagccgcgccaccugggcgcagaacauccucaccgccauccagcagguccggucccugaucggggacgaggaguuccuggacuacaugcccagcaugaagcgcuuccggaaggaggaggaguccgagggcgccaucugguga

SEQ ID NO: 10311 - RNA, 9873 nt, Artificial Sequence
  derived and/or modified CDS sequence (opt1) from DENV-3__FJ562097__SS-prME
accagccugugccucaugaugaugcugcccgcgacccuggccuuccaccucaccagccgggacggcgagccgcggaugaucguggggaagaacgagcggggcaagagccugcuguucaagaccgcguccgggaucaacaugugcacccucaucgccauggaccugggcgagaugugcgacgacaccgucaccuacaagugcccccugaucgccgagguggagcccgaggacaucgacugcuggugcaaccucaccagcaccugggugaccuacgggacgugcaaccaggccggcgagcaccggcgcgacaagcgguccgucgcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgugugcaagcacaccuacgucgaccggggguggggcaacgggugcggccuguucgggaagggcucccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccagcaccguggaggccgugcugcccgaguacggcacccucgggcuggagugcuccccgcgcaccggccuggacuucaacgagaugauccuccugaccaugaagaacaaggcguggaugguccaccggcagugguucuucgaccugccccuccccuggacgagcggcgccaccaccgagacccccacguggaaccgcaaggagcugcuggugaccuucaagaacgcccacgccaagaagcaggagguggucgugcucgggucccaggagggcgccaugcacaccgcgcugaccggggccacggagauccagaacagcggcgggaccuccaucuucgccggccaccugaagugccggcucaagauggacaagcuggagcugaagggcaugagcuacgccaugugccucaacaccuucgugcugaagaaggaggucuccgagacccagcacgggacgauccugaucaagguggaguacaagggcgaggacgccccgugcaagauccccuucagcaccgaggacgggcagggcaaggcgcacaacggccgccugaucaccgccaaccccguggucaccaagaaggaggagcccgugaacaucgaggccgagccgcccuucggggagagcaacaucgugaucggcaucggggacaaggcccucaagaucaacugguacaagaagggcuccagcaucgggaagauguucgaggcgacggcccggggcgcccgccggauggccauccugggcgacaccgccugggacuucggguccgucggcggggugcugaacagccucggcaagauggugcaccagaucuucggguccgcguacaccgcccuguucagcggcgucuccuggaucaugaagaucggcaucggggugcugcucaccuggaucggccugaacagcaagaacacguccaugagcuucuccugcaucgugaucgggaucaucacccuguaccucggcgccgucgugcaggccgacauggggugcgugaucaacuggaagggcaaggagcugaagugcggcagcgggaucuucgucaccaacgaggugcacaccuggacggagcaguacaaguuccaggccgacucccccaagcgccuggcgaccgccaucgccggcgccugggagaacggggugugcggcauccgcagcaccacccggauggagaaccuccuguggaagcagaucgccaacgagcugaacuacauccucugggagaacaacaucaagcugacggucguggugggggacaucaucggcguccuggagcagggcaagcgcacccucacgccccagccgauggagcugaaguacuccuggaagaccugggggaaggcgaagaucgugacggccgagacccagaacagcuccuucaucaucgacggccccaacacccccgagugccccagcgccucccgggccuggaacgugugggaggucgaggacuacggguucggcguguucaccacgaacaucuggcugaagcuccgcgagguguacacccagagcugcgaccaccggcugaugagcgcggccaucaaggacgagcgcgccguccacgccgacaugggcuacuggaucgagucccagaagaacgggagcuggaagcuggagaaggccuccuucaucgaggugaagaccugcaccuggcccaagagccacacccucugguccaacggcgugcuggagagcgacaugaucauccccaagucccuggcggggcccaucagccagcacaaccaccggccgggcuaccacacgcagaccgccgggcccuggcaccucggcaagcuggagcuggacuucaacuacugcgagggcaccaccgucgugaucacggagaacugcgggacccgcggccccucccuccggaccaccacggugagcgggaagcugauccacgaguggugcugccgcuccugcacccugcccccgcuccgguacaugggcgaggacgggugcugguacggcauggagauccgccccaucaacgagaaggaggagaacauggucaagagccugguguccgccggcagcgggaagguggacaacuucaccaugggcguccugugccucgccauccuguucgaggaggugaugcgggggaaguucggcaagaagcacaugaucgccggggugcuguucaccuucguccuccugcuguccggccagaucacguggcgcgacauggcgcacacccucaucaugaucggcagcaacgccuccgaccggauggggaugggcgugaccuaccuggcccugaucgccaccuucaagauccagcccuuccucgcccugggguucuuccugcgcaagcucacgagccgggagaaccugcugcucggcgugggccuggcgauggccgccacccugcagcuccccgaggacaucgagcagauggccaacgggaucgcgcugggccugaugacccucaagcugaucacccaguucgagacguaccagcuguggaccgcccucgucagccugaccugcuccaacaccaucuucacgcugaccguggccuggcgcaccgccacccucauccuggccggggucagccugcucccgcugugccaguccagcuccaugcggaagacggacuggcugcccaugaccguggcggccaugggcgugccgccccugccgcuguucaucuucagccugaaggacacccccaagcgccgcuccuggccccucaacgagggggucauggccgugggccuggugagcauccuggccuccagccuccugcggaacgacguccccauggccggcccgcugguggccggcgggcuccugaucgccugcuacgugaucaccgggacguccgccgaccugaccgucgagaaggccgccgacgugaccugggaggaggaggcggagcagaccggggugagccacaaccucaugaucacggucgacgacgacgggaccaugcgcaucaaggacgacgagaccgagaacauccugaccgugcugcucaagaccgcccugcugaucguguccggcgucuuccccuacagcauccccgccacgcuccugguguggcacaccuggcagaagcagacccagcgguccggcgugcugugggacguccccagcccgcccgagacccagaaggccgagcucgaggaggggguguaccgcaucaagcagcagggcaucuucgggaagacccaggugggcgucggggugcagaaggagggcguguuccacaccauguggcacgucacccggggcgccgugcugacccacaacgggaagcgccuggagcccaacugggcguccgugaagaaggaccucaucagcuacggcgggggcuggcggcuguccgcccaguggcagaagggggaggagguccaggugaucgccguggagcccggcaagaacccgaagaacuuccagacgaugcccggcaucuuccagaccaccaccggggagaucggcgccaucgcgcuggacuucaagcccgggacgagcggcagcccgaucaucaaccgcgagggcaaggucguggggcuguacggcaacgggguggucaccaagaacggcggguacguguccggcaucgcccagaccaacgccgagcccgacggccccacccccgagcucgaggaggagauguucaagaagcggaaccugacgaucauggaccugcacccggggagcggcaagacccgcaaguaccuccccgccaucgugcgggaggccaucaagcgccggcugcgcacccugauccucgcgcccacccgggucguggccgccgagauggaggaggcccugaaggggcugcccauccgcuaccagacgaccgccaccaaguccgagcacaccggccgggagaucguggaccucaugugccacgcgacguucaccaugcgccugcugagcccgguccgggugcccaacuacaaccucaucaucauggacgaggcccacuucaccgaccccgccuccaucgccgcccgcggguacaucagcacccgggugggcaugggcgaggcggccgccaucuucaugacggccacgccgcccgggaccgcggaggccuucccccaguccaacgcccccauccaggacgaggagcgcgacauccccgagcgcagcuggaacuccggcaacgaguggaucaccgacuucgucgggaagacggugugguucgugcccagcaucaaggccggcaacgacaucgccaacugccugcggaagaacgggaagaaggucauccagcugucccgcaagaccuucgacaccgaguaccagaagaccaagcucaacgacugggacuucguggugacgaccgacaucagcgagaugggcgcgaacuucaaggccgaccgggucaucgacccccgccggugccugaagcccgugauccugaccgacggccccgagcgcgugauccucgccgggccgaugcccgucaccgccgccuccgcggcccagcggcgcggccggguggggcgcaacccccagaaggagaacgaccaguacaucuucacgggccagccccugaacaacgacgaggaccacgcccacuggaccgaggccaagaugcugcucgacaacaucaacaccccggaggggaucauccccgcccuguucgagcccgagcgggagaaguccgcggccaucgacggcgaguaccgccugaagggcgagucccggaagaccuucgucgagcucaugcgccgcggggaccugcccguguggcuggcccacaagguggccagcgagggcaucaaguacaccgaccgcaaguggugcuucgacggggagcggaacaaccagauccucgaggagaacauggacgucgagaucuggacgaaggagggcgagcgcaagaagcugcggccgcgcuggcuggacgcgcgcaccuacuccgacccccucgcccugaaggaguucaaggacuucgccgccggccgcaagagcaucgcccuggaccucgugaccgagaucgggcgcgugcccucccaccuggcguaccggacccgcaacgcccuggacaaccucgucaugcugcacacgagcgagcacggcgggcgggccuaccgccacgccguggaggagcugccggagaccauggagacccuccugcugcucggccugaugauccugcucaccgggggcgccaugcuguuccugaucagcggcaaggggaucggcaagacguccaucgggcucaucugcgugaucgucagcuccggcaugcuguggauggcggacgugccccugcaguggaucgccagcgccaucgugcucgaguucuucaugaugguccugcugauccccgagcccgagaagcagcggaccccgcaggacaaccagcucgccuacguggugaucgggauccugacccuggccgcgaucgucgccgccaacgagaugggccuccuggagaccacgaagcgcgaccugggcauguccaaggagcccgggguggugagccccaccuccuaccucgacgucgaccugcaccccgccagcgccuggacccuguacgcgguggccaccacggugaucaccccgaugcuccggcacaccaucgagaacuccaccgccaacgucagccuggccgcgaucgccaaccaggccguggugcugaugggccucgacaagggguggcccaucuccaagauggaccugggcgucccccugcucgcccuggggugcuacagccaggugaacccccugacgcucaccgccgcggugcugcugcucgucacccacuacgccaucaucggcccgggccugcaggccaaggccacccgcgaggcccagaagcggacggcggccgggaucaugaagaaccccaccguggacggcaucaugaccaucgaccuggaccccgugaucuacgacuccaaguucgagaagcagcucgggcaggucaugcugcuggugcucugcgccgugcagcugcugcucaugcgcaccagcugggcccugugcgaggcccugacgcucgcgaccggccccaucaccacccugugggagggcuccccggggaaguucuggaacacgaccaucgccgucagcauggccaacaucuuccggggcuccuaccuggccggggcgggccucgccuucagcaucaugaaguccguggggaccggccgccggggcaccgggagccagggcgagacgcugggggagaaguggaagaagaagcugaaccagcucagccgcaaggaguucgaccuguacaagaaguccggcaucaccgagguggaccggaccgaggccaaggaggggcugaagcgcggcgagaccacccaccacgccgucagccggggcuccgccaagcuccagugguucguggagcgcaacauggugauccccgaggggcgggucaucgaccugggcugcgggcgcggcggguggagcuacuacugcgcgggccugaagaaggugacggaggugcgcggcuacaccaagggcggccccgggcacgaggagcccgucccgauguccaccuacggcuggaacaucgugaagcucaugagcgggaaggacguguucuaccugccgcccgagaagugcgacacccugcugugcgacaucggcgaguccagccccuccccgacggucgaggagagccggaccauccgcgugcucaagaugguggagcccuggcugaagaacaaccaguucugcaucaagguccugaaccccuacaugcccaccgugaucgagcaccucgagcggcugcagcgcaaguacggcgggaugcuggugcggaacccgcucucccgcaacagcacccacgagauguacuggaucuccaacggcacggggaacaucgucagcuccgugaacauggucagccggcugcugcucaaccgcuucaccaugacccaccggcgccccaccaucgagaaggacguggaccugggcgccggcacgcggcacgugaacgccgagcccgagaccccgaacauggacgucaucggggagcgcaucaagcggaucaaggaggagcacuccagcaccuggcacuacgacgacgagaaccccuacaagaccugggccuaccacggcuccuacgaggugaaggccacggggagcgcgagcuccaugaucaacggcguggucaagcugcucaccaagcccugggacguggugcccauggucacccagauggccaugaccgacacgaccccguucgggcagcagcgcguguucaaggagaagguggacacccggacgccccggcccaugcccggcacgcggaaggucauggagaucaccgccgaguggcuguggcgcacccugggccggaacaagaagccgcgccucugcacccgcgaggaguucacgaagaaggugcggaccaacgccgccaugggggcgguguucaccgaggagaaccagugggacagcgcccgcgccgccgucgaggacgaggaguucuggaagcugguggaccgggagcgcgagcugcacaagcucggcaagugcggguccugcguguacaacaugaugggcaagcgggagaagaagcugggggaguucggcaaggcgaagggcagccgcgccaucugguacauguggcugggggcccgguaccucgaguucgaggcccugggcuuccugaacgaggaccacugguucucccgcgagaacagcuacuccggggucgagggcgaggggcuccacaagcugggcuacauccugcgggacaucagcaagauccccggcggggccauguacgcggacgacaccgccggcugggacacgcgcaucaccgaggacgaccuccacaacgaggagaagaucacccagcagauggaccccgagcaccggcagcuggccaacgccaucuucaagcugaccuaccagaacaagguggugaagguccagcgccccacgccgaaggggaccgugauggacaucaucucccggaaggaccagcgcggcagcggccagguggggaccuacggccucaacaccuucaccaacauggaggcccagcugguccggcagauggagggggagggcgugcuguccaaggcggaccucgagaacccccaccuccuggagaagaagaucacgcaguggcucgagaccaaggggguggagcgccugaagcggauggccaucagcggcgacgacugcgucgugaagcccaucgacgaccgcuucgccaacgcccugcucgcccugaacgacaugggcaaggugcggaaggacaucccccaguggcagccguccaagggguggcacgacuggcagcagguccccuucugcagccaccacuuccacgagcugaucaugaaggacggccgcaagcucguggugcccugccggccccaggacgagcugaucgggcgcgcgcgcaucucccagggcgccggguggagccugaaggagaccgccugccucggcaaggccuacgcccagauguggucccugauguacuuccaccggcgcgaccugcggcucgcgagcaacgccaucugcuccgccgucccggugcacuggauccccaccagccgcacgaccuggagcauccacgcccaccaccaguggaugaccaccgaggacaugcugacgguguggaaccgggucuggaucgaggacaaccccuggauggaggacaagacccccgugaccaccugggaggacgugccguaccugggcaagcgcgaggaccaguggugcgggucccucaucggccugacgagccgggcgaccugggcccagaacauccugaccgccauccagcagguccgcucccucaucggggacgaggaguuccuggacuacaugcccagcaugaagcgguuccgcaaggaggaggaguccgagggcgccaucugguga

SEQ ID NO: 10312 - RNA, 9873 nt, Artificial Sequence
  derived and/or modified CDS sequence (opt1) from DENV-3__FJ432741__SS-prME
accagccugugccucaugaugaugcugcccgccacccuggccuuccaccucaccagccgggacggggagccgcggaugaucguggggaagaacgagcgcggcaagagccugcuguucaagaccgcguccgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggacgugcaaccaggccggcgagcaccggcgcgacaagcgguccguggcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgugugcaagcacaccuacgucgaccggggguggggcaacgggugcggccuguucgggaagggcucccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccagcaccguggaggccgugcugcccgaguacggcacccucgggcuggagugcuccccgcgcaccggccuggacuucaacgagaugauccuccugaccaugaagaacaaggcguggaugguccaccggcagugguucuucgaccugccccuccccuggacgagcggcgccaccaccgagacccccacguggaaccgcaaggagcugcuggugaccuucaagaacgcccacgccaagaagcaggagguggucgugcucgggucccaggagggcgccaugcacaccgcgcugaccggggccacggagauccagaacagcggcgggaccuccaucuucgccggccaccugaagugccggcucaagauggacaagcuggagcugaagggcaugagcuacgccaugugccucaacaccuucgugcugaagaaggaggucuccgagacccagcacgggacgauccugaucaagguggaguacaagggcgaggacgccccgugcaagauccccuucagcaccgaggacgggcagggcaaggcgcacaacggccgccugaucaccgccaaccccguggucgccaagaaggaggagcccgugaacaucgaggccgagccgcccuucggggagagcaacaucgugaucggcaucggggacaaggcgcucaagaucaacugguacaagaagggcuccagcaucgggaagauguucgaggccaccgcccggggcgcccgccggauggccauccugggcgacacggcgugggacuucggguccgucggcggggugcugaacagccucggcaagauggugcaccagaucuucggguccgccuacaccgcccuguucagcggcgucuccuggaucaugaagaucggcaucggggugcugcucaccuggaucggccugaacagcaagaacaccuccaugagcuucuccugcaucgugaucgggaucaucacgcuguaccucggcgccgucgugcaggccgacauggggugcgcgaucaacuggaagggcaaggagcugaagugcggcagcgggaucuucgugaccaacgagguccacaccuggaccgagcaguacaaguuccaggccgacucccccaagcgccuggccacggccaucgccggcgcgugggagaacggggugugcggcauccgcagcaccacccggauggagaaccuccuguggaagcagaucgccaacgagcugaacuacauccucugggagaacaacaucaagcugaccguggucgugggggacaucaucggcgugcuggagcagggcaagcgcacgcucacgccccagccgauggagcugaaguacuccuggaagaccugggggaaggccaagaucgucaccgccgagacgcagaacagcuccuucaucaucgacggccccaacacccccgagugccccagcgcgucccgggccuggaacgugugggagguggaggacuacggguucggcgucuucaccaccaacaucuggcugaagcuccgcgaggugcacacgcagagcugcgaccaccggcugaugagcgccgccaucaaggacgagcgcgccgugcacgcggacaugggcuacuggaucgagucccagaagaacgggagcuggaagcuggagaaggccuccuucaucgaggucaagaccugcaccuggcccaagagccacacccucugguccaacggcgugcuggagagcgacauggugauccccaagucccuggccgggcccaucagccagcacaaccaccggccgggcuaccacacccagacggccgggcccuggcaccucggcaagcuggagcuggacuucaacuacugcgagggcaccaccgucgugaucaccgagaacugcgggacgcgcggccccucccuccggaccaccaccgugagcgggaagcugauccacgaguggugcugccgcuccugcacgcugcccccgcuccgguacaugggcgaggacgggugcugguacggcauggagauccgccccaucaacgagaaggaggagaacauggucaagagccugguguccgccggcagcgggaagguggacaacuucaccaugggcguccugugccucgcgauccuguucgaggaggugaugcgggggaaguucggcaagaagcacaugaucgccggggugcuguucaccuucguccuccugcuguccggccagaucaccuggcgcgacauggcccacacgcucaucaugaucggcagcaacgccuccgaccggauggggaugggcgugaccuaccuggcccugaucgcgaccuucaagauccagcccuuccucgcccugggguucuuccugcgcaagcucaccagccgggagaaccugcugcucggcgugggccuggccauggccacgacccugcagcuccccgaggacaucgagcagauggcgaacgggaucgcccugggccugaugacccucaagcugaucacccaguucgagacguaccagcuguggaccgcccucgucagccugaccugcuccaacaccaucuucacgcugaccguggccuggcgcaccgccacccucauccuggcgggggucagccugcucccgcugugccaguccagcuccaugcggaagacggacuggcugcccaugaccguggccgccaugggcgugccgccccugccgcuguucaucuucagccugaaggacacccccaagcgccgcuccuggccccucaacgagggggucauggccgugggccuggugagcauccuggccuccagccuccugcggaacgacguccccauggcgggcccgcugguggccgggggccuccugaucgccugcuacgugaucaccgggacguccgccgaccugaccgucgagaaggccgcggacgugaccugggaggaggaggccgagcagaccggcgugagccacaaccucaugaucacggucgacgacgacgggaccaugcgcaucaaggacgacgagaccgagaacauccugaccgugcugcucaagaccgcccugcugaucguguccggcaucuuccccuacagcauccccgccacgcuccuggucuggcacaccuggcagaagcagacccagcgguccggcgugcugugggacgugcccagcccgcccgagacccagaaggccgagcucgaggagggggucuaccgcaucaagcagcagggcaucuucgggaagacccaggugggcguggggguccagaaggagggcguguuccacaccauguggcacgugacccggggcgcgguccugacccacaacgggaagcgccuggagcccaacugggccuccgugaagaaggaccucaucagcuacggcgggggcuggcggcuguccgcccaguggcagaagggggaggaggugcaggucaucgccguggagcccggcaagaacccgaagaacuuccagacgaugcccggcaucuuccagaccaccaccggggagaucggcgcgaucgcccuggacuucaagcccgggacgagcggcagcccgaucaucaaccgcgagggcaagguggucgggcuguacggcaacgggguggugaccaagaacggcggguacgucuccggcaucgcccagaccaacgccgagcccgacggccccacccccgagcucgaggaggagguguucaagaagcggaaccugacgaucauggaccugcacccggggagcggcaagacccgcaaguaccuccccgccaucgugcgggaggcgaucaagcgccggcugcgcacccugauccucgcccccacccgggucguggccgccgagauggaggaggcccugaaggggcugcccauccgcuaccagacgaccgcgaccaaguccgagcacaccggccgggagaucguggaccucaugugccacgccacguucaccaugcgccugcugagcccgguccgggugcccaacuacaaccucaucaucauggacgaggcccacuucaccgaccccgccuccaucgccgcgcgcggguacaucagcacccgggugggcaugggcgaggccgccgccaucuucaugacggcgacgccgcccgggaccgccgaggccuucccccaguccaacgcccccauccaggacgaggagcgcgacauccccgagcgcagcuggaacuccggcaacgaguggaucaccgacuucgucgggaagacggugugguucgugcccagcaucaaggccggcaacgacaucgcgaacugccugcggaagaacgggaagaaggucauccagcugucccgcaagaccuucgacaccgaguaccagaagacccggcucaacgacugggacuucguggugacgaccgacaucagcgagaugggcgccaacuucaaggccgaccgcgucaucgacccccggcgcugccugaagcccgugauccugaccgacggccccgagcgggugauccucgccgggccgaugcccgucaccgccgcguccgccgcccagcgccggggccgcguggggcggaacccccagaaggagaacgaccaguacaucuucacgggccagccccugaacaacgacgaggaccacgcccacuggaccgaggccaagaugcugcucgacaacaucaacaccccggaggggaucauccccgcgcuguucgagcccgagcgcgagaaguccgccgccaucgacggcgaguaccggcugaagggcgagucccgcaagaccuucgucgagcucaugcggcgcggggaccugcccguguggcuggcccacaagguggcgagcgagggcaucaaguacaccgaccggaaguggugcuucgacggggagcgcaacaaccagauccucgaggagaacauggacgucgagaucuggacgaaggagggcgagcggaagaagcugcgcccgcgcuggcuggacgcccggaccuacuccgacccccucgcccugaaggaguucaaggacuucgccgccggccgcaagagcaucgcgcuggaccucgugaccgagaucgggcgggugcccucccaccuggccuaccgcacccggaacgcccuggacaaccucgucaugcugcacacgagcgagcacggcgggcgcgccuaccggcacgccguggaggagcugccggagaccauggagacccuccugcugcucggccugaugauccugcucaccgggggcgcgaugcuguuccugaucagcggcaaggggaucggcaagacguccaucgggcucaucugcgugaucgucagcuccggcaugcuguggauggccgacgugccccugcaguggaucgccagcgccaucauccucgaguucuucaugauggugcugcugauccccgagcccgagaagcagcgcaccccgcaggacaaccagcucgccuacgucgugaucgggauccugacccuggcggccaucguggccgccaacgagaugggccuccuggagaccacgaagcgggaccugggcauguccaaggagcccggggucgugagccccaccuccuaccucgacguggaccugcaccccgccagcgcguggacccuguacgccgucgccaccacggugaucaccccgaugcuccgccacaccaucgagaacuccaccgccaacgugagccuggcggccaucgccaaccaggccgucgugcugaugggccucgacaagggguggcccaucuccaagauggaccugggcgugccccugcucgcccuggggugcuacagccaggucaacccccugacgcucaccgcggccgugcugcugcucgugacccacuacgccaucaucggcccgggccugcaggccaaggccacccgggaggcgcagaagcgcacggccgccgggaucaugaagaaccccaccgucgacggcaucaugaccaucgaccuggaccccgugaucuacgacuccaaguucgagaagcagcucggccaggugaugcugcugguccucugcgccgugcagcugcugcucaugcggaccagcugggcccugugcgaggcgcugacgcucgccaccggccccaucaccacccugugggagggcuccccggggaaguucuggaacacgaccaucgccgugagcauggccaacaucuuccgcggcuccuaccuggcgggggccggccucgccuucagcaucaugaaguccgucgggaccggccggcgcggcaccgggagccagggcgagacgcugggggagaaguggaagaagaagcugaaccagcucagccggaaggaguucgaccuguacaagaaguccggcaucaccgagguggaccgcaccgaggccaaggaggggcugaagcggggcgagaccacccaccacgccgugagccgcggcuccgcgaagcuccagugguucgucgagcggaacauggugauccccgaggggcgcgugaucgaccugggcugcgggcgcggcggguggagcuacuacugcgccggccugaagaaggucacggaggugcggggcuacaccaagggcgggcccgggcacgaggagcccgugccgauguccaccuacggcuggaaccucgucaagcugaugagcgggaaggacguguucuaccugccgcccgagaagugcgacacccugcucugcgacaucggcgaguccagccccuccccgacgguggaggagagccgcaccauccggguccugaagaugguggagcccuggcugaagaacaaccaguucugcaucaaggugcucaaccccuacaugcccaccgucaucgagcaccuggagcgccugcagcggaaguacggcgggaugcucgugcgcaacccgcugucccggaacagcacccacgagauguacuggaucuccaacggcacggggaacaucgugagcuccgucaacauggugagccgccugcuccugaaccgguucaccaugacccaccgccggcccaccaucgagaaggacgucgaccugggcgccggcacgcgccacgugaacgccgagcccgagaccccgaacauggacgugaucggggagcggaucaagcgcaucaaggaggagcacuccagcaccuggcacuacgacgacgagaaccccuacaagaccugggccuaccacggcuccuacgaggucaaggcgacggggagcgccagcuccaugaucaacggcguggugaagcuccugaccaagcccugggacgucgugcccauggugacccagauggccaugaccgacacgaccccguucgggcagcagcgggucuucaaggagaagguggacacccgcacgccccggcccaugcccggcacgcgcaaggugauggagaucaccgccgaguggcuguggcggacccucggccgcaacaagaagccgcgccugugcacccgggaggaguucacgaagaagguccgcaccaacgccgcgaugggggccguguucaccgaggagaaccagugggacagcgcccgggccgcgguggaggacgaggaguucuggaagcuggucgaccgcgagcggaagcuccacaagcugggcaagugcggguccugcguguacaacaugaugggcaagcgcgagaagaagcugggggaguucggcaaggccaagggcagccgggccaucugguacauguggcucggggcccgcuaccuggaguucgaggcccugggcuuccucaacgaggaccacugguucucccgggagaacagcuacuccgggguggagggcgaggggcugcacaagcugggcuacauccuccgcgacaucagcaagauccccggcggggcgauguacgccgacgacaccgccggcugggacacgcggaucaccgaggacgaccugcacaacgaggagaagaucacccagcagauggaccccgagcaccgccagcuggccaacgccaucuucaagcucaccuaccagaacaaggucgugaaggugcagcggcccacgccgaaggggaccgucauggacaucaucucccgcaaggaccagcggggcagcggccagguggggaccuacggccugaacaccuucaccaacauggaggcgcagcuggugcgccagauggagggggagggcguccucuccaaggccgaccuggagaacccccaccuccucgagaagaagaucacgcaguggcuggagaccaaggggguggagcggcugaagcgcauggccaucagcggcgacgacugcguggucaagcccaucgacgaccgguucgccaacgcccuccuggcgcugaacgacaugggcaaggugcgcaaggacaucccccaguggcagccguccaagggguggcacgacuggcagcagguccccuucugcagccaccacuuccacgagcucaucaugaaggacggccggaagcuggucgugcccugccgcccccaggacgagcugaucgggcgcgcccggaucucccagggcgccggguggagccucaaggagaccgccugccugggcaaggccuacgcgcagauguggucccugauguacuuccaccgccgggaccuccgccuggccagcaacgccaucugcuccgccgugccgguccacuggauccccaccagccggacgaccuggagcauccacgcgcaccaccaguggaugaccaccgaggacaugcugacgguguggaaccgcguguggaucgaggacaaccccuggauggaggacaagacccccgucaccaccugggaggacgugccguaccucggcaagcgggaggaccaguggugcgggucccugaucggccugacgagccgcgccaccugggcccagaacauccucaccgccauccagcagguccggucccugaucggggacgaggaguuccuggacuacaugcccagcaugaagcgcuuccggaaggaggaggaguccgagggcgccaucugguga

SEQ ID NO: 10313 - RNA, 9873 nt, Artificial Sequence
  derived and/or modified CDS sequence (opt1) from DENV-3__FJ562099__SS-prME
accagccugugccucaugaugaugcugcccgccacccuggccuuccaccucaccagccgggacggcgagccgcggaugaucguggggaagaacgagcggggcaagagccugcuguucaagaccgcguccgggaucaacaugugcacccucaucgccauggaccugggcgagaugugcgacgacaccgucacguacaagugcccccugaucgccgagguggagcccgaggacaucgacugcuggugcaaccucaccagcaccugggugaccuacgggacgugcaaccaggccggcgagcaccggcgggacaagcgguccgucgcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgugugcaagcacaccuacgucgaccggggguggggcaacgggugcggccuguucgggaagggcucccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccagcaccguggaggccgugcugcccgaguacggcacccucgggcuggagugcuccccgcgcaccggccuggacuucaacgagaugauccuccugaccaugaagaacaaggcguggaugguccaccggcagugguucuucgaccugccccuccccuggacgagcggcgccaccaccgagacccccacguggaaccgcaaggagcugcuggugaccuucaagaacgcccacgccaagaagcaggagguggucgugcucgggucccaggagggcgccaugcacaccgcgcugaccggggccacggagauccagaacagcggcgggaccuccaucuucgccggccaccugaagugccggcucaagauggacaagcuggagcugaagggcaugagcuacgccaugugccucaacaccuucgugcugaagaaggaggucuccgagacccagcacgggacgauccugaucaagguggaguacaagggcgaggacgccccgugcaagauccccuucagcaccgaggacgggcagggcaaggcgcacaacggccgccugaucaccgccaaccccguggucaccaagaaggaggagcccgugaacaucgaggccgagccgcccuucggggagagcaacaucgugaucggcaucggggacaaggcccucaagaucaacugguacaagaagggcuccagcaucgggaagauguucgaggcgacggcccggggcgcccgccggauggccauccugggcgacaccgccugggacuucggguccgucggcggggugcugaacagccucggcaagauggugcaccagaucuucggguccgcguacaccgcccuguucagcggcgucuccuggaucaugaagaucggcaucggggugcugcucaccuggaucggccugaacagcaagaacacguccaugagcuucuccugcaucgugaucgggaucaucacccuguaccucggcgccgucgugcaggccgacauggggugcgugaucaacuggaagggcaaggagcugaagugcggcagcgggaucuucgucaccaacgaggugcacaccuggacggagcaguacaaguuccaggccgacucccccaagcgccuggcgaccgccaucgccggcgccugggagaacggggugugcggcauccgcagcaccacccggauggagaaccuccuguggaagcagaucgccaacgagcugaacuacauccucugggagaacaacaucaagcugacggucguggugggggacaucaucggcguccuggagcagggcaagcgcacccucacgccccagccgauggagcugaaguacuccuggaagaccugggggaaggcgaagaucgugacggccgagacccagaacagcuccuucaucaucgacggccccaacacccccgagugccccagcgccucccgggccuggaacgugugggaggucgaggacuacggguucggcguguucaccacgaacaucuggcugaagcuccgcgagguguacacccagagcugcgaccaccggcugaugagcgcggccaucaaggacgagcgcgccguccacgccgacaugggcuacuggaucgagucccagaagaacgggagcuggaagcuggagaaggccuccuucaucgaggugaagaccugcaccuggcccaagagccacacccucugguccaacggcgugcuggagagcgacaugaucauccccaagucccuggcggggcccaucagccagcacaaccaccggccgggcuaccacacgcagaccgccgggcccuggcaccucggcaagcuggagcuggacuucaacuacugcgagggcaccaccgucgugaucacggagaacugcgggacccgcggccccucccuccggaccaccacggugagcgggaagcugauccacgaguggugcugccgcuccugcacccugcccccgcuccgguacaugggcgaggacgggugcugguacggcauggagauccgccccaucaacgagaaggaggagaacauggucaagagccugguguccgccggcagcgggaagguggacaacuucaccaugggcguccugugccucgccauccuguucgaggaggugaugcgggggaaguucggcaagaagcacaugaucgccggggugcuguucaccuucguccuccugcuguccggccagaucacguggcgcgacauggcgcacacccucaucaugaucggcagcaacgccuccgaccggauggggaugggcgugaccuaccuggcccugaucgccaccuucaagauccagcccuuccucgcccugggguucuuccugcgcaagcucacgagccgggagaaccugcugcucggcgugggccuggcgauggccaccacccugcagcuccccgaggacaucgagcagauggccaacgggaucgcccugggccugaugacccucaagcugaucacgcaguucgagaccuaccagcuguggaccgcgcucgucagccugaccugcuccaacacgaucuucacccugaccguggccuggcgcaccgccacgcucauccuggccggggucagccugcucccgcugugccaguccagcuccaugcggaagaccgacuggcugcccaugaccguggccgcgaugggcgugccgccccugccgcuguucaucuucagccugaaggacacccccaagcgccgcuccuggccccucaacgagggggucauggccgugggccuggugagcauccuggccuccagccuccugcggaacgacguccccauggccggcccgcugguggccgggggccuccugaucgcgugcuacgugaucacggggaccuccgccgaccugaccgucgagaaggccgccgacgugaccugggaggaggaggccgagcagacgggcgugagccacaaccucaugaucaccgucgacgacgacgggaccaugcgcaucaaggacgacgagaccgagaacauccugaccgugcugcucaagacggcgcugcugaucguguccggcgucuuccccuacagcauccccgccacccuccugguguggcacaccuggcagaagcagacccagcgguccggcgugcugugggacguccccagcccgcccgagacgcagaaggccgagcucgaggaggggguguaccgcaucaagcagcagggcaucuucgggaagacccaggugggcgucggggugcagaaggagggcguguuccacaccauguggcacgucacccggggcgccgugcugacgcacaacgggaagcgccuggagcccaacugggccuccgugaagaaggaccucaucagcuacggcgggggcuggcggcuguccgcgcaguggcagaagggggaggagguccaggugaucgccguggagcccggcaagaacccgaagaacuuccagaccaugcccggcaucuuccagaccaccacgggggagaucggcgccaucgcccuggacuucaagcccgggaccagcggcagcccgaucaucaaccgcgagggcaaggucguggggcuguacggcaacgggguggucaccaagaacggcggguacguguccggcaucgcgcagaccaacgccgagcccgacggccccacgcccgagcucgaggaggagauguucaagaagcggaaccugaccaucauggaccugcacccggggagcggcaagacccgcaaguaccuccccgccaucgugcgggaggccaucaagcgccggcugcgcacccugauccucgcccccacgcgggucguggcggccgagauggaggaggcccugaaggggcugcccauccgcuaccagaccaccgccaccaaguccgagcacacgggccgggagaucguggaccucaugugccacgccaccuucaccaugcgccugcugagcccgguccgggugcccaacuacaaccucaucaucauggacgaggcgcacuucaccgaccccgccuccaucgccgcccgcggguacaucagcacgcgggugggcaugggcgaggccgcggccaucuucaugaccgccacgccgcccgggaccgccgaggcguucccccaguccaacgcccccauccaggacgaggagcgcgacauccccgagcgcagcuggaacuccggcaacgaguggaucacggacuucgucgggaagaccgugugguucgugcccagcaucaaggccggcaacgacaucgccaacugccugcggaagaacgggaagaaggucauccagcugucccgcaagaccuucgacaccgaguaccagaagacgaagcucaacgacugggacuucguggugaccaccgacaucagcgagaugggcgccaacuucaaggcggaccgggucaucgacccccgccggugccugaagcccgugauccugaccgacggccccgagcgcgugauccucgccgggccgaugcccgucacggccgccuccgccgcgcagcggcgcggccggguggggcgcaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgggagaaguccgccgcgaucgacggcgaguaccgccugaagggcgagucccggaagaccuucgucgagcucaugcgccgcggggaccugcccguguggcuggcccacaagguggccagcgagggcaucaaguacacggaccgcaaguggugcuucgacggggagcggaacaaccagauccucgaggagaacauggacgucgagaucuggaccaaggagggcgagcgcaagaagcugcggccgcgcuggcuggacgcccgcaccuacuccgacccccucgcgcugaaggaguucaaggacuucgccgccggccgcaagagcaucgcccuggaccucgugaccgagaucgggcgcgugcccucccaccuggccuaccggacgcgcaacgcgcuggacaaccucgucaugcugcacaccagcgagcacggcgggcgggccuaccgccacgccguggaggagcugccggagaccauggagacccuccugcugcucggccugaugauccugcucaccggcggggccaugcuguuccugaucagcgggaaggggaucggcaagaccuccaucgggcucaucugcgugaucgucagcuccggcaugcuguggauggccgacgugccccugcaguggaucgcgagcgccaucgugcucgaguucuucaugaugguccugcugauccccgagcccgagaagcagcggaccccgcaggacaaccagcucgccuacguggugaucgggauccugacccuggccgccaucgucgcggccaacgagaugggccuccuggagacgaccaagcgcgaccugggcauguccaaggagcccgggguggugagccccaccuccuaccucgacgucgaccugcaccccgccagcgccuggacccuguacgccguggcgacgaccgugaucaccccgaugcuccggcacaccaucgagaacuccacggccaacgucagccuggccgccaucgcgaaccaggccguggugcugaugggccucgacaagggguggcccaucuccaagauggaccugggcgucccccugcucgcccuggggugcuacagccaggugaacccccugacccucaccgccgccgugcugcugcucgucacccacuacgcgaucaucggcccgggccugcaggccaaggccacgcgcgaggcccagaagcggaccgccgcggggaucaugaagaaccccaccguggacggcaucaugaccaucgaccuggaccccgugaucuacgacuccaaguucgagaagcagcucgggcaggucaugcugcuggugcucugcgccgugcagcugcugcucaugcgcacgagcugggcccugugcgaggcccugacccucgccaccggccccaucaccacgcugugggagggcuccccggggaaguucuggaacaccaccaucgcggucagcauggccaacaucuuccggggcuccuaccuggccggggccggccucgcguucagcaucaugaaguccguggggaccggccgccggggcacggggagccagggcgagacccugggggagaaguggaagaagaagcugaaccagcucagccgcaaggaguucgaccuguacaagaaguccggcaucaccgagguggaccggaccgaggccaaggaggggcugaagcgcggcgagaccacgcaccacgccgucagccggggcuccgccaagcuccagugguucguggagcgcaacauggugauccccgaggggcgggucaucgaccugggcugcgggcgcggcggguggagcuacuacugcgccggccugaagaaggugaccgaggugcgcggcuacaccaagggcggccccgggcacgaggagcccgucccgauguccaccuacggcuggaacaucgugaagcucaugagcgggaaggacguguucuaccugccgcccgagaagugcgacacgcugcugugcgacaucggcgaguccagccccuccccgaccgucgaggagagccggaccauccgcgugcucaagaugguggagcccuggcugaagaacaaccaguucugcaucaagguccugaaccccuacaugcccaccgugaucgagcaccucgagcggcugcagcgcaaguacggcgggaugcuggugcggaacccgcucucccgcaacagcacgcacgagauguacuggaucuccaacggcaccgggaacaucgucagcuccgugaacauggucagccggcugcugcucaaccgcuucaccaugacccaccggcgccccacgaucgagaaggacguggaccugggcgcgggcacccggcacgugaacgccgagcccgagaccccgaacauggacgucaucggggagcgcaucaagcggaucaaggaggagcacuccagcaccuggcacuacgacgacgagaaccccuacaagacgugggccuaccacggcuccuacgaggugaaggccaccgggagcgccagcuccaugaucaacggcguggucaagcugcucaccaagcccugggacguggugcccauggucacccagauggcgaugacggacaccaccccguucgggcagcagcgcguguucaaggagaagguggacacccggacgccccgccccaugcccggcacccggaaggucauggagaucaccgccgaguggcuguggcgcacccugggccggaacaagaagccgcgccucugcacgcgcgaggaguucaccaagaaggugcggaccaacgccgccaugggggccguguucaccgaggagaaccagugggacagcgcgcgcgccgccgucgaggacgaggaguucuggaagcugguggaccgggagcgcgagcugcacaagcucggcaagugcggguccugcguguacaacaugaugggcaagcgggagaagaagcugggggaguucggcaaggccaagggcagccgcgcgaucugguacauguggcugggggcccgguaccucgaguucgaggcccugggcuuccugaacgaggaccacugguucucccgcgagaacagcuacuccggggucgagggcgaggggcuccacaagcugggcuacauccugcgggacaucagcaagauccccggcggggccauguacgccgacgacacggcgggcugggacacccgcaucaccgaggacgaccuccacaacgaggagaagaucacccagcagauggaccccgagcaccggcagcuggccaacgccaucuucaagcugacguaccagaacaagguggugaagguccagcgccccaccccgaaggggaccgugauggacaucaucucccggaaggaccagcgcggcagcggccagguggggaccuacggccucaacaccuucacgaacauggaggcccagcugguccggcagauggagggggagggcgugcuguccaaggccgaccucgagaacccccaccuccuggagaagaagaucacccaguggcucgagaccaaggggguggagcgccugaagcggauggcgaucagcggcgacgacugcgucgugaagcccaucgacgaccgcuucgccaacgcccugcucgcccugaacgacaugggcaaggugcggaaggacaucccccaguggcagccguccaagggguggcacgacuggcagcagguccccuucugcagccaccacuuccacgagcugaucaugaaggacggccgcaagcucguggugcccugccggccccaggacgagcugaucgggcgcgcccgcaucucccagggcgcgggguggagccugaaggagaccgccugccucggcaaggccuacgcccagauguggucccugauguacuuccaccggcgcgaccugcggcucgccagcaacgcgaucugcuccgccgucccggugcacuggauccccacgagccgcaccaccuggagcauccacgcccaccaccaguggaugaccacggaggacaugcugaccguguggaaccgggucuggaucgaggacaaccccuggauggaggacaagacccccgugaccacgugggaggacgugccguaccugggcaagcgcgaggaccaguggugcgggucccucaucggccugaccagccgggccaccugggcgcagaacauccugaccgccauccagcagguccgcucccucaucggggacgaggaguuccuggacuacaugcccagcaugaagcgguuccgcaaggaggaggaguccgagggcgccaucugguga

SEQ ID NO: 10314 - RNA, 9873 nt, Artificial Sequence
  derived and/or modified CDS sequence (opt1) from DENV-3__KF955457__SS-prME
accagccugugccucaugaugaugcugcccgccacccuggccuuccaccucaccagccgcgacggcgagccccggaugaucguggggaagaacgagcgcggcaagagccugcuguucaagaccgcgagcgggaucaacaugugcacccucaucgccauggaccugggcgagaugugcgacgacaccgucacguacaagugcccccugaucgccgagguggagcccgaggacaucgacugcuggugcaaccucaccagcaccugggugaccuacgggacgugcaaccaggccggcgagcaccggcgcgacaagcgguccgucgcccuggcgccccacgugggcauggggcuggacacccgcacccagaccuggaugagcgccgagggcgccuggcggcaggucgagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgugugcaagcacaccuacgucgaccggggguggggcaacgggugcggccuguucgggaagggcucccuggugaccugcgccaaguuccagugccucgagcccaucgagggcaaggugguccaguacgagaaccugaaguacaccgugaucaucacggugcacaccggggaccagcaccaggucggcaacgacacccagggggccaccguggagaucacgccccaggccagcaccgucgaggcggugcugcccgaguacggcacccucgggcuggagugcuccccgcgcaccggccuggacuucaacgagaugauccuccugaccaugaagaacaaggccuggauggugcaccggcagugguucuucgaccugccccuccccuggacgagcggcgccaccaccgagacccccacguggaaccgcaaggagcugcuggucaccuucaagaacgcccacgccaagaagcaggagguggugguccucgggucccaggagggcgcgaugcacaccgcccugaccggggccacggagauccagaacagcggcgggaccuccaucuucgccggccaccugaagugccggcucaagauggacaagcuggagcugaagggcaugagcuacgccaugugccucaacaccuucgugcugaagaaggagguguccgagacccagcacgggacgauccugaucaaggucgaguacaagggcgaggacgcgccgugcaagauccccuucagcaccgaggacgggcagggcaaggcccacaacggccgccugaucaccgccaaccccguggugaccaagaaggaggagcccgucaacaucgaggccgagccgcccuucggggagagcaacaucgugaucggcaucggggacaaggcgcucaagaucaacugguacaagaagggcuccagcaucgggaagauguucgaggccacggcccggggcgcccgccggauggccauccugggcgacaccgcgugggacuucggguccgugggcgggguccugaacagccucggcaagauggugcaccagaucuucggguccgccuacaccgcccuguucagcggcguguccuggaucaugaagaucggcaucgggguccugcucaccuggaucggccugaacagcaagaacacguccaugagcuucuccugcaucgugaucgggaucaucacccuguaccucggcgccgugguccaggccgacauggggugcgcgaucaacuggaagggcaaggagcugaagugcggcagcgggaucuucgugaccaacgaggugcacaccuggacggagcaguacaaguuccaggccgacucccccaagcgccuggccaccgccaucgccggcgcgugggagaacggggucugcggcauccgcagcaccacccggauggagaaccuccuguggaagcagaucgccaacgagcugaacuacauccucugggagaacaacaucaagcugacggugguggucggggacaucaucggcgugcuggagcagggcaagcgcacccucacgccccagccgauggagcugaaguacuccuggaagaccugggggaaggccaagaucgugacggccgagacccagaacuucagcuucaucaucgacggccccaacacccccgagugccccuccgcgagccgggccuggaacgucugggagguggaggacuacggguucggcguguucaccacgaacaucuggcugaagcuccgcgaggucuacacccaguccugcgaccaccggcugaugagcgccgccaucaaggacgagcgcgccgugcacgcggacaugggcuacuggaucgagagccagaagaacggguccuggaagcuggagaaggccagcuucaucgaggugaagaccugcaccuggccgaagucccacacccucuggagcaacggcguccuggaguccgacaugaucauccccaagagccuggccgggcccaucucccagcacaaccaccggccgggcuaccacacgcagaccgccgggcccuggcaccucggcaagcuggagcuggacuucaacuacugcgagggcaccaccguggugaucacggaggacugcgggacccgcggccccagccuccggaccaccacggucuccgggaagcugauccacgaguggugcugccgcagcugcacccugcccccgcuccgguacaugggcgaggacgggugcugguacggcauggagauccgccccaucaacgagaaggaggagaacauggugaagucccuggugagcgccggcuccgggaaggucgacaacuucaccaugggcgugcugugccucgcgauccuguucgaggaggugaugcgggggaaguucggcaagaagcacaugaucgccgggguccuguucaccuucgugcuccugcugagcggccagaucacguggcgcgacauggcccacacccucaucaugaucggcuccaacgccagcgaccggauggggaugggcgugaccuaccuggcccugaucgcgaccuucaagauccagcccuuccucgcccugggguucuuccugcgcaagcucacgucccgggagaaccugcugcucggcgucggccuggccauggccaccacccugcagcuccccgaggacaucgagcagauggcgaacgggaucgcccugggccugaugacccucaagcugaucacgcaguucgagaccuaccagcuguggaccgcccucgugagccugaccugcagcaacacgaucuucacccugaccguggccuggcgcaccgccacgcucauccuggcgggggucucccugcucccgcugugccagagcuccagcaugcggaagaccgacuggcugcccaugaccguggccgccaugggcgugccgccccugccgcuguucaucuucucccugaaggacacccccaagcgccgcagcuggccccucaacgagggggugauggccgugggccuggucuccauccuggccagcucccuccugcggaacgacgugcccauggcgggcccgcugguggccgggggccuccugaucgccugcuacgucaucacggggaccagcgccgaccugaccguggagaaggccgcggacgugaccugggaggaggaggccgagcagacgggcgucucccacaaccucaugaucaccguggacgacgacgggaccaugcgcaucaaggacgacgagaccgagaacauccugaccgugcugcucaagacggcccugcugaucgucagcggcaucuuccccuacuccauccccgccacccuccugguguggcacaccuggcagaagcagacccagcggagcggcgugcugugggacguccccuccccgcccgagacgcagaaggccgagcucgaggaggggguguaccgcaucaagcagcagggcaucuucgggaagacccaggugggcgucggggugcagaaggagggcguguuccacaccauguggcacgucacccggggcgcggugcugacgcacaacgggaagcgccuggagcccaacugggccagcgugaagaaggaccucaucuccuacggcgggggcuggcggcugagcgcccaguggcagaagggggaggagguccaggugaucgccguggagcccggcaagaacccgaagaacuuccagaccaugcccggcaucuuccagaccaccacgggggagaucggcgcgaucgcccuggacuucaagcccgggaccuccggcagcccgaucaucaaccgcgagggcaaggucguggggcuguacggcaacgggguggucaccaagaacggcggguacgugagcggcaucgcccagaccaacgccgagcccgacggccccacgcccgagcucgaggaggagauguucaagaagcggaaccugaccaucauggaccugcacccgggguccggcaagacccgcaaguaccuccccgccaucgugcgggaggcgaucaagcgccggcugcgcacccugauccucgcccccacgcgggucguggccgccgagauggaggaggcccugaaggggcugcccauccgcuaccagaccaccgcgaccaagagcgagcacacgggccgggagaucguggaccucaugugccacgccaccuucaccaugcgccugcuguccccgguccgggugcccaacuacaaccucaucaucauggacgaggcccacuucaccgaccccgccagcaucgccgcgcgcggguacaucuccacgcgggugggcaugggcgaggccgccgccaucuucaugaccgcgacgccgcccgggaccgccgaggccuucccccagagcaacgcccccauccaggacgaggagcgcgacauccccgagcgcuccuggaacagcggcaacgaguggaucacggacuucgucgggaagaccgugugguucgugcccuccaucaaggccggcaacgacaucgcgaacugccugcggaagaacgggaagaaggucauccagcugagccgcaagaccuucgacaccgaguaccagaagacgcggcucaacgacugggacuucguggugaccaccgacaucuccgagaugggcgccaacuucaaggccgaccgcgucaucgacccccggcgcugccugaagcccgugauccugaccgacggccccgagcgggugauccucgccgggccgaugcccgucacggccgcgagcgccgcccagcgccggggccgcguggggcggaacccccagaaggagaacgaccaguacaucuucaccggccagccccugaacaacgacgaggaccacgcccacuggaccgaggccaagaugcugcucgacaacaucaacaccccggaggggaucauccccgcgcuguucgagcccgagcgcgagaaguccgccgccaucgacggcgaguaccggcugaagggcgagagccgcaagaccuucguggagcucaugcggcgcggggaccugcccgucuggcuggcccacaagguggcguccgagggcaucaaguacacggaccggaaguggugcuucgacggggagcgcaacaaccagauccucgaggagaacauggacgucgagaucuggaccaaggagggcgagcggaagaagcugcgcccgcgcuggcuggacgcccggaccuacagcgacccccucgcccugaaggaguucaaggacuucgccgccggccgcaaguccaucgcgcuggaccucgugaccgagaucgggcgggugcccagccaccuggccuaccgcacgcggaacgcccuggacaaccucgucaugcugcacaccuccgagcacggcgggcgcgccuaccggcacgccguggaggagcugccggagaccauggagacccuccugcugcucggccugaugauccugcucaccggcggggcgaugcuguuccugaucagcgggaaggggaucggcaagaccagcaucgggcucaucugcgugaucgucuccagcggcaugcuguggauggccgacgugccccugcaguggaucgccuccgccaucgugcucgaguucuucaugaugguccugcugauccccgagcccgagaagcagcgcaccccgcaggacaaccagcucgccuacguggugaucgggauccugacccuggcggccaucgucgccgccaacgagaugggccuccuggagacgaccaagcgggaccugggcaugagcaaggagcccgggguggugucccccaccagcuaccucgacgucgaccugcaccccgccuccgcguggacccuguacgccguggccacgaccgugaucaccccgaugcuccgccacaccaucgagaacagcacggccaacgucucccuggcggccaucgccaaccaggccguggugcugaugggccucgacaagggguggcccaucagcaagauggaccugggcgucccccugcucgcccuggggugcuacucccaggugaacccccugacccucaccgcggccgugcugcugcucgucacccacuacgccaucaucggcccgggccugcaggccaaggccacgcgggaggcgcagaagcgcaccgccgccgggaucaugaagaaccccaccguggacggcaucaugaccaucgaccuggaccccgugaucuacgacagcaaguucgagaagcagcucgggcaggucaugcugcuggugcucugcgccgugcagcugcugcucaugcggacguccugggcccugugcgaggcgcugacccucgccaccggccccaucaccacgcugugggagggcagcccggggaaguucuggaacaccaccaucgccgucuccauggccaacaucuuccgcggcagcuaccuggcgggggccggccucgccuucuccaucaugaaguccguggggaccggccggcgcggcacggggucccagggcgagacccugggggagaaguggaagaagaagcugaaccagcucagccggaaggaguucgaccuguacaagaaguccggcaucaccgagguggaccgcaccgaggccaaggaggggcugaagcggggcgagaccacgcaccacgccgucucccgcggcagcgcgaagcuccagugguucguggaccggaacauggugauccccgaggggcgcgucaucgaccugggcugcgggcgcggcgggugguccuacuacugcgccggccugaagaaggugaccgaggugcggggcuacaccaagggcggccccgggcacgaggagcccgucccgaugagcaccuacggcuggaaccucgugaagcugauguccgggaaggacguguucuaccugccgcccgagaagugcgacacgcugcucugcgacaucggcgagagcucccccagcccgaccgucgaggagucccgcaccauccgggugcugaagaugguggagcccuggcugaagaacaaccaguucugcaucaagguccucaaccccuacaugcccaccgugaucgagcaccuggagcgccugcagcggaaguacggcgggaugcucgugcgcaacccgcugagccggaacuccacgcacgagauguacuggaucagcaacggcaccgggaacaucgucuccagcgugaacauggugucccgccugcuccugaaccgguucaccaugacccaccgccggcccacgaucgagaaggacgucgaccugggcgccggcacccgccacgugaacgccgagcccgagaccccgaacauggacgucaucggggagcggaucaagcgcaucaaggaggagcacagcuccaccuggcacuacgacgacgagaaccccuacaagacgugggccuaccacggcagcuacgaggugaaggcgaccggguccgccagcagcaugaucaacggcguggucaagcuccugaccaagcccugggacguggugcccauggucacccagauggccaugacggacaccaccccguucgggcagcagcggguguucaaggagaagguggacacccgcacgccccggcccaugcccggcacccgcaaggucauggagaucaccgccgaguggcuguggcggacccucggccgcaacaagaagccgcgccugugcacgcgggaggaguucaccaagaaggugcgcaccaacgccgcgaugggggccguguucaccgaggagaaccagugggacuccgcccgggccgcggucgaggacgaggaguucuggaagcugguggaccgcgagcgggagcuccacaagcugggcaagugcgggagcugcguguacaacaugaugggcaagcgcgagaagaagcugggggaguucggcaaggccaagggcucccgggccaucugguacauguggcucggggcccgcuaccuggaguucgaggcccugggcuuccucaacgaggaccacugguucagccgggagaacuccuacagcggggucgagggcgaggggcugcacaagcugggcuacauccuccgcgacaucuccaagauccccggcggggcgauguacgccgacgacacggccggcugggacacccggaucaccgaggacgaccugcacaacgaggagaagaucacccagcagauggaccccgagcaccgccagcuggccaacgccaucuucaagcucacguaccagaacaagguggugaagguccagcggcccaccccgaaggggaccgugauggacaucaucagccgcaaggaccagcggggcuccggccagguggggaccuacggccugaacaccuucacgaacauggaggcgcagcugguccgccagauggagggggagggcgugcucagcaaggccgaccuggagaacccccaccuccucgagaagaagaucacccaguggcuggagaccaaggggguggagcggcugaagcgcauggccaucuccggcgacgacugcgucgugaagcccaucgacgaccgguucgccaacgcccuccuggcgcugaacgacaugggcaaggugcgcaaggacaucccccaguggcagccgagcaagggguggcacgacuggcagcagguccccuucugcucccaccacuuccacgagcucaucaugaaggacggccggaagcugguggugcccugccgcccccaggacgagcugaucgggcgcgcccggaucagccagggcgccggguggucccucaaggagaccgccugccugggcaaggccuacgcgcagauguggagccugauguacuuccaccgccgggaccuccgccuggccuccaacgccaucugcagcgccgucccggugcacuggauccccacgucccggaccaccuggagcauccacgcgcaccaccaguggaugaccacggaggacaugcugaccguguggaaccgcgucuggaucgaggacaaccccuggauggaggacaagacccccgugaccacgugggaggacgugccguaccucggcaagcgggaggaccaguggugcgggagccugaucggccugaccucccgcgccaccugggcccagaacauccucaccgccauccagcagguccggagccugaucggggacgaggaguuccuggacuacaugcccuccaugaagcgcuuccggaaggaggaggagagcgagggcgccaucugguga

SEQ ID NO: 10315 - RNA, 9873 nt, Artificial Sequence
  derived and/or modified CDS sequence (opt1) from DENV-3__FJ562100__SS-prME
accagccugugccucaugaugaugcugcccgcgacccuggccuuccaccucaccagccgcgacggcgagccgcggaugaucguggggaagaacgagcgcggcaagagccugcuguucaagaccgcguccgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggacgugcaaccaggccggcgagcaccggcgcgacaagcgguccgucgcccuggcgccccacgugggcauggggcuggacacccgcacccagaccuggaugagcgccgagggcgccuggcggcaggucgagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgugugcaagcacaccuacgucgaccggggguggggcaacgggugcggccuguucgggaagggcucccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccagcaccguggaggccauccugcccgaguacggcacccucgggcuggagugcuccccgcgcaccggccuggacuucaacgagaugauccuccugaccaugaagaacaaggcguggauggugcaccggcagugguucuucgaccugccccuccccuggacgagcggcgccaccaccgagacccccacguggaaccgcaaggagcugcuggucaccuucaagaacgcccacgccaagaagcaggagguggugguccucgggucccaggagggcgccaugcacaccgcgcugaccggggccacggagauccagaacagcggcgggaccuccaucuucgccggccaccugaagugccggcucaagauggacaagcuggagcugaagggcaugagcuacgccaugugccucaacaccuucgugcugaagaaggagguguccgagacccagcacgggacgauccugaucaaggucgaguacaagggcgaggacgccccgugcaagauccccuucagcaccgaggacgggcagggcaaggcgcacaacggccgccugaucaccgccaaccccguggugaccaagaaggaggagcccgucaacaucgaggccgagccgcccuucggggagagcaacaucgugaucggcaucggggacaaggcccucaagaucaacugguacaagaagggcuccagcaucgggaagauguucgaggcgacggcccggggcgcccgccggauggccauccugggcgacaccgccugggacuucggguccgugggcgggguccugaacagccucggcaagauggugcaccagaucuucggguccgcguacaccgcccuguucagcggcguguccuggaucaugaagaucggcaucgggguccugcucaccuggaucggccugaacagcaagaacacguccaugagcuucuccugcaucgugaucgggaucaucacccuguaccucggcgccgugguccaggccgacauggggugcgccaucaacuggaagggcaaggagcugaagugcggcagcgggaucuucgugaccaacgaggugcacaccuggacggagcaguacaaguuccaggcggacucccccaagcgccuggccaccgccaucgccggcgccugggagaacggggucugcggcauccgcagcaccacccggauggagaaccuccuguggaagcagaucgcgaacgagcugaacuacauccucugggagaacaacaucaagcugacggugguggucggggacaucaucggcgugcuggagcagggcaagcgcacccucacgccccagccgauggagcugaaguacuccuggaagaccugggggaaggccaagaucgugacggccgagacccagaacagcuccuucaucaucgacggccccaacacccccgagugccccagcgccucccgggcguggaacgucugggagguggaggacuacggguucggcguguucaccacgaacaucuggcugaagcuccgcgaggucuacacccagagcugcgaccaccggcugaugagcgccgccaucaaggacgagcgcgccgugcacgccgacaugggcuacuggaucgagucccagaagaacgggagcuggaagcuggagaaggcguccuucaucgaggugaagaccugcaccuggcccaagagccacacccucugguccaacggcguccuggagagcgacaugaucauccccaagucccuggccgggcccaucagccagcacaaccaccggccgggcuaccacacgcagaccgccgggcccuggcaccucggcaagcuggagcuggacuucaacuacugcgagggcaccaccguggugaucacggagaacugcgggacccgcggccccucccuccggaccaccacggucagcgggaagcugauccacgaguggugcugccgcuccugcacccugcccccgcuccgguacaugggcgaggacgggugcugguacggcauggagauccgccccaucaacgagaaggaggagaacauggucaagagccugguguccgccggcagcgggaaggucgacaacuucaccaugggcgugcugugccucgccauccuguucgaggaggugaugcgggggaaguucggcaagaagcacaugaucgcggggguccuguucaccuucgugcuccugcuguccggccagaucacguggcgcgacauggcccacacccucaucaugaucggcagcaacgccuccgaccggauggggaugggcgugaccuaccuggcccugaucgccaccuucaagauccagcccuuccucgcgcugggguucuuccugcgcaagcucacgagccgggagaaccugcugcucggcgucggccuggccauggccaccacccugcagcuccccgaggacaucgagcagauggccaacgggaucgcgcugggccugaugacccucaagcugaucacgcaguucgagaccuaccagcuguggaccgcccucgugagccugaccugcuccaacacgaucuucacccugaccguggccuggcgcaccgccacgcucauccuggccggggucagccugcucccgcugugccaguccagcuccaugcggaagaccgacuggcugcccaugaccguggcggccaugggcgugccgccccugccgcuguucaucuucagccugaaggacacccccaagcgccgcuccuggccccucaacgagggggugauggccgugggccuggucagcauccuggccuccagccuccugcggaacgacgugcccauggccggcccgcugguggccggcgggcuccugaucgccugcuacgucaucacggggaccuccgccgaccugaccguggagaaggccgccgacgugaccugggaggaggaggcggagcagacgggggucagccacaaccucaugaucaccguggacgacgacgggaccaugcgcaucaaggacgacgagaccgagaacauccugaccgugcugcucaagacggcccugcugaucgucuccggcaucuuccccuacagcauccccgccacccuccugguguggcacaccuggcagaagcagacccagcgguccggcgugcugugggacguccccagcccgcccgagacgcagaaggccgagcucgaggaggggguguaccgcaucaagcagcagggcaucuucgggaagacccaggugggcgucggggugcagaaggagggcguguuccacaccauguggcacgucacccggggcgccgugcugacgcacaacgggaagcgccuggagcccaacugggcguccgugaagaaggaccucaucagcuacggcgggggcuggcggcuguccgcccaguggcagaagggggaggagguccaggugaucgccguggagcccggcaagaacccgaagaacuuccagaccaugcccggcaucuuccagaccaccacgggggagaucggcgccaucgcgcuggacuucaagcccgggaccagcggcagcccgaucaucaaccgcgagggcaaggucguggggcuguacggcaacgggguggucaccaagaacggcggguacguguccggcaucgcccagaccaacgccgagcccgacggccccacgcccgagcucgaggaggagauguucaagaagcggaaccugaccaucauggaccugcacccggggagcggcaagacccgcaaguaccuccccgccaucgugcgggaggccaucaagcgccggcugcgcacccugauccucgcgcccacgcgggucguggccgccgagauggaggaggcccugaaggggcugcccauccgcuaccagaccaccgccaccaaguccgagcacacgggccgggagaucguggaccucaugugccacgcgaccuucaccaugcgccugcugagcccgguccgggugcccaacuacaaccucaucaucauggacgaggcccacuucaccgaccccgccuccaucgccgcccgcggguacaucagcacgcgggugggcaugggcgaggcggccgccaucuucaugaccgccacgccgcccgggaccgcggaggccuucccccaguccaacgcccccauccaggacgaggagcgcgacauccccgagcgcagcuggaacuccggcaacgaguggaucacggacuucgucgggaagaccgugugguucgugcccagcaucaaggccggcaacgacaucgccaacugccugcggaagaacgggaagaaggucauccagcugucccgcaagaccuucgacaccgaguaccagaagacgcggcucaacgacugggacuucguggugaccaccgacaucagcgagaugggcgcgaacuucaaggccgaccgcgucaucgacccccggcgcugccugaagcccgugauccugaccgacggccccgagcgggugauccucgccgggccgaugcccgucacggccgccuccgcggcccagcgccggggccgcguggggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgcggccaucgacggcgaguaccggcugaagggcgagucccgcaagaccuucguggagcucaugcggcgcggggaccugcccgucuggcuggcccacaagguggccagcgagggcaucaaguacacggaccggaaguggugcuucgacggggagcgcaacaaccagauccucgaggagaacauggacgucgagaucuggaccaaggagggcgagcggaagaagcugcgcccgcgcuggcuggacgcgcggaccuacuccgacccccucgcccugaaggaguucaaggacuucgccgccggccgcaagagcaucgcccuggaccucgugaccgagaucgggcgggugcccucccaccuggcguaccgcacgcggaacgcccuggacaaccucgucaugcugcacaccagcgagcacggcgggcgcgccuaccggcacgccguggaggagcugccggagaccauggagacccuccugcugcucggccugaugauccugcucaccgggggcgccaugcuguuccugaucagcggcaaggggaucggcaagaccuccaucgggcucaucugcgugaccgucagcuccggcaugcuguggauggcggacgugccccugcaguggaucgccagcgccaucgugcucgaguucuucaugaugguccugcugauccccgagcccgagaagcagcgcaccccgcaggacaaccagcucgccuacguggugaucgggauccugacgcuggccgcgaucgucgccgccaacgagaugggccuccuggagaccaccaagcgggaccugggcauguccaaggagcccgggguggugagccccaccuccuaccucgacgucgaccugcaccccgccagcgccuggacgcuguacgcgguggccaccaccgugaucaccccgaugcuccgccacacgaucgagaacuccaccgccaacgucagccuggccgcgaucgccaaccaggccguggugcugaugggccucgacaagggguggcccaucuccaagauggaccugggcgucccccugcucgcccuggggugcuacagccaggugaacccccugacccucaccgccgcggugcugcugcucgucacgcacuacgccaucaucggcccgggccugcaggccaaggccacccgggaggcccagaagcgcaccgcggccgggaucaugaagaaccccaccguggacggcaucaugacgaucgaccuggaccccgugaucuacgacuccaaguucgagaagcagcucgggcaggucaugcugcuggugcucugcgccgugcagcugcugcucaugcggaccagcugggcccugugcgaggcccugacccucgcgaccggccccaucacgacccugugggagggcuccccggggaaguucuggaacaccaccaucgccgucagcauggccaacaucuuccgcggcuccuaccuggccggggcgggccucgccuucagcaucaugaaguccguggggacgggccggcgcggcaccgggagccagggcgagacccugggggagaaguggaagaagaagcugaaccagcucagccggaaggaguucgaccuguacaagaaguccggcaucaccgagguggaccgcaccgaggccaaggaggggcugaagcggggcgagacgacccaccacgccgucagccgcggcuccgccaagcuccagugguucguggagcggaacauggugauccccgaggggcgcgucaucgaccugggcugcgggcgcggcggguggagcuacuacugcgcgggccugaagaaggugaccgaggugcggggcuacaccaagggcggccccgggcacgaggagcccgucccgauguccacguacggcuggaaccucgugaagcugaugagcgggaaggacguguucuaccugccgcccgagaagugcgacacccugcucugcgacaucggcgaguccagccccuccccgaccgucgaggagagccgcaccauccgggugcugaagaugguggagcccuggcugaagaacaaccaguucugcaucaagguccucaaccccuacaugcccacggugaucgagcaccuggagcgccugcagcggaaguacggcgggaugcucgugcgcaacccgcugucccggaacagcacccacgagauguacuggaucuccaacggcaccgggaacaucgucagcuccgugaacauggugagccgccugcuccugaaccgguucaccaugacgcaccgccggcccaccaucgagaaggacgucgaccugggcgccggcacccgccacgugaacgccgagcccgagaccccgaacauggacgucaucggggagcggaucaagcgcaucaaggaggagcacuccagcacguggcacuacgacgacgagaaccccuacaagaccugggccuaccacggcuccuacgaggugaaggccaccgggagcgcgagcuccaugaucaacggcguggucaagcuccugaccaagcccugggacguggugcccauggucacgcagauggccaugaccgacaccaccccguucgggcagcagcggguguucaaggagaagguggacacgcgcacgccccggcccaugcccggcacccgcaaggucauggagaucaccgccgaguggcuguggcggacgcucggccgcaacaagaagccgcgccugugcacccgggaggaguucaccaagaaggugcgcaccaacgccgccaugggggcgguguucacggaggagaaccagugggacagcgcccgggccgccgucgaggacgaggaguucuggaagcugguggaccgcgagcgggagcuccacaagcugggcaagugcggguccugcguguacaacaugaugggcaagcgcgagaagaagcugggggaguucggcaaggcgaagggcagccgggccaucugguacauguggcucggggcccgcuaccuggaguucgaggcccugggcuuccucaacgaggaccacugguucucccgggagaacagcuacuccggggucgagggcgaggggcugcacaagcugggcuacauccuccgcgacaucagcaagauccccggcggggccauguacgcggacgacaccgccggcugggacacccggaucaccgaggacgaccugcacaacgaggagaagaucacgcagcagauggaccccgagcaccgccagcuggccaacgccaucuucaagcucaccuaccagaacaagguggugaagguccagcggcccaccccgaaggggaccgugauggacaucaucucccgcaaggaccagcggggcagcggccagguggggaccuacggccugaacacguucaccaacauggaggcccagcugguccgccagauggagggggagggcgugcucuccaaggcggaccuggagaacccccaccuccucgagaagaagaucacccaguggcuggagaccaaggggguggagcggcugaagcgcauggccaucagcggcgacgacugcgucgugaagcccaucgacgaccgguucgccaacgcccuccuggcccugaacgacaugggcaaggugcgcaaggacaucccccaguggcagccguccaagggguggcacgacuggcagcagguccccuucugcagccaccacuuccacgagcucaucaugaaggacggccggaagcugguggugcccugccgcccccaggacgagcugaucgggcgcgcgcggaucucccagggcgccggguggagccucaaggagacggccugccugggcaaggccuacgcccagauguggucccugauguacuuccaccgccgggaccuccgccuggcgagcaacgccaucugcuccgccgucccggugcacuggauccccaccagccggaccaccuggagcauccacgcccaccaccaguggaugacgaccgaggacaugcugaccguguggaaccgcgucuggaucgaggacaaccccuggauggaggacaagacccccgugacgaccugggaggacgugccguaccucggcaagcgggaggaccaguggugcgggucccugaucggccugaccagccgcgcgaccugggcccagaacauccucacggccauccagcagguccggucccugaucggggacgaggaguuccuggacuacaugcccagcaugaagcgcuuccggaaggaggaggaguccgagggcgccaucugguga

SEQ ID NO: 10316 - RNA, 9873 nt, Artificial Sequence
  derived and/or modified CDS sequence (opt1) from DENV-3__FJ547062__SS-prME
accagccugugccucaugaugaugcugcccgccacccuggccuuccaccucaccagccgggacggcgagccccggaugaucguggggaagaacgagcggggcaagagccugcuguucaagaccgcgagcgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggacgugcaaccaggccggcgagcaccggcgcgacaagcgguccgucgcccuggcgccccacgugggcauggggcuggacacccgcacccagaccuggaugagcgccgagggcgccuggcggcaggucgagaaggucgagacgugggcccuccgccacccgggguucaccauccuggcgcuguuccucgcccacuacaucuccaccagccugacccagaagguggugaucuucauccugcucaugcuggucacgcccuccaugaccaugcggugcgugggcguggggaaccgcgacuucgucgagggccugagcggcgccaccuggguggacgugguccucgagcacgggggcugcgugaccacgauggccaagaacaagcccacccuggacaucgagcugcagaagaccgaggccacccagcucgcgacgcugcggaagcugugcaucgaggggaagaucaccaacaucaccaccgacucccgcugccccacgcagggcgaggccauccucccggaggagcaggaccagaacuacgugugcaagcacaccuacgucgaccggggcugggggaacggcugcgggcuguucggcaaggggagccuggugaccugcgccaaguuccagugccucgagcccaucgagggcaaggugguccaguacgagaaccugaaguacaccgugaucaucacggugcacaccggcgaccagcaccaggucgggaacgacacccagggcgugaccgucgagaucacgccccaggccuccaccguggaggccauccugcccgaguacgggacccucggccuggagugcagcccgcgcaccgggcuggacuucaacgagaugauccuccugaccaugaagaacaaggcguggauggugcaccggcagugguucuucgaccugccccuccccuggacguccggcgccaccaccgagacccccacguggaaccgcaaggagcugcuggucaccuucaagaacgcccacgccaagaagcaggagguggugguccucggcagccaggagggggccaugcacaccgcgcugaccggcgccacggagauccagaacuccgggggcaccagcaucuucgccgggcaccugaagugccggcucaagauggacaagcuggagcugaagggcauguccuacgccaugugccucaacaccuucgugcugaagaaggaggugagcgagacccagcacggcacgauccugaucaaggucgaguacaagggggaggacgccccgugcaagauccccuucagcaccgaggacggccaggggaaggcgcacaacggccgccugaucaccgccaaccccguggugaccaagaaggaggagcccgucaacaucgaggccgagccgcccuucggcgaguccaacaucgugaucgggaucggcgacaaggcccucaagaucaacugguacaagaaggggagcuccaucggcaagauguucgaggcgacggcccgcggggcccgccggauggccauccugggcgacaccgccugggacuucggcagcgucgggggcguccugaacucccucgggaagauggugcaccagaucuucggcagcgcguacaccgcccuguucuccggggugagcuggaucaugaagaucggcaucggcguccugcucaccuggaucgggcugaacuccaagaacacgagcauguccuucagcugcaucgugaucggcaucaucacccuguaccucggggccgugguccaggccgacaugggcugcgccaucaacuggaaggggaaggagcugaagugcggcuccggcaucuucgugaccaacgaggugcacaccuggacggagcaguacaaguuccaggcggacagccccaagcgccuggccaccgccaucgccggggccugggagaacggcgucugcgggauccgcuccaccacccggauggagaaccuccuguggaagcagaucgcgaacgagcugaacuacauccucugggagaacaacaucaagcugacggugguggucggcgacaucaucggggugcuggagcagggcaagcgcacccucacgccccagccgauggagcugaaguacagcuggaagaccuggggcaaggccaagaucgugacggccgagacccagaacuccagcuucaucaucgacgggcccaacacccccgagugccccuccgccagccgggcguggaacgucugggagguggaggacuacggcuucgggguguucaccacgaacaucuggcugaagcuccgcgaggucuacacccagagcugcgaccaccggcugauguccgccgccaucaaggacgagcgcgccgugcacgccgacaugggcuacuggaucgagagccagaagaacggcuccuggaagcuggagaaggcgagcuucaucgaggugaagaccugcaccuggccgaagucccacacccucuggagcaacgggguccuggaguccgacaugaucauccccaagagccuggccggccccaucucccagcacaaccaccggccgggguaccacacgcagaccgccggccccuggcaccucgggaagcuggagcuggacuucaacuacugcgagggcaccaccguggugaucacggagaacugcggcacccgcgggcccagccuccggaccaccacggucuccggcaagcugauccacgaguggugcugccgcagcugcacccugcccccgcuccgguacaugggggaggacggcugcugguacgggauggagauccgccccaucaacgagaaggaggagaacauggugaagucccuggugagcgccggcuccggcaaggucgacaacuucaccaugggggugcugugccucgccauccuguucgaggaggugaugcggggcaaguucgggaagaagcacaugaucgcgggcguccuguucaccuucgugcuccugcugagcgggcagaucacguggcgcgacauggcccacacccucaucaugaucggcuccaacgccagcgaccggaugggcaugggggugaccuaccuggcccugaucgccaccuucaagauccagcccuuccucgcgcugggcuucuuccugcgcaagcucacgagccgggagaaccugcugcucggggucggccuggccauggccaccacccugcagcuccccgaggacaucgagcagauggccaacggcaucgcgcuggggcugaugacccucaagcugaucacgcaguucgagaccuaccagcuguggaccgcccucgugucccugaccugcagcaacacgaucuucacccugaccguggccuggcgcaccgccacgcucauccuggccggcgucucccugcucccgcugugccagagcuccagcaugcggaagaccgacuggcugcccaugaccguggcggccaugggggugccgccccugccgcuguucaucuucucccugaaggacacccccaagcgccgcagcuggccccucaacgagggcgugauggccguggggcuggucuccauccuggccagcucccuccugcggaacgacgugcccauggccggcccgcugguggcgggcgggcuccugaucgccugcuacgucaucacgggcaccagcgccgaccugaccguggagaaggccgccgacgugaccugggaggaggaggcggagcagacgggggucucccacaaccucaugaucaccguggacgacgacggcaccaugcgcaucaaggacgacgagaccgagaacauccugaccgugcugcucaagacggcccugcugaucgucagcgggaucuuccccuacuccauccccgccacccuccugguguggcacaccuggcagaagcagacccagcggagcggcgugcugugggacguccccuccccgcccgagacgcagaaggccgagcucgaggagggcguguaccgcaucaagcagcaggggaucuucggcaagacccaggugggggucggcgugcagaaggaggggguguuccacaccauguggcacgucacccggggcgccgugcugacgcacaacggcaagcgccuggagcccaacugggcgagcgugaagaaggaccucaucuccuacgggggcggguggcggcugagcgcccaguggcagaagggcgaggagguccaggugaucgccguggagcccgggaagaacccgaagaacuuccagaccaugcccggcaucuuccagaccaccacgggcgagaucggggccaucgcgcuggacuucaagcccggcaccagcggguccccgaucaucaaccgcgagggcaaggucgugggccuguacgggaacggcguggucaccaagaacgggggcuacgugagcgggaucgcccagaccaacgccgagcccgacggccccacgcccgagcucgaggaggagauguucaagaagcggaaccugaccaucauggaccugcacccgggcuccgggaagacccgcaaguaccuccccgccaucgugcgggaggccaucaagcgccggcugcgcacccugauccucgcgcccacgcgggucguggccgccgagauggaggaggcccugaagggccugcccauccgcuaccagaccaccgccaccaagagcgagcacacggggcgggagaucguggaccucaugugccacgcgaccuucaccaugcgccugcuguccccgguccgggugcccaacuacaaccucaucaucauggacgaggcccacuucaccgaccccgccagcaucgccgcccgcggcuacaucuccacgcggguggggaugggcgaggcggccgccaucuucaugaccgccacgccgcccggcaccgcggaggccuucccccagagcaacgcccccauccaggacgaggagcgcgacauccccgagcgcuccuggaacagcgggaacgaguggaucacggacuucgucggcaagaccgugugguucgugcccuccaucaaggccgggaacgacaucgccaacugccugcggaagaacggcaagaaggucauccagcugagccgcaagaccuucgacaccgaguaccagaagacgcggcucaacgacugggacuucguggugaccaccgacaucuccgagaugggggcgaacuucaaggccgaccgcgucaucgacccccggcgcugccugaagcccgugauccugaccgacggccccgagcgggugauccucgccggcccgaugcccgucacggccgccagcgcggcccagcgccgggggcgcgugggccggaacccccagaaggagaacgaccaguacaucuucaccgggcagccccugaacaacgacgaggaccacgcccacuggaccgaggccaagaugcugcucgacaacaucaacaccccggagggcaucauccccgcccuguucgagcccgagcgcgagaaguccgcggccaucgacggggaguaccggcugaagggcgagagccgcaagaccuucguggagcucaugcggcgcggcgaccugcccgucuggcuggcccacaagguggccuccgaggggaucaaguacacggaccggaaguggugcuucgacggcgagcgcaacaaccagauccucgaggagaacauggacgucgagaucuggaccaaggagggggagcggaagaagcugcgcccgcgcuggcuggacgcgcggaccuacagcgacccccucgcccugaaggaguucaaggacuucgccgccggccgcaaguccaucgcccuggaccucgugaccgagaucggccgggugcccagccaccuggcguaccgcacgcggaacgcccuggacaaccucgucaugcugcacaccagcgagcacgggggccgcgccuaccggcacgccguggaggagcugccggagaccauggagacccuccugcugcucgggcugaugauccugcucacgggcggggccaugcuguuccugaucuccggcaagggcaucgggaagaccagcaucggccucaucugcgugaucgucuccagcgggaugcuguggauggcggacgugccccugcaguggaucgccuccgccaucgugcucgaguucuucaugaugguccugcugauccccgagcccgagaagcagcgcaccccgcaggacaaccagcucgccuacguggugaucggcauccugacccuggccgcgaucgucgccgccaacgagauggggcuccuggagacgaccaagcgggaccugggcaugagcaaggagcccggcguggugucccccaccagcuaccucgacgucgaccugcaccccgccuccgccuggacccuguacgcgguggccacgaccgugaucaccccgaugcuccgccacaccaucgagaacagcacggccaacgucucccuggccgcgaucgccaaccaggccguggugcugauggggcucgacaagggcuggcccaucagcaagauggaccugggggucccccugcucgcccugggcugcuacucccaggugaacccccugacccucaccgccgcggugcugcugcucgucacccacuacgccaucaucgggccgggccugcaggccaaggccacgcgggaggcccagaagcgcaccgcggccggcaucaugaagaaccccaccguggacgggaucaugaccaucgaccuggaccccgugaucuacgacagcaaguucgagaagcagcucggccaggucaugcugcuggugcucugcgccgugcagcugcugcucaugcggacguccugggcccugugcgaggcccugacccucgcgaccgggcccaucaccacgcugugggagggcagcccgggcaaguucuggaacaccaccaucgccgucuccauggccaacaucuuccgcgggagcuaccuggccggcgcggggcucgccuucuccaucaugaaguccgugggcaccgggcggcgcggcacgggcagccagggggagacccugggcgagaaguggaagaagaagcugaaccagcucucccggaaggaguucgaccuguacaagaaguccgggaucaccgagguggaccgcaccgaggccaaggagggccugaagcgcggggagaccacgcaccacgccgucucccgcggcagcgccaagcuccagugguucguggagcggaacauggugauccccgagggccgcgucaucgaccuggggugcggccgcgggggcugguccuacuacugcgcggggcugaagaaggugaccgaggugcggggcuacaccaagggcgggcccggccacgaggagcccgucccgaugagcaccuacggguggaaccucgugaagcugauguccggcaaggacguguucuaccugccgcccgagaagugcgacacgcugcucugcgacaucggggagagcucccccagcccgaccgucgaggagucccgcaccauccgggugcugaagaugguggagcccuggcugaagaacaaccaguucugcaucaagguccucaaccccuacaugcccaccgugaucgagcaccuggagcgccugcagcggaaguacggcggcaugcucgugcgcaacccgcugagccggaacuccacgcacgagauguacuggaucagcaacgggaccggcaacaucgucuccagcgugaacauggugucccgccugcuccugaaccgguucaccaugacccaccgccggcccacgaucgagaaggacgucgaccugggggccggcacccgccacgugaacgccgagcccgagaccccgaacauggacgucaucggcgagcggaucaagcgcaucaaggaggagcacagcuccaccuggcacuacgacgacgagaaccccuacaagacgugggccuaccacgggagcuacgaggugaaggccaccggcagcgcguccagcaugaucaacgggguggucaagcuccugaccaagcccugggacguggugcccauggucacccagauggccaugacggacaccaccccguucggccagcagcggguguucaaggagaagguggacacccgcacgccccggcccaugcccgggacccgcaaggucauggagaucaccgccgaguggcuguggcggacccucggccgcaacaagaagccgcgccugugcacgcgggaggaguucaccaagaaggugcgcaccaacgccgccaugggcgcgguguucaccgaggagaaccagugggacuccgcccgggccgccgucgaggacgaggaguucuggaagcugguggaccgcgagcgggagcuccacaagcuggggaagugcggcagcugcguguacaacaugauggggaagcgcgagaagaagcugggcgaguucgggaaggcgaagggcucccgggccaucugguacauguggcucggcgcccgcuaccuggaguucgaggcccugggguuccucaacgaggaccacugguucagccgggagaacuccuacagcggcgucgagggggagggccugcacaagcugggguacauccuccgcgacaucuccaagauccccggcggcgccauguacgcggacgacacggccgggugggacacccggaucaccgaggacgaccugcacaacgaggagaagaucacccagcagauggaccccgagcaccgccagcuggccaacgccaucuucaagcucacguaccagaacaagguggugaagguccagcggcccaccccgaagggcaccgugauggacaucaucagccgcaaggaccagcggggguccggccaggugggcaccuacgggcugaacaccuucacgaacauggaggcccagcugguccgccagauggagggcgagggggugcucagcaaggcggaccuggagaacccccaccuccucgagaagaagaucacccaguggcuggagaccaagggcguggagcggcugaagcgcauggccaucuccggggacgacugcgucgugaagcccaucgacgaccgguucgccaacgcccuccuggcccugaacgacaugggcaaggugcgcaaggacaucccccaguggcagccgagcaagggcuggcacgacuggcagcagguccccuucugcucccaccacuuccacgagcucaucaugaaggacgggcggaagcugguggugcccugccgcccccaggacgagcugaucggccgcgcgcggaucagccagggggccggcuggucccucaaggagaccgccugccuggggaaggccuacgcccagauguggagccugauguacuuccaccgccgggaccuccgccuggcguccaacgccaucugcagcgccgucccggugcacuggauccccacgagccggaccaccugguccauccacgcccaccaccaguggaugaccacggaggacaugcugaccguguggaaccgcgucuggaucgaggacaaccccuggauggaggacaagacccccgugaccacgugggaggacgugccguaccucggcaagcgggaggaccaguggugcggcagccugaucgggcugaccucccgcgcgaccugggcccagaacauccucaccgccauccagcagguccggagccugaucggcgacgaggaguuccuggacuacaugcccuccaugaagcgcuuccggaaggaggaggagagcgagggggccaucugguga

SEQ ID NO: 10317 - RNA, 9873 nt, Artificial Sequence
  derived and/or modified CDS sequence (opt1) from DENV-3__FJ461322__SS-prME
accagccugugccucaugaugaugcugcccgcgacccuggccuuccaccucaccagccgggacggcgagccgcggaugaucguggggaagaacgagcgcggcaagagccugcuguucaagaccgcguccgggaucaacaugugcacccucaucgccauggaccugggcgagaugugcgacgacaccgugacguacaagugcccccugaucgccgagguggagcccgaggacaucgacugcuggugcaaccucaccagcaccugggugaccuacgggacgugcaaccaggccggcgagcaccggcgcgacaagcgguccguggcccuggcgccccacgugggcauggggcuggacacccgcacccagaccuggaugagcgccgagggcgccuggcgccagguggagaagguggagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgugugcaagcacaccuacgucgaccggggguggggcaacgggugcggccuguucgggaagggcucccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccagcaccguggaggccgugcugcccgaguacggcacccucgggcuggagugcuccccgcgcaccggccuggacuucaacgagaugauccuccugaccaugaagaacaaggcguggaugguccaccggcagugguucuucgaccugccccuccccuggacgagcggcgccaccaccgagacccccacguggaaccgcaaggagcugcuggugaccuucaagaacgcccacgccaagaagcaggagguggucgugcucgggucccaggagggcgccaugcacaccgcgcugaccggggccacggagauccagaacagcggcgggaccuccaucuucgccggccaccugaagugccggcucaagauggacaagcuggagcugaagggcaugagcuacgccaugugccucaacaccuucgugcugaagaaggaggucuccgagacccagcacgggacgauccugaucaagguggaguacaagggcgaggacgccccgugcaagauccccuucagcaccgaggacgggcagggcaaggcgcacaacggccgccugaucaccgccaaccccguggucaccaagaaggaggagcccgugaacaucgaggccgagccgcccuucggggagagcaacaucgugaucggcaucggggacaaggcccucaagaucaacugguacaagaagggcuccagcaucgggaagauguucgaggcgacggcccggggcgcccgccggauggccauccugggcgacaccgccugggacuucggguccgucggcggggugcugaacagccucggcaagauggugcaccagaucuucggguccgcguacaccgcccuguucagcggcgucuccuggaucaugaagaucggcaucggggugcugcucaccuggaucggccugaacagcaagaacacguccaugagcuucuccugcaucgugaucgggaucaucacccuguaccucggcgccgucgugcaggccgacauggggugcgccaucaacuggaagggcaaggagcugaagugcggcagcgggaucuucgugaccaacgagguccacaccuggacggagcaguacaaguuccaggcggacucccccaagcgccuggccaccgccaucgccggcgccugggagaacggggugugcggcauccgcagcaccacccggauggagaaccuccuguggaagcagaucgcgaacgagcugaacuacauccucugggagaacaacaucaagcugacgguggucgugggggacaucaucggcgugcuggagcagggcaagcgcacccucacgccccagccgauggagcugaaguacuccuggaagaccugggggaaggccaagaucgucacggccgagacccagaacagcuccuucaucaucgacggccccaacacccccgagugccccagcgccucccgggcguggaacgugugggagguggaggacuacggguucggcgucuucaccacgaacaucuggcugaagcuccgcgagguguacacccagagcugcgaccaccggcugaugagcgccgccaucaaggacgagcgcgccgugcacgccgacaugggcuacuggaucgagucccagaagaacgggagcuggaagcuggagaaggcguccuucaucgaggucaagaccugcaccuggcccaagagccacacccucugguccaacggcgugcuggagagcgacaugaucauccccaagucccuggccgggcccaucagccagcacaaccaccggccgggcuaccacacgcagaccgccgggcccuggcaccucggcaagcuggagcuggacuucaacuacugcgagggcaccaccguggucaucacggagaacugcgggacccgcggccccucccuccggaccaccacggugagcgggaagcugauccacgaguggugcugccgcuccugcacccugcccccgcuccgguacaugggcgaggacgggugcugguacggcauggagauccgccccaucaacgagaaggaggagaacauggucaagagccuggucuccgccggcagcgggaagguggacaacuucaccaugggcgugcugugccucgccauccuguucgaggaggucaugcgggggaaguucggcaagaagcacaugaucgcgggggugcuguucaccuucgugcuccugcuguccggccagaucacguggcgcgacauggcccacacccucaucaugaucggcagcaacgccuccgaccggauggggaugggcgucaccuaccuggcccugaucgccaccuucaagauccagcccuuccucgcgcugggguucuuccugcgcaagcucacgagccgggagaaccugcugcucggcgugggccuggccauggccaccacccugcagcuccccgaggacaucgagcagauggccaacgggaucgcgcugggccugaugacccucaagcugaucacgcaguucgagaccuaccagcuguggaccgcccucgugagccugaccugcuccaacacgaucuucacccugaccgucgccuggcgcaccgccacgcucauccuggccggggugagccugcucccgcugugccaguccagcuccaugcggaagaccgacuggcugcccaugaccgucgcggccaugggcgugccgccccugccgcuguucaucuucagccugaaggacacccccaagcgccgcuccuggccccucaacgagggggugauggccgucggccuggugagcauccuggccuccagccuccugcggaacgacgugcccauggccggcccgcuggucgccggcgggcuccugaucgccugcuacgugaucacggggaccuccgccgaccugaccguggagaaggccgccgacgucaccugggaggaggaggcggagcagacgggggugagccacaaccucaugaucaccguggacgacgacgggaccaugcgcaucaaggacgacgagaccgagaacauccugaccguccugcucaagacggcccugcugaucguguccggcaucuuccccuacagcauccccgccacccuccugguguggcacaccuggcagaagcagacccagcgguccggcguccugugggacgugcccagcccgcccgagacgcagaaggccgagcucgaggaggggguguaccgcaucaagcagcagggcaucuucgggaagacccaggucggcgugggggugcagaaggagggcgucuuccacaccauguggcacgugacccggggcgccgugcugacgcacaacgggaagcgccuggagcccaacugggcguccgucaagaaggaccucaucagcuacggcgggggcuggcggcuguccgcccaguggcagaagggggaggagguccaggugaucgccgucgagcccggcaagaacccgaagaacuuccagaccaugcccggcaucuuccagaccaccacgggggagaucggcgccaucgcgcuggacuucaagcccgggaccagcggcagcccgaucaucaaccgcgagggcaaggugguggggcuguacggcaacggggucgugaccaagaacggcggguacguguccggcaucgcccagaccaacgccgagcccgacggccccacgcccgagcucgaggaggagauguucaagaagcggaaccugaccaucauggaccugcacccggggagcggcaagacccgcaaguaccuccccgccaucguccgggaggccaucaagcgccggcugcgcacccugauccucgcgcccacgcgggugguggccgccgagauggaggaggcccugaaggggcugcccauccgcuaccagaccaccgccaccaaguccgagcacacgggccgggagaucgucgaccucaugugccacgcgaccuucaccaugcgccugcugagcccggugcgggugcccaacuacaaccucaucaucauggacgaggcccacuucaccgaccccgccuccaucgccgcccgcggguacaucagcacgcgggucggcaugggcgaggcggccgccaucuucaugaccgccacgccgcccgggaccgcggaggccuucccccaguccaacgcccccauccaggacgaggagcgcgacauccccgagcgcagcuggaacuccggcaacgaguggaucacggacuucguggggaagaccgugugguucguccccagcaucaaggccggcaacgacaucgccaacugccugcggaagaacgggaagaaggugauccagcugucccgcaagaccuucgacaccgaguaccagaagacgcggcucaacgacugggacuucguggucaccaccgacaucagcgagaugggcgcgaacuucaaggccgaccgcgugaucgacccccggcgcugccugaagcccgugauccugaccgacggccccgagcgggucauccucgccgggccgaugcccgugacggccgccuccgcggcccagcgccggggccgcguggggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgcggccaucgacggcgaguaccggcugaagggcgagucccgcaagaccuucgucgagcucaugcggcgcggggaccugcccguguggcuggcccacaaggucgccagcgagggcaucaaguacacggaccggaaguggugcuucgacggggagcgcaacaaccagauccucgaggagaacauggacguggagaucuggaccaaggagggcgagcggaagaagcugcgcccgcgcuggcuggacgcgcggaccuacuccgacccccucgcccugaaggaguucaaggacuucgccgccggccgcaagagcaucgcccuggaccucgugaccgagaucgggcggguccccucccaccuggcguaccgcacgcggaacgcccuggacaaccucgugaugcugcacaccagcgagcacggcgggcgcgccuaccggcacgccguggaggagcugccggagaccauggagacccuccugcugcucggccugaugauccugcucaccggcggggccaugcuguuccugaucagcgggaaggggaucggcaagaccuccaucgggcucaucugcgucaucgugagcuccggcaugcuguggauggcggaggugccccugcaguggaucgccagcgccaucguccucgaguucuucaugauggugcugcugauccccgagcccgagaagcagcgcaccccgcaggacaaccagcucgccuacguggucaucgggauccugacccuggccgcgaucguggccgccaacgagaugggccuccuggagacgaccaagcgggaccugggcauguccaaggagcccgggguggucagccccaccuccuaccucgacguggaccugcaccccgccagcgccuggacccuguacgcgguggccacgaccgucaucaccccgaugcuccgccacaccaucgagaacuccacggccaacgugagccuggccgcgaucgccaaccaggccgugguccugaugggccucgacaagggguggcccaucuccaagauggaccugggcgugccccugcucgcccuggggugcuacagccaggugaacccccugacccucaccgccgcgguccugcugcucgugacccacuacgccaucaucggcccgggccugcaggccaaggccacgcgggaggcccagaagcgcaccgcggccgggaucaugaagaaccccaccguggacggcaucaugaccaucgaccuggaccccgucaucuacgacuccaaguucgagaagcagcucggccaggugaugcugcuggugcucugcgccguccagcugcugcucaugcggacgagcugggcccugugcgaggcccugacccucgcgaccggccccaucaccacgcugugggagggcuccccggggaaguucuggaacaccaccaucgccgugagcauggccaacaucuuccgcggcuccuaccuggccggggcgggccucgccuucagcaucaugaaguccguggggaccggccggcgcggcacggggagccagggcgagacccugggggagaaguggaagaagaagcugaaccagcucagccggaaggaguucgaccuguacaagaaguccggcaucaccgaggucgaccgcaccgaggccaaggaggggcugaagcggggcgagaccacgcaccacgccgugagccgcggcuccgccaagcuccagugguucguggagcggaacauggucauccccgaggggcgcgugaucgaccugggcugcgggcgcggcggguggagcuacuacugcgcgggccugaagaaggugaccgagguccggggcuacaccaagggcggccccgggcacgaggagcccgugccgauguccaccuacggcuggaacaucgugaagcucaugagcgggaaggacgucuucuaccugccgcccgagaagugcgacacgcugcugugcgacaucggcgaguccagccccuccccgaccguggaggagagccgcaccauccgggugcucaagauggucgagcccuggcugaagaacaaccaguucugcaucaaggugcugaaccccuacaugcccaccgugaucgagcaccucgagcgccugcagcggaaguacggcgggaugcugguccgcaacccgcucucccggaacagcacgcacgagauguacuggaucuccaacggcaccgggaacaucgugagcuccgugaacauggucagccgccugcugcucaaccgguucaccaugacccaccgccggcccacgaucgagaaggacguggaccugggcgccggcacccgccacgucaacgccgagcccgagaccccgaacauggacgugaucggggagcggaucaagcgcaucaaggaggagcacuccagcaccuggcacuacgacgacgagaaccccuacaagacgugggccuaccacggcuccuacgaggugaaggccaccgggagcgcgagcuccaugaucaacggcgucgugaagcugcucaccaagcccugggacgugguccccauggugacccagauggccaugacggacaccaccccguucgggcagcagcggguguucaaggagaaggucgacacccgcacgccccggcccaugcccggcacccgcaaggugauggagaucaccgccgaguggcuguggcggacccugggccgcaacaagaagccgcgccucugcacgcgggaggaguucaccaagaaggugcgcaccaacgccgccaugggggcggucuucaccgaggagaaccagugggacagcgcccgggccgccguggaggacgaggaguucuggaagcugguggaccgcgagcgggagcugcacaagcucggcaagugcggguccugcgucuacaacaugaugggcaagcgcgagaagaagcugggggaguucggcaaggcgaagggcagccgggccaucugguacauguggcugggggcccgcuaccucgaguucgaggcccugggcuuccugaacgaggaccacugguucucccgggagaacagcuacuccgggguggagggcgaggggcuccacaagcugggcuacauccugcgcgacaucagcaagauccccggcggggccauguacgcggacgacacggccggcugggacacccggaucaccgaggacgaccuccacaacgaggagaagaucacccagcagauggaccccgagcaccgccagcuggccaacgccaucuucaagcugacguaccagaacaagguggucaaggugcagcggcccaccccgaaggggaccgugauggacaucaucucccgcaaggaccagcggggcagcggccaggucgggaccuacggccucaacaccuucacgaacauggaggcccagcuggugcgccagauggagggggagggcgugcuguccaaggcggaccucgagaacccccaccuccuggagaagaagaucacccaguggcucgagaccaagggggucgagcggcugaagcgcauggccaucagcggcgacgacugcguggugaagcccaucgacgaccgguucgccaacgcccugcucgcccugaacgacaugggcaagguccgcaaggacaucccccaguggcagccguccaagggguggcacgacuggcagcagguccccuucugcagccaccacuuccacgagcugaucaugaaggacggccggaagcucgugguccccugccgcccccaggacgagcugaucgggcgcgcgcggaucucccagggcgccggguggagccugaaggagaccgccugccucggcaaggccuacgcccagauguggucccugauguacuuccaccgccgggaccugcgccucgcgagcaacgccaucugcuccgccgugccggugcacuggauccccacgagccggaccaccuggagcauccacgcccaccaccaguggaugaccacggaggacaugcugaccgucuggaaccgcguguggaucgaggacaaccccuggauggaggacaagacccccgugaccacgugggaggacaucccguaccugggcaagcgggaggaccaguggugcgggucccucaucggccugaccagccgcgcgaccugggcccagaacauccugaccgccauccagcagguccggucccucaucggggacgaggaguuccuggacuacaugcccagcaugaagcgcuuccggaaggaggaggaguccgagggcgccaucugguga

SEQ ID NO: 10318 - RNA, 9873 nt, Artificial Sequence
  derived and/or modified CDS sequence (opt1) from DENV-3__KF955458__SS-prME
accagccugugccucaugaugaugcugcccgcgacccuggccuuccaccucaccagccgggacggcgagccgcggaugaucguggggaagaacgagcgcggcaagagccugcuguucaagaccgcguccgggaucaacaugugcacccucaucgccauggaccugggcgagaugugcgacgacaccgugacguacaagugcccccugaucgccgagguggagcccgaggacaucgacugcuggugcaaccucaccagcaccugggugaccuacgggacgugcaaccaggccggcgagcaccggcgcgacaagcgguccguggcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgugugcaagcacaccuacgucgaccggggguggggcaacgggugcggccuguucgggaagggcucccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccagcaccguggaggccgugcugcccgaguacggcacccucgggcuggagugcuccccgcgcaccggccuggacuucaacgagaugauccuccugaccaugaagaacaaggcguggaugguccaccggcagugguucuucgaccugccccuccccuggacgagcggcgccaccaccgagacccccacguggaaccgcaaggagcugcuggugaccuucaagaacgcccacgccaagaagcaggagguggucgugcucgggucccaggagggcgccaugcacaccgcgcugaccggggccacggagauccagaacagcggcgggaccuccaucuucgccggccaccugaagugccggcucaagauggacaagcuggagcugaagggcaugagcuacgccaugugccucaacaccuucgugcugaagaaggaggucuccgagacccagcacgggacgauccugaucaagguggaguacaagggcgaggacgccccgugcaagauccccuucagcaccgaggacgggcagggcaaggcgcacaacggccgccugaucaccgccaaccccguggucaccaagaaggaggagcccgugaacaucgaggccgagccgcccuucggggagagcaacaucgugaucggcaucggggacaaggcccucaagaucaacugguacaagaagggcuccagcaucgggaagauguucgaggcgacggcccggggcgcccgccggauggccauccugggcgacaccgccugggacuucggguccgucggcggggugcugaacagccucggcaagauggugcaccagaucuucggguccgcguacaccgcccuguucagcggcgucuccuggaucaugaagaucggcaucggggugcugcucaccuggaucggccugaacagcaagaacacguccaugagcuucuccugcaucgugaucgggaucaucacccuguaccucggcgccgucgugcaggccgacauggggugcgccaucaacuggaagggcaaggagcugaagugcggcagcgggaucuucgugaccaacgagguccacaccuggacggagcaguacaaguuccaggcggacucccccaagcgccuggccaccgccaucgccggcgccugggagaacggggugugcggcauccgcagcaccacccggauggagaaccuccuguggaagcagaucgcgaacgagcugaacuacauccucugggagaacaacaucaagcugacgguggucgugggggacaucaucggcgugcuggagcagggcaagcgcacccucacgccccagccgauggagcugaaguacuccuggaagaccugggggaaggccaagaucgucacggccgagacccagaacagcuccuucaucaucgacggccccaacacccccgagugccccagcgccucccgggcguggaacgugugggagguggaggacuacggguucggcgucuucaccacgaacaucuggcugaagcuccgcgaggugaacacccagagcugcgaccaccggcugaugagcgccgccaucaaggacgagcgcgccgugcacgccgacaugggcuacuggaucgagucccagaagaacgggagcuggaagcuggagaaggcguccuucaucgaggucaagaccugcaccuggcccaagagccacacccucugguccaacggcgugcuggagagcgacaugaucauccccaagucccuggccgggcccaucagccagcacaaccaccggccgggcuaccacacgcagaccgccgggcccuggcaccucggcaagcuggagcuggacuucaacuacugcgagggcaccaccguggucaucacggagaacugcgggacccgcggccccucccuccggaccaccacggugagcgggaagcugauccacgaguggugcugccgcuccugcacccugcccccgcuccgguacaugggcgaggacgggugcugguacggcauggagauccgccccaucaacgagaaggaggagaacauggucaagagccuggucuccgccggcagcgggaagguggacaacuucaccaugggcgugcugugccucgccauccuguucgaggaggucaugcgggggaaguucggcaagaagcacaugaucgcgggggugcuguucaccuucgugcuccugcuguccggccagaucacguggcgcgacauggcccacacccucaucaugaucggcagcaacgccuccgaccggauggggaugggcgucaccuaccuggcccugaucgccaccuucaagauccagcccuuccucgcgcugggguucuuccugcgcaagcucacgagccgggagaaccugcugcucggcgugggccuggccauggccaccacccugcagcuccccgaggacaucgagcagauggccaacgggaucgcgcugggccugaugacccucaagcugaucacgcaguucgagaccuaccagcuguggaccgcccucgugagccugaccugcuccaacacgaucuucacccugaccgucgccuggcgcaccgccacgcucauccuggccggggugagccugcucccgcugugccaguccagcuccaugcggaagaccgacuggcugcccaugaccgucgcggccaugggcgugccgccccugccgcuguucaucuucagccugaaggacacccccaagcgccgcuccuggccccucaacgagggggugauggccgucggccuggugagcauccuggccuccagccuccugcggaacgacgugcccauggccggcccgcuggucgccggcgggcuccugaucgccugcuacgugaucacggggaccuccgccgaccugaccguggagaaggccgccgacgucaccugggaggaggaggcggagcagacgggggugagccacaaccucaugaucaccguggacgacgacgggaccaugcgcaucaaggacgacgagaccgagaacauccugaccguccugcucaagacggcccugcugaucguguccggcaucuuccccuacagcauccccgccacccuccugguguggcacaccuggcagaagcagacccagcgguccggcguccugugggacgugcccagcccgcccgagacgcagaaggccgagcucgaggaggggguguaccgcaucaagcagcagggcaucuucgggaagacccaggucggcgugggggugcagaaggagggcgucuuccacaccauguggcacgugacccggggcgccgugcugacgcacaacgggaagcgccuggagcccaacugggcguccgucaagaaggaccucaucagcuacggcgggggcuggcggcuguccgcccaguggcagaagggggaggagguccaggugaucgccgucgagcccggcaagaacccgaagaacuuccagaccaugcccggcaucuuccagaccaccacgggggagaucggcgccaucgcgcuggacuucaagcccgggaccagcggcagcccgaucaucaaccgcgagggcaaggugguggggcuguacggcaacggggucgugaccaagaacggcggguacguguccggcaucgcccagaccaacgccgagcccgacggccccacgcccgagcucgaggaggagauguucaagaagcggaaccugaccaucauggaccugcacccggggagcggcaagacccgcaaguaccuccccgccaucguccgggaggccaucaagcgccggcugcgcacccugauccucgcgcccacgcgggugguggccgccgagauggaggaggcccugaaggggcugcccauccgcuaccagaccaccgccaccaaguccgagcacacgggccgggagaucgucgaccucaugugccacgcgaccuucaccaugcgccugcugagcccggugcgggugcccaacuacaaccucaucaucauggacgaggcccacuucaccgaccccgccuccaucgccgcccgcggguacaucagcacgcgggucggcaugggcgaggcggccgccaucuucaugaccgccacgccgcccgggaccgcggaggccuucccccaguccaacgcccccauccaggacgaggagcgcgacauccccgagcgcagcuggaacuccggcaacgaguggaucacggacuucguggggaagaccgugugguucguccccagcaucaaggccggcaacgacaucgccaacugccugcggaagaacgggaagaaggugauccagcugucccgcaagaccuucgacaccgaguaccagaagacgcggcucaacgacugggacuucguggucaccaccgacaucagcgagaugggcgcgaacuucaaggccgaccgcgugaucgacccccggcgcugccugaagcccgugauccugaccgacggccccgagcgggucauccucgccgggccgaugcccgugacggccgccuccgcggcccagcgccggggccgcguggggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgcggccaucgacggcgaguaccggcugaagggcgagucccgcaagaccuucgucgagcucaugcggcgcggggaccugcccguguggcuggcccacaaggucgccagcgagggcaucaaguacacggaccggaaguggugcuucgacggggagcgcaacaaccagauccucgaggagaacauggacguggagaucuggaccaaggagggcgagcggaagaagcugcgcccgcgcuggcuggacgcgcggaccuacuccgacccccucgcccugaaggaguucaaggacuucgccgccggccgcaagagcaucgcccuggaccucgugaccgagaucgggcggguccccucccaccuggcguaccgcacgcggaacgcccuggacaaccucaugaugcugcacaccagcgagcacggcgggcgcgccuaccggcacgccguggaggagcugccggagaccauggagacccuccugcugcucggccugaugauccugcucaccgggggcgccaugcuguuccugaucagcggcaaggggaucggcaagaccuccaucgggcucaucugcgugaucgucagcuccggcaugcuguggauggcggacgugccccugcaguggaucgccagcgccaucgugcucgaguucuucaugaugguccugcugauccccgagcccgagaagcagcgcaccccgcaggacaaccagcucgccuacguggugaucgggauccugacccuggccgcgaucgucgccgccaacgagaugggccuccuggagacgaccaagcgggaccugggcauguccaaggagcccgggguggugagccccaccuccuaccucgacgucgaccugcaccccgccagcgccuggacccuguacgcgguggccacgaccgugaucaccccgaugcuccgccacaccaucgagaacuccacggccaacgucagccuggccgcgaucgccaaccaggccguggugcugaugggccucgacaagggguggcccaucuccaagauggaccugggcgucccccugcucgcccuggggugcuacagccaggugaacccccugacccucaccgccgcggugcugcugcucgucacccacuacgccaucaucggcccgggccugcaggccaaggccacgcgggaggcccagaagcgcaccgcggccgggaucaugaagaaccccaccguggacggcaucaugaccaucgaccuggaccccgugaucuacgacuccaaguucgagaagcagcucgggcaggucaugcugcuggugcucugcgccgugcagcugcugcucaugcggacgagcugggcccugugcgaggcccugacccucgcgaccggccccaucaccacgcugugggagggcuccccggggaaguucuggaacaccaccaucgccgucagcauggccaacaucuuccgcggcuccuaccuggccggggcgggccucgccuucagcaucaugaaguccguggggaccggccggcgcggcacggggagccagggcgagacccugggggagaaguggaagaagaagcugaaccagcucagccggaaggaguucgaccuguacaagaaguccggcaucaccgagguggaccgcaccgaggccaaggaggggcugaagcggggcgagaccacgcaccacgccgucagccgcggcuccgccaagcuccagugguucguggagcggaacauggugauccccgaggggcgcgucaucgaccugggcugcgggcgcggcggguggagcuacuacugcgcgggccugaagaaggugaccgaggugcggggcuacaccaagggcggccccgggcacgaggagcccgucccgauguccaccuacggcuggaaccucgugaagcugaugagcgggaaggacguguucuaccugccgcccgagaagugcgacacgcugcucugcgacaucggcgaguccagccccuccccgaccgucgaggagagccgcaccauccgggugcugaagaugguggagcccuggcugaagaacaaccaguucugcaucaagguccucaaccccuacaugcccaccgugaucgagcaccuggagcgccugcagcggaaguacggcgggaugcucgugcgcaacccgcugucccggaacagcacgcacgagauguacuggaucuccaacggcaccgggaacaucgucagcuccgugaacauggugagccgccugcuccugaaccgguucaccaugacccaccgccggcccacgaucgagaaggacgucgaccugggcgccggcacccgccacgugaacgccgagcccgagaccccgaacauggacgucaucggggagcggaucaagcgcaucaaggaggagcacuccagcaccuggcacuacgacgacgagaaccccuacaagacgugggccuaccacggcuccuacgaggugaaggccaccgggagcgcgagcuccaugaucaacggcguggucaagcuccugaccaagcccugggacguggugcccauggucacccagauggccaugacggacaccaccccguucgggcagcagcggguguucaaggagaagguggacacccgcacgccccggcccaugcccggcacccgcaaggucauggagaucaccgccgaguggcuguggcggacccucggccgcaacaagaagccgcgccugugcacgcgggaggaguucaccaagaaggugcgcaccaacgccgccaugggggcgguguucaccgaggagaaccagugggacagcgcccgggccgccgucgaggacgaggaguucuggaagcugguggaccgcgagcgggagcuccacaagcugggcaagugcggguccugcguguacaacaugaugggcaagcgcgagaagaagcugggggaguucggcaaggcgaagggcagccgggccaucugguacauguggcucggggcccgcuaccuggaguucgaggcccugggcuuccucaacgaggaccacugguucucccgggagaacagcuacuccggggucgagggcgaggggcugcacaagcugggcuacauccuccgcgacaucagcaagauccccggcggggccauguacgcggacgacacggccggcugggacacccggaucaccgaggacgaccugcacaacgaggagaagaucacccagcagauggaccccgagcaccgccagcuggccaacgccaucuucaagcucacguaccagaacaagguggugaagguccagcggcccaccccgaaggggaccgugauggacaucaucucccgcaaggaccagcggggcagcggccagguggggaccuacggccugaacaccuucacgaacauggaggcccagcugguccgccagauggagggggagggcgugcucuccaaggcggaccuggagaacccccaccuccucgagaagaagaucacccaguggcuggagaccaaggggguggagcggcugaagcgcauggccaucagcggcgacgacugcgucgugaagcccaucgacgaccgguucgccaacgcccuccuggcccugaacgacaugggcaaggugcgcaaggacaucccccaguggcagccguccaagggguggcacgacuggcagcagguccccuucugcagccaccacuuccacgagcucaucaugaaggacggccggaagcugguggugcccugccgcccccaggacgagcugaucgggcgcgcgcggaucucccagggcgccggguggagccucaaggagaccgccugccugggcaaggccuacgcccagauguggucccugauguacuuccaccgccgggaccuccgccuggcgagcaacgccaucugcuccgccgucccggugcacuggauccccacgagccggaccaccuggagcauccacgcccaccaccaguggaugaccacggaggacaugcugaccguguggaaccgcgucuggaucgaggacaaccccuggauggaggacaagacccccgugaccacgugggaggacgugccguaccucggcaagcgggaggaccaguggugcgggucccugaucggccugaccagccgcgcgaccugggcccagaacauccucaccgccauccagcagguccggucccugaucggggacgaggaguuccuggacuacaugcccagcaugaagcgcuuccggaaggaggaggaguccgagggcgccaucugguga

SEQ ID NO: 10319 - RNA, 9873 nt, Artificial Sequence
  derived and/or modified CDS sequence (opt1) from DENV-3__FJ562102__SS-prME
accagccugugccucaugaugaugcugcccgcgacccuggccuuccaccucacgagccgggacggcgagccgcggaugaucguggggaagaacgagcgcggcaagagccugcuguucaagaccgcguccgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggacgugcaaccaggccggcgagcaccggcgcgacaagcgguccguggcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgugugcaagcacaccuacgucgaccggggguggggcaacgggugcggccuguucgggaagggcucccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccagcaccguggaggccgugcugcccgaguacggcacccucgggcuggagugcuccccgcgcaccggccuggacuucaacgagaugauccuccugaccaugaagaacaaggcguggaugguccaccggcagugguucuucgaccugccccuccccuggacgagcggcgccaccaccgagacccccacguggaaccgcaaggagcugcuggugaccuucaagaacgcccacgccaagaagcaggagguggucgugcucgggucccaggagggcgccaugcacaccgcgcugaccggggccacggagauccagaacagcggcgggaccuccaucuucgccggccaccugaagugccggcucaagauggacaagcuggagcugaagggcaugagcuacgccaugugccucaacaccuucgugcugaagaaggaggucuccgagacccagcacgggacgauccugaucaagguggaguacaagggcgaggacgccccgugcaagauccccuucagcaccgaggacgggcagggcaaggcgcacaacggccgccugaucaccgccaaccccguggucaccaagaaggaggagcccgugaacaucgaggccgagccgcccuucggggagagcaacaucgugaucggcaucggggacaaggcccucaagaucaacugguacaagaagggcuccagcaucgggaagauguucgaggcgacggcccggggcgcccgccggauggccauccugggcgacaccgccugggacuucggguccgucggcggggugcugaacagccucggcaagauggugcaccagaucuucggguccgcguacaccgcccuguucagcggcgucuccuggaucaugaagaucggcaucggggugcugcucaccuggaucggccugaacagcaagaacacguccaugagcuucuccugcaucgugaucgggaucaucacccuguaccucggcgccgucgugcaggccgacauggggugcgccaucaacuggaagggcaaggagcugaagugcggcagcgggaucuucgugaccaacgagguccacaccuggacggagcaguacaaguuccaggcggacucccccaagcgccuggccaccgccaucgccggcgccugggagaacggggugugcggcauccgcagcaccacccggauggagaaccuccuguggaagcagaucgcgaacgagcugaacuacauccucugggagaacaacaucaagcugacgguggucgugggggacaucaucggcgugcuggagcagggcaagcgcacccucacgccccagccgauggagcugaaguacuccuggaagaccugggggaaggccaagaucgucacggccgagacccagaacagcuccuucaucaucgacggccccaacacccccgagugccccagcgccucccgggcguggaacgugugggagguggaggacuacggguucggcgucuucaccacgaacaucuggcugaagcuccgcgagguguacacccagagcugcgaccaccggcugaugagcgccgccaucaaggacgagcgcgccgugcacgccgacaugggcuacuggaucgagucccagaagaacgggagcuggaagcuggagaaggcguccuucaucgaggucaagaccugcaccuggcccaagagccacacccucugguccaacggcgugcuggagagcgacaugaucauccccaagucccuggccgggcccaucagccagcacaaccaccggccgggcuaccacacgcagaccgccgggcccuggcaccucggcaagcuggagcuggacuucaacuacugcgagggcaccaccguggucaucacggagaacugcgggacccgcggccccucccuccggaccaccacggugagcgggaagcugauccacgaguggugcugccgcuccugcacccugcccccgcuccgguacaugggcgaggacgggugcugguacggcauggagauccgccccaucaacgagaaggaggagaacauggucaagagccuggucuccgccggcagcgggaagguggacaacuucaccaugggcgugcugugccucgccauccuguucgaggaggucaugcgggggaaguucggcaagaagcacaugaucgcgggggugcuguucaccuucgugcuccugcuguccggccagaucacguggcgcgacauggcccacaccuucaucaugaucggcagcaacgccuccgaccggauggggaugggcgucaccuaccucgcccugaucgccaccuucaagauccagcccuuccuggcgcucggguucuuccugcgcaagcugacgagccgggagaaccuccugcugggcgugggccucgccauggccaccacccugcagcugcccgaggacaucgagcagauggccaacgggaucgcgcucggccugaugacccugaagcucaucacgcaguucgagaccuaccagcuguggaccgcccuggugagccugaccugcuccaacacgaucuucacccugaccgucgccuggcgcaccgccacgcugauccucgccggggugagccugcugccgcucugccaguccagcuccaugcggaagaccgacuggcugcccaugaccgucgcggccaugggcgugccgccccucccccucuucaucuucagccugaaggacacccccaagcgccgcuccuggccccugaacgagggggugauggccgucggccucgugagcauccuggccuccagccugcuccggaacgacgugcccauggccggcccgcuggucgccggcgggcugcucaucgccugcuacgugaucacggggaccuccgccgaccugaccguggagaaggccgccgacgucaccugggaggaggaggcggagcagacgggggugagccacaaccugaugaucaccguggacgacgacgggaccaugcgcaucaaggacgacgagaccgagaacauccucaccguccugcugaagacggcccuccugaucguguccggcaucuuccccuacagcauccccgccacccugcucguguggcacaccuggcagaagcagacccagcgguccggcguccugugggacgugcccagcccgcccgagacgcagaaggccgagcuggaggaggggguguaccgcaucaagcagcagggcaucuucgggaagacccaggucggcgugggggugcagaaggagggcgucuuccacaccauguggcacgugacccggggcgccgugcucacgcacaacgggaagcgccuggagcccaacugggcguccgucaagaaggaccugaucagcuacggcgggggcuggcggcucuccgcccaguggcagaagggggaggagguccaggugaucgccgucgagcccggcaagaacccgaagaacuuccagaccaugcccggcaucuuccagaccaccacgggggagaucggcgccaucgcgcuggacuucaagcccgggaccagcggcagcccgaucaucaaccgcgagggcaaggugguggggcuguacggcaacggggucgugaccaagaacggcggguacguguccggcaucgcccagaccaacgccgagcccgacggccccacgcccgagcuggaggaggagauguucaagaagcggaaccucaccaucauggaccugcacccggggagcggcaagacccgcaaguaccugcccgccaucguccgggaggccaucaagcgccggcuccgcacccugauccuggcgcccacgcgggugguggccgccgagauggaggaggcccucaaggggcugcccauccgcuaccagaccaccgccaccaaguccgagcacacgggccgggagaucgucgaccugaugugccacgcgaccuucaccaugcgccuccugagcccggugcgggugcccaacuacaaccugaucaucauggacgaggcccacuucaccgaccccgccuccaucgccgcccgcggguacaucagcacgcgggucggcaugggcgaggcggccgccaucuucaugaccgccacgcccccggggaccgcggaggccuucccccaguccaacgcccccauccaggacgaggagcgcgacauccccgagcgcagcuggaacuccggcaacgaguggaucacggacuucguggggaagaccgugugguucgucccgagcaucaaggccggcaacgacaucgccaacugccuccggaagaacgggaagaaggugauccagcugucccgcaagaccuucgacaccgaguaccagaagacgcggcugaacgacugggacuucguggucaccaccgacaucagcgagaugggcgcgaacuucaaggccgaccgcgugaucgacccccggcgcugccucaagcccgugauccugaccgacggccccgagcgggucauccuggccgggccgaugcccgugacggccgccuccgcggcccagcgccggggccgcguggggcggaacccccagaaggagaacgaccaguacaucuucaccggccagccccucaacaacgacgaggaccacgcccacuggaccgaggccaagaugcugcuggacaacaucaacaccccggaggggaucauccccgcccucuucgagcccgagcgcgagaaguccgcggccaucgacggcgaguaccggcugaagggcgagucccgcaagaccuucgucgagcugaugcggcgcggggaccuccccguguggcuggcccacaaggucgccagcgagggcaucaaguacacggaccggaaguggugcuucgacggggagcgcaacaaccagauccuggaggagaacauggacguggagaucuggaccaaggagggcgagcggaagaagcuccgcccgcgcuggcuggacgcgcggaccuacuccgacccccuggcccucaaggaguucaaggacuucgccgccggccgcaagagcaucgcccuggaccuggugaccgagaucgggcggguccccucccaccucgcguaccgcacgcggaacgcccuggacaaccuggugaugcuccacaccagcgagcacggcgggcgcgccuaccggcacgccguggaggagcugccggagaccauggagacccugcuccugcugggccucaugauccugcugaccgggggcgccaugcuguuccugaucagcggcaaggggaucggcaagaccuccaucgggcugaucugcgucaucgugagcuccggcaugcucuggauggcggacgugccccugcaguggaucgccagcgccaucauccuggaguucuucaugaugguccuccugauccccgagcccgagaagcagcgcaccccgcaggacaaccagcuggccuacguggugaucgggauccucacccuggccgcgaucgucgccgccaacgagaugggccugcucgagacgaccaagcgggaccugggcauguccaaggagcccgggguggugagccccaccuccuaccuggacgucgaccuccaccccgccagcgccuggacccuguacgcgguggccacgaccgugaucaccccgaugcugcgccacaccaucgagaacuccacggccaacgucagccucgccgcgaucgccaaccaggccguggugcugaugggccuggacaagggguggcccaucuccaagauggaccucggcgucccccugcuggcccucgggugcuacagccaggugaacccccugacccugaccgccgcggugcuccugcuggucacccacuacgccaucaucggcccgggccuccaggccaaggccacgcgggaggcccagaagcgcaccgcggccgggaucaugaagaaccccaccguggacggcaucaugaccaucgaccuggaccccgugaucuacgacuccaaguucgagaagcagcuggggcaggucaugcuccuggugcugugcgccgugcagcuccugcugaugcggacgagcugggcccucugcgaggcccugacccuggcgaccggccccaucaccacgcucugggagggcuccccggggaaguucuggaacaccaccaucgccgucagcauggccaacaucuuccgcggcuccuaccuggccggggcgggccuggccuucagcaucaugaaguccguggggaccggccggcgcggcacggggagccagggcgagacccucggggagaaguggaagaagaagcugaaccagcugagccggaaggaguucgaccucuacaagaaguccggcaucaccgagguggaccgcaccgaggccaaggaggggcugaagcggggcgagaccacgcaccacgccgucagccgcggcuccgccaagcugcagugguucguggagcggaacauggugauccccgaggggcgcgucaucgaccucggcugcgggcgcggcggguggagcuacuacugcgcgggccugaagaaggugaccgaggugcggggcuacaccaagggcggccccgggcacgaggagcccgucccgauguccaccuacggcuggaaccuggugaagcucaugagcgggaaggacguguucuaccugccgcccgagaagugcgacacgcugcugugcgacaucggcgaguccagccccuccccgaccgucgaggagagccgcaccauccgggugcucaagaugguggagcccuggcugaagaacaaccaguucugcaucaagguccugaaccccuacaugcccaccgugaucgagcaccucgagcgccugcagcggaaguacggcgggaugcuggugcgcaacccgcucucccggaacagcacgcacgagauguacuggaucuccaacggcaccgggaacaucgucagcuccgugaacauggugagccgccugcugcucaaccgguucaccaugacccaccgccggcccacgaucgagaaggacgucgaccugggcgccggcacccgccacgugaacgccgagcccgagaccccgaacauggacgucaucggggagcggaucaagcgcaucaaggaggagcacuccagcaccuggcacuacgacgacgagaaccccuacaagacgugggccuaccacggcuccuacgaggugaaggccaccgggagcgcgagcuccaugaucaacggcguggucaagcugcucaccaagcccugggacguggugcccauggucacccagauggccaugacggacaccaccccguucgggcagcagcggguguucaaggagaagguggacacccgcacgccccggcccaugcccggcacccgcaaggucauggagaucaccgccgaguggcuguggcggacccugggccgcaacaagaagccgcgccucugcacgcgggaggaguucaccaagaaggugcgcaccaacgccgccaugggggcgguguucaccgaggagaaccagugggacagcgcccgggccgccgucgaggacgaggaguucuggaagcugguggaccgcgagcgggagcugcacaagcucggcaagugcggguccugcguguacaacaugaugggcaagcgcgagaagaagcugggggaguucggcaaggcgaagggcagccgggccaucugguacauguggcugggggcccgcuaccucgaguucgaggcccugggcuuccugaacgaggaccacugguucucccgggagaacagcuacuccggggucgagggcgaggggcuccacaagcugggcuacauccugcgcgacaucagcaagauccccggcggggccauguacgcggacgacacggccggcugggacacccggaucaccgaggacgaccuccacaacgaggagaagaucacccagcagauggaccccgagcaccgccagcuggccaacgccaucuucaagcugacguaccagaacaagguggugaagguccagcggcccaccccgaaggggaccgugauggacaucaucucccgcaaggaccagcggggcagcggccagguggggaccuacggccucaacaccuucacgaacauggaggcccagcugguccgccagauggagggggagggcgugcuguccaaggcggaccucgagaacccccaccuccuggagaagaagaucacccaguggcucgagaccaaggggguggagcggcugaagcgcauggccaucagcggcgacgacugcgucgugaagcccaucgacgaccgguucgccaacgcccugcucgcccugaacgacaugggcaaggugcgcaaggacaucccccaguggcagccguccaagggguggcacgacuggcagcagguccccuucugcagccaccacuuccacgagcugaucaugaaggacggccggaagcucguggugcccugccgcccccaggacgagcugaucgggcgcgcgcggaucucccagggcgccggguggagccugaaggagaccgccugccucggcaaggccuacgcccagauguggucccugauguacuuccaccgccgggaccugcgccucgcgagcaacgccaucugcuccgccgucccggugcacuggauccccacgagccggaccaccuggagcauccacgcccaccaccaguggaugaccacggaggacaugcugaccguguggaaccgcgucuggaucgaggacaaccccuggauggaggacaagacccccgugaccacgugggaggacgugccguaccugggcaagcgggaggaccaguggugcgggucccucaucggccugaccagccgcgcgaccugggcccagaacauccugaccgccauccagcagguccggucccucaucggggacgaggaguuccuggacuacaugcccagcaugaagcgcuuccggaaggaggaggaguccgagggcgccaucugguga

SEQ ID NO: 10320 - RNA, 9873 nt, Artificial Sequence
  derived and/or modified CDS sequence (opt1) from DENV-3__FJ410229__SS-prME
accagccugugccucaugaugaugcugcccgcgacccuggccuuccaccucaccagccgggacggcgagccgcggaugaucguggggaagaacgagcgcggcaagagccugcuguucaagaccgcguccgggaucaacaugugcacccucaucgccauggaccugggcgagaugugcgacgacaccgugacguacaagugcccccugaucgccgagguggagcccgaggacaucgacugcuggugcaaccucaccagcaccugggugaccuacgggacgugcaaccaggccggcgagcaccggcgcgacaagcgguccguggcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgugugcaagcacaccuacgucgaccggggguggggcaacgggugcggccuguucgggaagggcucccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccagcaccguggaggccgugcugcccgaguacggcacccucgggcuggagugcuccccgcgcaccggccuggacuucaacgagaugauccuccugaccaugaagaacaaggcguggaugguccaccggcagugguucuucgaccugccccuccccuggacgagcggcgccaccaccgagacccccacguggaaccgcaaggagcugcuggugaccuucaagaacgcccacgccaagaagcaggagguggucgugcucgggucccaggagggcgccaugcacaccgcgcugaccggggccacggagauccagaacagcggcgggaccuccaucuucgccggccaccugaagugccggcucaagauggacaagcuggagcugaagggcaugagcuacgccaugugccucaacaccuucgugcugaagaaggaggucuccgagacccagcacgggacgauccugaucaagguggaguacaagggcgaggacgccccgugcaagauccccuucagcaccgaggacgggcagggcaaggcgcacaacggccgccugaucaccgccaaccccguggucaccaagaaggaggagcccgugaacaucgaggccgagccgcccuucggggagagcaacaucgugaucggcaucggggacaaggcccucaagaucaacugguacaagaagggcuccagcaucgggaagauguucgaggcgacggcccggggcgcccgccggauggccauccugggcgacaccgccugggacuucggguccgucggcggggugcugaacagccucggcaagauggugcaccagaucuucggguccgcguacaccgcccuguucagcggcgucuccuggaucaugaagaucggcaucggggugcugcucaccuggaucggccugaacagcaagaacacguccaugagcuucuccugcaucgugaucgggaucaucacccuguaccucggcgccgucgugcaggccgacauggggugcgccaucaacuggaagggcaaggagcugaagugcggcagcgggaucuucgugaccaacgagguccacaccuggacggagcaguacaaguuccaggcggacucccccaagcgccuggccaccgccaucgccggcgccugggagaacggggugugcggcauccgcagcaccacccggauggagaaccuccuguggaagcagaucgcgaacgagcugaacuacauccucugggagaacaacaucaagcugacgguggucgugggggacaucaucggcgugcuggagcagggcaagcgcacccucacgccccagccgauggagcugaaguacuccuggaagaccugggggaaggccaagaucgucacggccgagacccagaacagcuccuucaucaucgacggccccaacacccccgagugccccagcgccucccgggcguggaacgugugggagguggaggacuacggguucggcgucuucaccacgaacaucuggcugaagcuccgcgagguguacacccagagcugcgaccaccggcugaugagcgccgccaucaaggacgagcgcgccgugcacgccgacaugggcuacuggaucgagucccagaagaacgggagcuggaagcuggagaaggcguccuucaucgaggucaagaccugcaccuggcccaagagccacacccucugguccaacggcgugcuggagagcgacaugaucauccccaagucccuggccgggcccaucagccagcacaaccaccggccgggcuaccacacgcagaccgccgggcccuggcaccucggcaagcuggagcuggacuucaacuacugcgagggcaccaccguggucaucacggagaacugcgggacccgcggccccucccuccggaccaccacggugagcgggaagcugauccacgaguggugcugccgcuccugcacccugcccccgcuccgguacaugggcgaggacgggugcugguacggcauggagauccgccccaucaacgagaaggaggagaacauggucaagagccuggucuccgccggcagcgggaagguggacaacuucaccaugggcgugcugugccucgccauccuguucgaggaggucaugcgggggaaguucggcaagaagcacaugaucgcgggggugcuguucaccuucgugcuccugcuguccggccagaucacguggcgcgacauggcccacacccucaucaugaucggcagcaacgccuccgaccggauggggaugggcgucaccuaccuggcccugaucgccaccuucaagauccagcccuuccucgcgcugggguucuuccugcgcaagcucacgagccgggagaaccugcugcucggcgugggccuggccauggccaccacccugcagcuccccgaggacaucgagcagauggccaacgggaucgcgcugggccugaugacccucaagcugaucacgcaguucgagaccuaccagcuguggaccgcccucgugagccugaccugcuccaacacgaucuucacccugaccgucgccuggcgcaccgccacgcucauccuggccggggugagccugcucccgcugugccaguccagcuccaugcggaagaccgacuggcugcccaugaccgucgcggccaugggcgugccgccccugccgcuguucaucuucagccugaaggacacccccaagcgccgcuccuggccccucaacgagggggugauggccgucggccuggugagcauccuggccuccagccuccugcggaacgacgugcccauggccggcccgcuggucgccggcgggcuccugaucgccugcuacgugaucacggggaccuccgccgaccugaccguggagaaggccgccgacgucaccugggaggaggaggcggagcagacgggggugagccacaaccucaugaucaccguggacgacgacgggaccaugcgcaucaaggacgacgagaccgagaacauccugaccguccugcucaagacggcccugcugaucguguccggcaucuuccccuacagcauccccgccacccuccugguguggcacaccuggcagaagcagacccagcgguccggcguccugugggacgugcccagcccgcccgagacgcagaaggccgagcucgaggaggggguguaccgcaucaagcagcagggcaucuucgggaagacccaggucggcgugggggugcagaaggagggcgucuuccacaccauguggcacgugacccggggcgccgugcugacgcacaacgggaagcgccuggagcccaacugggcguccgucaagaaggaccucaucagcuacggcgggggcuggcggcuguccgcccaguggcagaagggggaggagguccaggugaucgccgucgagcccggcaagaacccgaagaacuuccagaccaugcccggcaucuuccagaccaccacgggggagaucggcgccaucgcgcuggacuucaagcccgggaccagcggcagcccgaucaucaaccgcgagggcaaggugguggggcuguacggcaacggggucgugaccaagaacggcggguacguguccggcaucgcccagaccaacgccgagcccgacggccccacgcccgagcucgaggaggagauguucaagaagcggaaccugaccaucauggaccugcacccggggagcggcaagacccgcaaguaccuccccgccaucguccgggaggccaucaagcgccggcugcgcacccugauccucgcgcccacgcgggugguggccgccgagauggaggaggcccugaaggggcugcccauccgcuaccagaccaccgccaccaaguccgagcacacgggccgggagaucgucgaccucaugugccacgcgaccuucaccaugcgccugcugagcccggugcgggugcccaacuacaaccucaucaucauggacgaggcccacuucaccgaccccgccuccaucgccgcccgcggguacaucagcacgcgggucggcaugggcgaggcggccgccaucuucaugaccgccacgccgcccgggaccgcggaggccuucccccaguccaacgcccccauccaggacgaggagcgcgacauccccgagcgcagcuggaacuccggcaacgaguggaucacggacuucguggggaagaccgugugguucguccccagcaucaaggccggcaacgacaucgccaacugccugcggaagaacgggaagaaggugauccagcugucccgcaagaccuucgacaccgaguaccagaagacgcggcucaacgacugggacuucguggucaccaccgacaucagcgagaugggcgcgaacuucaaggccgaccgcgugaucgacccccggcgcugccugaagcccgugauccugaccgacggccccgagcgggucauccucgccgggccgaugcccgugacggccgccuccgcggcccagcgccggggccgcguggggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgcggccaucgacggcgaguaccggcugaagggcgagucccgcaagaccuucgucgagcucaugcggcgcggggaccugcccguguggcuggcccacaaggucgccagcgagggcaucaaguacacggaccggaaguggugcuucgacggggagcgcaacaaccagauccucgaggagaacauggacguggagaucuggaccaaggagggcgagcggaagaagcugcgcccgcgcuggcuggacgcgcggaccuacuccgacccccucgcccugaaggaguucaaggacuucgccgccggccgcaagagcaucgcccuggaccucgugaccgagaucgggcggguccccucccaccuggcguaccgcacgcggaacgcccuggacaaccucgugaugcugcacaccagcgagcacggcgggcgcgccuaccggcacgccguggaggagcugccggagaccauggagacccuccugcugcucggccugaugauccugcucaccgggggcgccaugcuguuccugaucagcggcaaggggaucggcaagaccuccaucgggcucaucugcgucaucgugagcuccggcaugcuguggauggcggacgugccccugcaguggaucgccagcgccaucauccucgaguucuucaugaugguccugcugauccccgagcccgagaagcagcgcaccccgcaggacaaccagcucgccuacguggugaucgggauccugacccuggccgcgaucgucgccgccaacgagaugggccuccuggagacgaccaagcgggaccugggcauguccaaggagcccgggguggugagccccaccuccuaccucgacgucgaccugcaccccgccagcgccuggacccuguacgcgguggccacgaccgugaucaccccgaugcuccgccacaccaucgagaacuccacggccaacgucagccuggccgcgaucgccaaccaggccguggugcugaugggccucgacaagggguggcccaucuccaagauggaccugggcgucccccugcucgcccuggggugcuacagccaggugaacccccugacccucaccgccgcggugcugcugcucgucacccacuacgccaucaucggcccgggccugcaggccaaggccacgcgggaggcccagaagcgcaccgcggccgggaucaugaagaaccccaccguggacggcaucaugaccaucgaccuggaccccgugaucuacgacuccaaguucgagaagcagcucgggcaggucaugcugcuggugcucugcgccgugcagcugcugcucaugcggacgagcugggcccugugcgaggcccugacccucgcgaccggccccaucaccacgcugugggagggcuccccggggaaguucuggaacaccaccaucgccgucagcauggccaacaucuuccgcggcuccuaccuggccggggcgggccucgccuucagcaucaugaaguccguggggaccggccggcgcggcacggggagccagggcgagacccugggggagaaguggaagaagaagcugaaccagcucagccggaaggaguucgaccuguacaagaaguccggcaucaccgagguggaccgcaccgaggccaaggaggggcugaagcggggcgagaccacgcaccacgccgucagccgcggcuccgccaagcuccagugguucguggagcggaacauggugauccccgaggggcgcgucaucgaccugggcugcgggcgcggcggguggagcuacuacugcgcgggccugaagaaggugaccgaggugcggggcuacaccaagggcggccccgggcacgaggagcccgucccgauguccaccuacggcuggaaccucgugaagcugaugagcgggaaggacguguucuaccugccgcccgagaagugcgacacgcugcucugcgacaucggcgaguccagccccuccccgaccgucgaggagagccgcaccauccgggugcugaagaugguggagcccuggcugaagaacaaccaguucugcaucaagguccucaaccccuacaugcccaccgugaucgagcaccuggagcgccugcagcggaaguacggcgggaugcucgugcgcaacccgcugucccggaacagcacgcacgagauguacuggaucuccaacggcaccgggaacaucgucagcuccgugaacauggugagccgccugcuccugaaccgguucaccaugacccaccgccggcccacgaucgagaaggacgucgaccugggcgccggcacccgccacgugaacgccgagcccgagaccccgaacauggacgucaucggggagcggaucaagcgcaucaaggaggagcacuccagcaccuggcacuacgacgacgagaaccccuacaagacgugggccuaccacggcuccuacgaggugaaggccaccgggagcgcgagcuccaugaucaacggcguggucaagcuccugaccaagcccugggacguggugcccauggucacccagauggccaugacggacaccaccccguucgggcagcagcggguguucaaggagaagguggacacccgcacgccccggcccaugcccggcacccgcaaggucauggagaucaccgccgaguggcuguggcggacccucggccgcaacaagaagccgcgccugugcacgcgggaggaguucaccaagaaggugcgcaccaacgccgccaugggggcgguguucaccgaggagaaccagugggacagcgcccgggccgccgucgaggacgaggaguucuggaagcugguggaccgcgagcgggagcuccacaagcugggcaagugcggguccugcguguacaacaugaugggcaagcgcgagaagaagcugggggaguucggcaaggcgaagggcagccgggccaucugguacauguggcucggggcccgcuaccuggaguucgaggcccugggcuuccucaacgaggaccacugguucucccgggagaacagcuacuccggggucgagggcgaggggcugcacaagcugggcuacauccuccgcgacaucagcaagauccccggcggggccauguacgcggacgacacggccggcugggacacccggaucaccgaggacgaccugcacaacgaggagaagaucacccagcagauggaccccgagcaccgccagcuggccaacgccaucuucaagcucacguaccagaacaagguggugaagguccagcggcccaccccgaaggggaccgugauggacaucaucucccgcaaggaccagcggggcagcggccagguggggaccuacggccugaacaccuucacgaacauggaggcccagcugguccgccagauggagggggagggcgugcucuccaaggcggaccuggagaacccccaccuccucgagaagaagaucacccaguggcuggagaccaaggggguggagcggcugaagcgcauggccaucagcggcgacgacugcgucgugaagcccaucgacgaccgguucgccaacgcccuccuggcccugaacgacaugggcaaggugcgcaaggacaucccccaguggcagccguccaagggguggcacgacuggcagcagguccccuucugcagccaccacuuccacgagcucaucaugaaggacggccggaagcugguggugcccugccgcccccaggacgagcugaucgggcgcgcgcggaucucccagggcgccggguggagccucaaggagaccgccugccugggcaaggccuacgcccagauguggucccugauguacuuccaccgccgggaccuccgccuggcgagcaacgccaucugcuccgccgucccggugcacuggauccccacgagccggaccaccuggagcauccacgcccaccaccaguggaugaccacggaggacaugcugaccguguggaaccgcgucuggaucgaggacaaccccuggauggaggacaagacccccgugaccacgugggaggacgugccguaccucggcaagcgggaggaccaguggugcgggucccugaucggccugaccagccgcgcgaccugggcccagaacauccucaccgccauccagcagguccggucccugaucggggacgaggaguuccuggacuacaugcccagcaugaagcgcuuccggaaggaggaggaguccgagggcgccaucugguga

SEQ ID NO: 10321 - RNA, 9873 nt, Artificial Sequence
  derived and/or modified CDS sequence (opt1) from DENV-3__FJ461326__SS-prME
accagccugugccucaugaugaugcugcccgccacccuggccuuccaccucaccagccgggacggcgagccccggaugaucguggggaagaacgagcggggcaagagccugcuguucaagaccgcgagcgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggacgugcaaccaggccggcgagcaccggcgcgacaagcgguccguggcccuggcgccccacgugggcauggggcuggacacccgcacccagaccuggaugagcgccgagggcgccuggcgccagguggagaagguggagacgugggcccuccgccacccgggguucaccauccuggcgcuguuccucgcccacuacaucuccaccagccugacccagaagguggugaucuucauccugcucaugcuggucacgcccuccaugaccaugcggugcgugggcguggggaaccgcgacuucgucgagggccugagcggcgccaccuggguggacgugguccucgagcacgggggcugcgugaccacgauggcccggaacaagcccacccuggacaucgagcugcagaagaccgaggccacccagcucgcgacgcugcgcaagcugugcaucgaggggaagaucaccaacaucaccaccgacucccggugccccacgcagggcgaggccauccucccggaggagcaggaccagaacuacgugugcaagcacaccuacgucgaccgcggcugggggaacggcugcgggcuguucggcaaggggagccuggugaccugcgccaaguuccagugccucgagcccaucgagggcaaggugguccaguacgagaaccugaaguacaccgugaucaucacggugcacaccggcgaccagcaccaggucgggaacgacacccagggcgugaccgucgagaucacgccccaggccuccaccguggaggccgugcugcccgaguacgggacccucggccuggagugcagcccgcggaccgggcuggacuucaacgagaugauccuccugaccaugaagaacaaggcguggaugguccaccgccagugguucuucgaccugccccuccccuggacguccggcgccaccaccgagacccccacguggaaccggaaggagcugcuggugaccuucaagaacgcccacgccaagaagcaggagguggucgugcucggcagccaggagggggccaugcacaccgcgcugaccggcgccacggagauccagaacuccgggggcaccagcaucuucgccgggcaccugaagugccgccucaagauggacaagcuggagcugaagggcauguccuacgccaugugccucaacaccuucgugcugaagaaggaggucagcgagacccagcacggcacgauccugaucaagguggaguacaagggggaggacgccccgugcaagauccccuucagcaccgaggacggccaggggaaggcgcacaacggccggcugaucaccgccaaccccguggucaccaagaaggaggagcccgugaacaucgaggccgagccgcccuucggcgaguccaacaucgugaucgggaucggcgacaaggcccucaagaucaacugguacaagaaggggagcuccaucggcaagauguucgaggcgacggcccgcggggcccggcgcauggccauccugggcgacaccgccugggacuucggcagcgucgggggcgugcugaacucccucgggaagauggugcaccagaucuucggcagcgcguacaccgcccuguucuccggggucagcuggaucaugaagaucggcaucggcgugcugcucaccuggaucgggcugaacuccaagaacacgagcauguccuucagcugcaucgugaucggcaucaucacccuguaccucggggccgucgugcaggccgacaugggcugcgccaucaacuggaaggggaaggagcugaagugcggcuccggcaucuucgugaccaacgagguccacaccuggacggagcaguacaaguuccaggcggacagccccaagcgccuggccaccgccaucgccggggccugggagaacggcgugugcgggauccgguccaccacccgcauggagaaccuccuguggaagcagaucgcgaacgagcugaacuacauccucugggagaacaacaucaagcugacgguggucgugggcgacaucaucggggugcuggagcagggcaagcggacccucacgccccagccgauggagcugaaguacagcuggaagaccuggggcaaggccaagaucgucacggccgagacccagaacuccagcuucaucaucgacgggcccaacacccccgagugccccuccgccagccgcgcguggaacgugugggagguggaggacuacggcuucggggucuucaccacgaacaucuggcugaagcuccgggagguguacacccagagcugcgaccaccgccugauguccgccgccaucaaggacgagcgggccgugcacgccgacaugggcuacuggaucgagagccagaagaacggcuccuggaagcuggagaaggcgagcuucaucgaggucaagaccugcaccuggccgaagucccacacccucuggagcaacggggugcuggaguccgacaugaucauccccaagagccuggccggccccaucucccagcacaaccaccgcccgggguaccacacgcagaccgccggccccuggcaccucgggaagcuggagcuggacuucaacuacugcgagggcaccaccguggucaucacggagaacugcggcacccgggggcccagccuccgcaccaccacgguguccggcaagcugauccacgaguggugcugccggagcugcacccugcccccgcuccgcuacaugggggaggacggcugcugguacgggauggagauccggcccaucaacgagaaggaggagaacauggugaagucccuggucagcgccggcuccggcaagguggacaacuucaccaugggggugcugugccucgccauccuguucgaggaggucaugcgcggcaaguucgggaagaagcacaugaucgcgggcgugcuguucaccuucgugcuccugcugagcgggcagaucacguggcgggacauggcccacacccucaucaugaucggcuccaacgccagcgaccgcaugggcaugggggucaccuaccuggcccugaucgccaccuucaagauccagcccuuccucgcgcugggcuucuuccugcggaagcucacgagccgcgagaaccugcugcucggggugggccuggccauggccaccacccugcagcuccccgaggacaucgagcagauggccaacggcaucgcgcuggggcugaugacccucaagcugaucacgcaguucgagaccuaccagcuguggaccgcccucgugucccugaccugcagcaacacgaucuucacccugaccgucgccuggcggaccgccacgcucauccuggccggcgugucccugcucccgcugugccagagcuccagcaugcgcaagaccgacuggcugcccaugaccgucgcggccaugggggugccgccccugccgcuguucaucuucucccugaaggacacccccaagcgccggagcuggccccucaacgagggcgugauggccgucgggcugguguccauccuggccagcucccuccugcgcaacgacgugcccauggccggcccgcuggucgcgggcgggcuccugaucgccugcuacgugaucacgggcaccagcgccgaccugaccguggagaaggccgccgacgucaccugggaggaggaggcggagcagacgggggugucccacaaccucaugaucaccguggacgacgacggcaccaugcggaucaaggacgacgagaccgagaacauccugaccguccugcucaagacggcccugcugaucgugagcgggaucuuccccuacuccauccccgccacccuccugguguggcacaccuggcagaagcagacccagcgcagcggcguccugugggacgugcccuccccgcccgagacgcagaaggccgagcucgaggagggcguguaccggaucaagcagcaggggaucuucggcaagacccaggucggggugggcgugcagaaggagggggucuuccacaccauguggcacgugacccgcggcgccgugcugacgcacaacggcaagcggcuggagcccaacugggcgagcgucaagaaggaccucaucuccuacgggggcggguggcgccugagcgcccaguggcagaagggcgaggagguccaggugaucgccgucgagcccgggaagaacccgaagaacuuccagaccaugcccggcaucuuccagaccaccacgggcgagaucggggccaucgcgcuggacuucaagcccggcaccagcggguccccgaucaucaaccgggagggcaagguggugggccuguacgggaacggcgucgugaccaagaacgggggcuacgugagcgggaucgcccagaccaacgccgagcccgacggccccacgcccgagcucgaggaggagauguucaagaagcgcaaccugaccaucauggaccugcacccgggcuccgggaagacccggaaguaccuccccgccaucguccgcgaggccaucaagcggcgccugcggacccugauccucgcgcccacgcgcgugguggccgccgagauggaggaggcccugaagggccugcccauccgguaccagaccaccgccaccaagagcgagcacacggggcgcgagaucgucgaccucaugugccacgcgaccuucaccaugcggcugcuguccccggugcgcgugcccaacuacaaccucaucaucauggacgaggcccacuucaccgaccccgccagcaucgccgcccggggcuacaucuccacgcgcgucgggaugggcgaggcggccgccaucuucaugaccgccacgccgcccggcaccgcggaggccuucccccagagcaacgcccccauccaggacgaggagcgcgacauccccgagcgguccuggaacagcgggaacgaguggaucacggacuucgugggcaagaccgugugguucguccccuccaucaaggccgggaacgacaucgccaacugccugcgcaagaacggcaagaaggugauccagcugagccggaagaccuucgacaccgaguaccagaagacgcgccucaacgacugggacuucguggucaccaccgacaucuccgagaugggggcgaacuucaaggccgaccgggugaucgacccccgccggugccugaagcccgugauccugaccgacggccccgagcgcgucauccucgccggcccgaugcccgugacggccgccagcgcggcccagcggcgcgggcgggugggccgcaacccccagaaggagaacgaccaguacaucuucaccgggcagccccugaacaacgacgaggaccacgcccacuggaccgaggccaagaugcugcucgacaacaucaacaccccggagggcaucauccccgcccuguucgagcccgagcgggagaaguccgcggccaucgacggggaguaccgccugaagggcgagagccggaagaccuucgucgagcucaugcgccggggcgaccugcccguguggcuggcccacaaggucgccuccgaggggaucaaguacacggaccgcaaguggugcuucgacggcgagcggaacaaccagauccucgaggagaacauggacguggagaucuggaccaaggagggggagcgcaagaagcugcgcccgcgguggcuggacgcgcgcaccuacagcgacccccucgcccugaaggaguucaaggacuucgccgccggccggaaguccaucgcccuggaccucgugaccgagaucggccgcguccccagccaccuggcguaccggacgcgcaacgcccuggacaaccucgugaugcugcacaccagcgagcacgggggccgggccuaccgccacgccguggaggagcugccggagaccauggagacccuccugcugcucgggcugaugauccugcucacgggcggggccaugcuguuccugaucuccggcaagggcaucgggaagaccagcaucggccucaucugcgucaucgcguccagcgggaugcuguggauggccgacgugccccugcaguggaucgccuccgccaucauccucgaguucuucaugauggugcugcugauccccgagcccgagaagcagcggaccccgcaggacaaccagcucgccuacgucgugaucggcauccugacccuggcggccaucguggccgccaacgagauggggcuccuggagacgaccaagcgcgaccugggcaugagcaaggagcccggcgucgugucccccaccagcuaccucgacguggaccugcaccccgccuccgcguggacccuguacgccgucgccacgaccgugaucaccccgaugcuccggcacaccaucgagaacagcacggccaacgugucccuggcggccaucgccaaccaggccgucgugcugauggggcucgacaagggcuggcccaucagcaagauggaccugggggugccccugcucgcccugggcugcuacucccaggucaacccccugacccucaccgcggccgugcugcugcucgugacccacuacgccaucaucgggccgggccugcaggccaaggccacgcgcgaggcgcagaagcggaccgccgccggcaucaugaagaaccccaccgucgacgggaucaugaccaucgaccuggaccccgugaucuacgacagcaaguucgagaagcagcucggccaggugaugcugcugguccucugcgccgugcagcugcugcucaugcgcacguccugggcccugugcgaggcgcugacccucgccaccgggcccaucaccacgcugugggagggcagcccgggcaaguucuggaacaccaccaucgccguguccauggccaacaucuuccgggggagcuaccuggcgggcgccgggcucgccuucuccaucaugaaguccgucggcaccgggcgccggggcacgggcagccagggggagacccugggcgagaaguggaagaagaagcugaaccagcucucccgcaaggaguucgaccuguacaagaaguccgggaucaccgagguggaccggaccgaggccaaggagggccugaagcgcggggagaccacgcaccacgccgugucccggggcagcgcgaagcuccagugguucgucgagcgcaacauggugauccccgagggccgcgugaucgaccuggggugcggccgcgggggcugguccuacuacugcgccgggcugaagaaggucaccgaggugcgcggcuacaccaagggcgggcccggccacgaggagcccgugccgaugagcaccuacggguggaaccucgucaagcugauguccggcaaggacguguucuaccugccgcccgagaagugcgacacgcugcucugcgacaucggggagagcucccccagcccgaccguggaggagucccggaccauccgcguccugaagaugguggagcccuggcugaagaacaaccaguucugcaucaaggugcucaaccccuacaugcccaccgucaucgagcaccuggagcggcugcagcgcaaguacggcggcaugcucgugcggaacccgcugagccgcaacuccacgcacgagauguacuggaucagcaacgggaccggcaacaucguguccagcgucaacauggugucccggcugcuccugaaccgcuucaccaugacccaccggcgccccacgaucgagaaggacguggaccugggggccggcacccggcacgucaacgccgagcccgagaccccgaacauggacgugaucggcgagcgcaucaagcggaucaaggaggagcacagcuccaccuggcacuacgacgacgagaaccccuacaagacgugggccuaccacgggagcuacgaggucaaggcgaccggcagcgccuccagcaugaucaacgggguggugaagcuccugaccaagcccugggacgucgugcccauggugacccagauggccaugacggacaccaccccguucggccagcagcgcgucuucaaggagaagguggacacccggacgccccgccccaugcccgggacccggaaggugauggagaucaccgccgaguggcuguggcgcacccucggccgcaacaagaagccgcggcugugcacgcgcgaggaguucaccaagaagguccggaccaacgccgcgaugggcgccguguucaccgaggagaaccagugggacuccgcccgcgccgcgguggaggacgaggaguucuggaagcuggucgaccgggagcgcgagcuccacaagcuggggaagugcggcagcugcguguacaacaugauggggaagcgggagaagaagcugggcgaguucgggaaggccaagggcucccgcgccaucugguacauguggcucggcgcccgguaccuggaguucgaggcccugggguuccucaacgaggaccacugguucagccgcgagaacuccuacagcggcguggagggggagggccugcacaagcugggguacauccuccgggacaucuccaagauccccggcggcgcgauguacgccgacgacacggccgggugggacacccgcaucaccgaggacgaccugcacaacgaggagaagaucacccagcagauggaccccgagcaccggaagcuggccaacgccaucuucaagcucacguaccagaacaaggucgugaaggugcagcgccccaccccgaagggcaccgucauggacaucaucagccggaaggaccagcgcggguccggccaggugggcaccuacgggcugaacaccuucacgaacauggaggcgcagcuggugcggcagauggagggcgaggggguccucagcaaggccgaccuggagaacccccaccuccucgagaagaagaucacccaguggcuggagaccaagggcguggagcgccugaagcggauggccaucuccggggacgacugcguggucaagcccaucgacgaccgcuucgccaacgcccuccuggcgcugaacgacaugggcaaggugcggaaggacaucccccaguggcagccgagcaagggcuggcacgacuggcagcagguccccuucugcucccaccacuuccacgagcucaucaugaaggacgggcgcaagcuggucgugcccugccgcccccaggacgagcugaucggccgggcccgcaucagccagggggccggcuggucccucaaggagaccgccugccuggggaaggccuacgcgcagauguggagccugauguacuuccaccggcgcgaccuccggcuggccuccaacgccaucugcagcgccgugccgguccacuggauccccacgagccgcaccaccugguccauccacgcgcaccaccaguggaugaccacggaggacaugcugaccguguggaaccggguguggaucgaggacaaccccuggauggaggacaagacccccgucaccacgugggaggacgugccguaccucggcaagcgcgaggaccaguggugcggcagccugaucgggcugaccucccgggccaccugggcccagaacauccucaccgccauccagcagguccgcagccugaucggcgacgaggaguuccuggacuacaugcccuccaugaagcgguuccgcaaggaggaggagagcgagggggccaucugguga

SEQ ID NO: 10322 - RNA, 9873 nt, Artificial Sequence
  derived and/or modified CDS sequence (opt1) from DENV-3__FJ461329__SS-prME
accagccugugccucaugaugaugcugcccgcgacccuggccuuccaccucaccagccgggacggcgagccgcggaugaucguggggaagaacgagcgcggcaagagccugcuguucaagaccgcguccgggaucaacaugugcacccucaucgccauggaccugggcgagaugugcgacgacaccgugacguacaagugcccccugaucgccgagguggagcccgaggacaucgacugcuggugcaaccucaccagcaccugggugaccuacgggacgugcaaccaggccggcgagcaccggcgcgacaagcgguccguggcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgugugcaagcacaccuacgucgaccggggguggggcaacgggugcggccuguucgggaagggcucccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccagcaccguggaggccgugcugcccgaguacggcacccucgggcuggagugcuccccgcgcaccggccuggacuucaacgagaugauccuccugaccaugaagaacaaggcguggaugguccaccggcagugguucuucgaccugccccuccccuggacgagcggcgccaccaccgagacccccacguggaaccgcaaggagcugcuggugaccuucaagaacgcccacgccaagaagcaggagguggucgugcucgggucccaggagggcgccaugcacaccgcgcugaccggggccacggagauccagaacagcggcgggaccuccaucuucgccggccaccugaagugccggcucaagauggacaagcuggagcugaagggcaugagcuacgccaugugccucaacaccuucgugcugaagaaggaggucuccgagacccagcacgggacgauccugaucaagguggaguacaagggcgaggacgccccgugcaagauccccuucagcaccgaggacgggcagggcaaggcgcacaacggccgccugaucaccgccaaccccguggucaccaagaaggaggagcccgugaacaucgaggccgagccgcccuucggggagagcaacaucgugaucggcaucggggacaaggcccucaagaucaacugguacaagaagggcuccagcaucgggaagauguucgaggcgacggcccggggcgcccgccggauggccauccugggcgacaccgccugggacuucggguccgucggcggggugcugaacagccucggcaagauggugcaccagaucuucggguccgcguacaccgcccuguucagcggcgucuccuggaucaugaagaucggcaucggggugcugcucaccuggaucggccugaacagcaagaacacguccaugagcuucuccugcaucgugaucgggaucaucacccuguaccucggcgccgucgugcaggccgacauggggugcgccaucaacuggaagggcaaggagcugaagugcggcagcgggaucuucgugaccaacgagguccacaccuggacggagcaguacaaguuccaggcggacucccccaagcgccuggccaccgccaucgccggcgccugggagaacggggugugcggcauccgcagcaccacccggauggagaaccuccuguggaagcagaucgcgaacgagcugaacuacauccucugggagaacaacaucaagcugacgguggucgugggggacaucaucggcgugcuggagcagggcaagcgcacccucacgccccagccgauggagcugaaguacuccuggaagaccugggggaaggccaagaucgucacggccgagacccagaacagcuccuucaucaucgacggccccaacacccccgagugccccagcgccucccgggcguggaacgugugggagguggaggacuacggguucggcgucuucaccacgaacaucuggcugaagcuccgcgagguguacacccagagcugcgaccaccggcugaugagcgccgccaucaaggacgagcgcgccgugcacgccgacaugggcuacuggaucgagucccagaagaacgggagcuggaagcuggagaaggcguccuucaucgaggucaagaccugcaccuggcccaagagccacacccucugguccaacggcgugcuggagagcgacaugaucauccccaagucccuggccgggcccaucagccagcacaaccaccggccgggcuaccacacgcagaccgccgggcccuggcaccucggcaagcuggagcuggacuucaacuacugcgagggcaccaccguggucaucacggaggacugcgggacccgcggccccucccuccggaccaccacggugagcgggaagcugauccacgaguggugcugccgcuccugcacccugcccccgcuccgguacaugggcgaggacgggugcugguacggcauggagauccgccccaucaacgagaaggaggagaacauggucaagagccuggucuccgccggcagcgggaagguggacaacuucaccaugggcgugcugugccucgccauccuguucgaggaggucaugcgggggaaguucggcaagaagcacaugaucgcgggggugcuguucaccuucgugcuccugcuguccggccagaucacguggcgcgacauggcccacacccucaucaugaucggcagcaacgccuccgaccggauggggaugggcgucaccuaccuggcccugaucgccaccuucaagauccagcccuuccucgcgcugggguucuuccugcgcaagcucacgagccgggagaaccugcugcucggcgugggccuggccauggccaccacccugcagcuccccgaggacaucgagcagauggccaacgggaucgcgcugggccugaugacccucaagcugaucacgcaguucgagaccuaccagcuguggaccgcccucgugagccugaccugcuccaacacgaucuucacccugaccgucgccuggcgcaccgccacgcucauccuggccggggugagccugcucccgcugugccaguccagcuccaugcggaagaccgacuggcugcccaugaccgucgcggccaugggcgugccgccccugccgcuguucaucuucagccugaaggacacccccaagcgccgcuccuggccccucaacgagggggugauggccgucggccuggugagcauccuggccuccagccuccugcggaacgacgugcccauggccggcccgcuggucgccggcgggcuccugaucgccugcuacgugaucacggggaccuccgccgaccugaccguggagaaggccgccgacgucaccugggaggaggaggcggagcagacgggggugagccacaaccucaugaucaccguggacgacgacgggaccaugcgcaucaaggacgacgagaccgagaacauccugaccguccugcucaagacggcccugcugaucguguccggcaucuuccccuacagcauccccgccacccuccugguguggcacaccuggcagaagcagacccagcgguccggcguccugugggacgugcccagcccgcccgagacgcagaaggccgagcucgaggaggggguguaccgcaucaagcagcagggcaucuucgggaagacccaggucggcgugggggugcagaaggagggcgucuuccacaccauguggcacgugacccggggcgccgugcugacgcacaacgggaagcgccuggagcccaacugggcguccgucaagaaggaccucaucagcuacggcgggggcuggcggcuguccgcccaguggcagaagggggaggagguccaggugaucgccgucgagcccggcaagaacccgaagaacuuccagaccaugcccggcaucuuccagaccaccacgggggagaucggcgccaucgcgcuggacuucaagcccgggaccagcggcagcccgaucaucaaccgcgagggcaaggugguggggcuguacggcaacggggucgugaccaagaacggcggguacguguccggcaucgcccagaccaacgccgagcccgacggccccacgcccgagcucgaggaggagauguucaagaagcggaaccugaccaucauggaccugcacccggggagcggcaagacccgcaaguaccuccccgccaucguccgggaggccaucaagcgccggcugcgcacccugauccucgcgcccacgcgggugguggccgccgagauggaggaggcccugaaggggcugcccauccgcuaccagaccaccgccaccaaguccgagcacacgggccgggagaucgucgaccucaugugccacgcgaccuucaccaugcgccugcugagcccggugcgggugcccaacuacaaccucaucaucauggacgaggcccacuucaccgaccccgccuccaucgccgcccgcggguacaucagcacgcgggucggcaugggcgaggcggccgccaucuucaugaccgccacgccgcccgggaccgcggaggccuucccccaguccaacgcccccauccaggacgaggagcgcgacauccccgagcgcagcuggaacuccggcaacgaguggaucacggacuucguggggaagaccgugugguucguccccagcaucaaggccggcaacgacaucgccaacugccugcggaagaacgggaagaaggugauccagcugucccgcaagaccuucgacaccgaguaccagaagacgcggcucaacgacugggacuucguggucaccaccgacaucagcgagaugggcgcgaacuucaaggccgaccgcgugaucgacccccggcgcugccugaagcccgugauccugaccgacggccccgagcgggucauccucgccgggccgaugcccgugacggccgccuccgcggcccagcgccggggccgcguggggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgcggccaucgacggcgaguaccggcugaagggcgagucccgcaagaccuucgucgagcucaugcggcgcggggaccugcccguguggcuggcccacaaggucgccagcgagggcaucaaguacacggaccggaaguggugcuucgacggggagcgcaacaaccagauccucgaggagaacauggacguggagaucuggaccaaggagggcgagcggaagaagcugcgcccgcgcuggcuggacgcgcggaccuacuccgacccccucgcccugaaggaguucaaggacuucgccgccggccgcaagagcaucgcccuggaccucgugaccgagaucgggcggguccccucccaccuggcguaccgcacgcggaacgcccuggacaaccucgugaugcugcacaccagcgagcacggcgggcgcgccuaccggcacgccguggaggagcugccggagaccauggagacccuccugcugcucggccugaugauccugcucaccgggggcgccaugcuguuccugaucagcggcaaggggaucggcaagaccuccaucgggcucaucugcgucaucgugagcuccggcaugcuguggauggcggacaucccccugcaguggaucgccagcgccaucgugcucgaguucuucaugaugguccugcugauccccgagcccgagaagcagcgcaccccgcaggacaaccagcucgccuacguggugaucgggauccugacccuggccgcgaucgucgccgccaacgagaugggccuccuggagacgaccaagcgggaccugggcauguccaaggagcccgggguggugagccccaccuccuaccucgacgucgaccugcaccccgccagcgccuggacccuguacgcgguggccacgaccgugaucaccccgaugcuccgccacaccaucgagaacuccacggccaacgucagccuggccgcgaucgccaaccaggccguggugcugaugggccucgacaagggguggcccaucuccaagauggaccugggcgucccccugcucgcccuggggugcuacagccaggugaacccccugacccucaccgccgcggugcugcugcucgucacccacuacgccaucaucggcccgggccugcaggccaaggccacgcgggaggcccagaagcgcaccgcggccgggaucaugaagaaccccaccguggacggcaucaugaccaucgaccuggaccccgugaucuacgacuccaaguucgagaagcagcucgggcaggucaugcugcuggugcucugcgccgugcagcugcugcucaugcggacgagcugggcccugugcgaggcccugacccucgcgaccggccccaucaccacgcugugggagggcuccccggggaaguucuggaacaccaccaucgccgucagcauggccaacaucuuccgcggcuccuaccuggccggggcgggccucgccuucagcaucaugaaguccguggggaccggccggcgcggcacggggagccagggcgagacccugggggagaaguggaagaagaagcugaaccagcucagccggaaggaguucgaccuguacaagaaguccggcaucaccgagguggaccgcaccgaggccaaggaggggcugaagcggggcgagaccacgcaccacgccgucagccgcggcuccgccaagcuccagugguucguggagcggaacauggugauccccgaggggcgcgucaucgaccugggcugcgggcgcggcggguggagcuacuacugcgcgggccugaagaaggugaccgaggugcggggcuacaccaagggcggccccgggcacgaggagcccgucccgauguccaccuacggcuggaaccucgugaagcugaugagcgggaaggacguguucuaccugccgcccgagaagugcgacacgcugcucugcgacaucggcgaguccagccccuccccgaccgucgaggagagccgcaccauccgggugcugaagaugguggagcccuggcugaagaacaaccaguucugcaucaagguccucaaccccuacaugcccaccgugaucgagcaccuggagcgccugcagcggaaguacggcgggaugcucgugcgcaacccgcugucccggaacagcacgcacgagauguacuggaucuccaacggcaccgggaacaucgucagcuccgugaacauggugagccgccugcuccugaaccgguucaccaugacccaccgccggcccacgaucgagaaggacgucgaccugggcgccggcacccgccacgugaacgccgagcccgagaccccgaacauggacgucaucggggagcggaucaagcgcaucaaggaggagcacuccagcaccuggcacuacgacgacgagaaccccuacaagacgugggccuaccacggcuccuacgaggugaaggccaccgggagcgcgagcuccaugaucaacggcguggucaagcuccugaccaagcccugggacguggugcccauggucacccagauggccaugacggacaccaccccguucgggcagcagcggguguucaaggagaagguggacacccgcacgccccggcccaugcccggcacccgcaaggucauggagaucaccgccgaguggcuguggcggacccucggccgcaacaagaagccgcgccugugcacgcgggaggaguucaccaagaaggugcgcaccaacgccgccaugggggcgguguucaccgaggagaaccagugggacagcgcccgggccgccgucgaggacgaggaguucuggaagcugguggaccgcgagcgggagcuccacaagcugggcaagugcggguccugcguguacaacaugaugggcaagcgcgagaagaagcugggggaguucggcaaggcgaagggcagccgggccaucugguacauguggcucggggcccgcuaccuggaguucgaggcccugggcuuccucaacgaggaccacugguucucccgggagaacagcuacuccggggucgagggcgaggggcugcacaagcugggcuacauccuccgcgacaucagcaagauccccggcggggccauguacgcggacgacacggccggcugggacacccggaucaccgaggacgaccugcacaacgaggagaagaucacccagcagauggaccccgagcaccgccagcuggccaacgccaucuucaagcucacguaccagaacaagguggugaagguccagcggcccaccccgaaggggaccgugauggacaucaucucccgcaaggaccagcggggcagcggccagguggggaccuacggccugaacaccuucacgaacauggaggcccagcugguccgccagauggagggggagggcgugcucuccaaggcggaccuggagaacccccaccuccucgagaagaagaucacccaguggcuggagaccaaggggguggagcggcugaagcgcauggccaucagcggcgacgacugcgucgugaagcccaucgacgaccgguucgccaacgcccuccuggcccugaacgacaugggcaaggugcgcaaggacaucccccaguggcagccguccaagggguggcacgacuggcagcagguccccuucugcagccaccacuuccacgagcucaucaugaaggacggccggaagcugguggugcccugccgcccccaggacgagcugaucgggcgcgcgcggaucucccagggcgccggguggagccucaaggagaccgccugccugggcaaggccuacgcccagauguggucccugauguacuuccaccgccgggaccuccgccuggcgagcaacgccaucugcuccgccgucccggugcacuggauccccacgagccggaccaccuggagcauccacgcccaccaccaguggaugaccacggaggacaugcugaccguguggaaccgcgucuggaucgaggacaaccccuggauggaggacaagacccccgugaccacgugggaggacgugccguaccucggcaagcgggaggaccaguggugcgggucccugaucggccugaccagccgcgcgaccugggcccagaacauccucaccgccauccagcagguccggucccugaucgggaacgaggaguuccuggacuacaugcccagcaugaagcgcuuccggaaggaggaggaguccgagggcgccaucugguga

SEQ ID NO: 10323 - RNA, 9873 nt, Artificial Sequence
  derived and/or modified CDS sequence (opt1) from DENV-3__KF955459__SS-prME
accagccugugccucaugaugaugcugcccgccacccuggccuuccaccucaccagccgggacggcgagccgcggaugaucguggggaagaacgagcgcggcaagagccugcuguucaagaccgcguccgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgugugcaagcacaccuacgucgaccggggguggggcaacgggugcggccuguucgggaagggcucccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccagcaccguggaggccgugcugcccgaguacggcacccucgggcuggagugcuccccgcgcaccggccuggacuucaacgagaugauccuccugaccaugaagaacaaggcguggaugguccaccggcagugguucuucgaccugccccuccccuggacgagcggcgccaccaccgagacccccacguggaaccgcaaggagcugcuggugaccuucaagaacgcccacgccaagaagcaggagguggucgugcucgggucccaggagggcgccaugcacaccgcgcugaccggggccacggagauccagaacagcggcgggaccuccaucuucgccggccaccugaagugccggcucaagauggacaagcuggagcugaagggcaugagcuacgccaugugccucaacaccuucgugcugaagaaggaggucuccgagacccagcacgggacgauccugaucaagguggaguacaagggcgaggacgccccgugcaagauccccuucagcaccgaggacgggcagggcaaggcgcacaacggccgccugaucaccgccaaccccguggucaccaagaaggaggagcccgugaacaucgaggccgagccgcccuucggggagagcaacaucgugaucggcaucggggacaaggcccucaagaucaacugguacaagaagggcuccagcaucgggaagauguucgaggcgacggcccggggcgcccgccggauggccauccugggcgacaccgccugggacuucggguccgucggcggggugcugaacagccucggcaagauggugcaccagaucuucggguccgcguacaccgcccuguucagcggcgucuccuggaucaugaagaucggcaucggggugcugcucaccuggaucggccugaacagcaagaacacguccaugagcuucuccugcaucgugaucgggaucaucacccuguaccucggcgccgucgugcaggccgacauggggugcgccaucaacuggaagggcaaggagcugaagugcggcagcgggaucuucgugaccaacgagguccacaccuggacggagcaguacaaguuccaggcggacucccccaagcgccuggccaccgccaucgccggcgccugggagaacggggugugcggcauccgcagcgcgacccggauggagaaccuccuguggaagcagaucgccaacgagcugaacuacauccucugggagaacaacaucaagcugaccguggucgugggggacaucaucggcgugcuggagcagggcaagcgcacgcucacgccccagccgauggagcugaaguacuccuggaagaccugggggaaggccaagaucgucaccgccgagacgcagaacagcuccuucaucaucgacggccccaacacccccgagugccccagcgcgucccgggccuggaacgugugggagguggaggacuacggguucggcgucuucaccaccaacaucuggcugaagcuccgcgagguguacacgcagagcugcgaccaccggcugaugagcgccgccaucaaggacgagcgcgccgugcacgcggacaugggcuacuggaucgagucccagaagaacgggagcuggaagcuggagaaggccuccuucaucgaggucaagaccugcaccuggcccaagagccacacccucugguccaacggcgugcuggagagcgacaugaucauccccaagucccuggccgggcccaucagccagcacaaccaccggccgggcuaccacacccagacggccgggcccuggcaccucggcaagcuggagcuggacuucaacuacugcgagggcaccaccguggucaucaccgagaacugcgggacgcgcggccccucccuccggaccaccaccgugagcgggaagcugauccacgaguggugcugccgcuccugcacgcugcccccgcuccgguacaugggcgaggacgggugcugguacggcauggagauccgccccaucaacgagaaggaggagaacauggucaagagccuggucuccgccggcagcgggaagguggacaacuucaccaugggcgugcugugccucgcgauccuguucgaggaggucaugcgggggaaguucggcaagaagcacaugaucgccggggugcuguucaccuucgugcuccugcuguccggccagaucaccuggcgcgacauggcccacacgcucaucaugaucggcagcaacgccuccgaccggauggggaugggcgucaccuaccuggcccugaucgcgaccuucaagauccagcccuuccucgcccugggguucuuccugcgcaagcucaccagccgggagaaccugcugcucggcgugggccuggccauggccacgacccugcagcuccccgaggacaucgagcagauggcgaacgggaucgcccugggccugaugacccucaagcugaucacccaguucgagacguaccagcuguggaccgcccucgugagccugaccugcuccaacaccaucuucacgcugaccgucgccuggcgcaccgccacccucauccuggcgggggugagccugcucccgcugugccaguccagcuccaugcggaagacggacuggcugcccaugaccgucgccgccaugggcgugccgccccugccgcuguucaucuucagccugaaggacacccccaagcgccgcuccuggccccucaacgagggggugauggccgucggccuggugagcauccuggccuccagccuccugcggaacgacgugcccauggcgggcccgcuggucgccgggggccuccugaucgccugcuacgugaucaccgggacguccgccgaccugaccguggagaaggccgcggacgucaccugggaggaggaggccgagcagaccggcgugagccacaaccucaugaucacgguggacgacgacgggaccaugcgcaucaaggacgacgagaccgagaacauccugaccguccugcucaagaccgcccugcugaucguguccggcaucuuccccuacagcauccccgccacgcuccugguguggcacaccuggcagaagcagacccagcgguccggcguccugugggacgugcccagcccgcccgagacccagaaggccgagcucgaggaggggguguaccgcaucaagcagcagggcaucuucgggaagacgcaggucggcgugggggugcagaaggagggcgucuuccacaccauguggcacgugacccggggcgcggugcugacccacaacgggaagcgccuggagcccaacugggccuccgucaagaaggaccucaucagcuacggcgggggcuggcggcuguccgcccaguggcagaagggggaggagguccaggugaucgccgucgagcccggcaagaacccgaagaacuuccagacgaugcccggcaucuuccagaccaccaccggggagaucggcgcgaucgcccuggacuucaagcccgggacgagcggcagcccgaucaucaaccgcgagggcaaggugguggggcuguacggcaacggggucgugaccaagaacggcggguacguguccggcaucgcccagaccaacgccgagcccgacggccccacccccgagcucgaggaggagauguucaagaagcggaaccugacgaucauggaccugcacccggggagcggcaagacccgcaaguaccuccccgccaucguccgggaggcgaucaagcgccggcugcgcacccugauccucgcccccacccgggugguggccgccgagauggaggaggcccugaaggggcugcccauccgcuaccagacgaccgcgaccaaguccgagcacaccggccgggagaucgucgaccucaugugccacgccacguucaccaugcgccugcugagcccggugcgggugcccaacuacaaccucaucaucauggacgaggcccacuucaccgaccccgccuccaucgccgcgcgcggguacaucagcacccgggucggcaugggcgaggccgccgccaucuucaugacggcgacgccgcccgggaccgccgaggccuucccccaguccaacgcccccauccaggacgaggagcgcgacauccccgagcgcagcuggaacuccggcaacgaguggaucaccgacuucguggggaagacggugugguucguccccagcaucaaggccggcaacgacaucgcgaacugccugcggaagaacgggaagaaggugauccagcugucccgcaagaccuucgacaccgaguaccagaagacccggcucaacgacugggacuucguggucacgaccgacaucagcgagaugggcgccaacuucaaggccgaccgcgugaucgacccccggcgcugccugaagcccgugauccugaccgacggccccgagcgggucauccucgccgggccgaugcccgugaccgccgcguccgccgcccagcgccggggccgcguggggcggaacccccagaaggagaacgaccaguacaucuucacgggccagccccugaacaacgacgaggaccacgcccacuggaccgaggccaagaugcugcucgacaacaucaacaccccggaggggaucauccccgcgcuguucgagcccgagcgcgagaaguccgccgccaucgacggcgaguaccggcugaagggcgagucccgcaagaccuucgucgagcucaugcggcgcggggaccugcccguguggcuggcccacaaggucgcgagcgagggcaucaaguacaccgaccggaaguggugcuucgacggggagcgcaacaaccagauccucgaggagaacauggacguggagaucuggacgaaggagggcgagcggaagaagcugcgcccgcgcuggcuggacgcccggaccuacuccgacccccucgcccugaaggaguucaaggacuucgccgccggccgcaagagcaucgcgcuggaccucgugaccgagaucgggcggguccccucccaccuggccuaccgcacccggaacgcccuggacaaccucgugaugcugcacacgagcgagcacggcgggcgcgccuaccggcacgccguggaggagcugccggagaccauggagacccuccugcugcucggccugaugauccugcucaccgggggcgcgaugcuguuccugaucagcggcaaggggaucggcaagacguccaucgggcucaucugcgucaucgugagcuccggcaugcuguggauggccgacgugccccugcaguggaucgccagcgccaucauccucgaguucuucaugaugguccugcugauccccgagcccgagaagcagcgcaccccgcaggacaaccagcucgccuacguggugaucgggauccugacccuggcggccaucgucgccgccaacgagaugggccuccuggagaccacgaagcgggaccugggcauguccaaggagcccgggguggugagccccaccuccuaccucgacgucgaccugcaccccgccagcgcguggacccuguacgccguggccaccacggugaucaccccgaugcuccgccacaccaucgagaacuccaccgccaacgucagccuggcggccaucgccaaccaggccguggugcugaugggccucgacaagggguggcccaucuccaagauggaccugggcgucccccugcucgcccuggggugcuacagccaggugaacccccugacgcucaccgcggccgugcugcugcucgucacccacuacgccaucaucggcccgggccugcaggccaaggccacccgggaggcgcagaagcgcacggccgccgggaucaugaagaaccccaccguggacggcaucaugaccaucgaccuggaccccgugaucuacgacuccaaguucgagaagcagcucgggcaggucaugcugcuggugcucugcgccgugcagcugcugcucaugcggaccagcugggcccugugcgaggcgcugacgcucgccaccggccccaucaccacccugugggagggcuccccggggaaguucuggaacacgaccaucgccgucagcauggccaacaucuuccgcggcuccuaccuggcgggggccggccucgccuucagcaucaugaaguccguggggaccggccggcgcggcaccgggagccagggcgagacgcugggggagaaguggaagaagaagcugaaccagcucagccggaaggaguucgaccuguacaagaaguccggcaucaccgagguggaccgcaccgaggccaaggaggggcugaagcggggcgagaccacccaccacgccgucagccgcggcuccgcgaagcuccagugguucguggagcggaacauggugauccccgaggggcgcgucaucgaccugggcugcgggcgcggcggguggagcuacuacugcgccggccugaagaaggugacggaggugcggggcuacaccaagggcgggcccgggcacgaggagcccgucccgauguccaccuacggcuggaaccucgugaagcugaugagcgggaaggacguguucuaccugccgcccgagaagugcgacacccugcucugcgacaucggcgaguccagccccuccccgacggucgaggagagccgcaccauccgggugcugaagaugguggagcccuggcugaagaacaaccaguucugcaucaagguccucaaccccuacaugcccaccgugaucgagcaccuggagcgccugcagcggaaguacggcgggaugcucgugcgcaacccgcugucccggaacagcacccacgagauguacuggaucuccaacggcacggggaacaucgucagcuccgugaacauggugagccgccugcuccugaaccgguucaccaugacccaccgccggcccaccaucgagaaggacgucgaccugggcgccggcacgcgccacgugaacgccgagcccgagaccccgaacauggacgucaucggggagcggaucaagcgcaucaaggaggagcacuccagcaccuggcacuacgacgacgagaaccccuacaagaccugggccuaccacggcuccuacgaggugaaggcgacggggagcgccagcuccaugaucaacggcguggucaagcuccugaccaagcccugggacguggugcccauggucacccagauggccaugaccgacacgaccccguucgggcagcagcggguguucaaggagaagguggacacccgcacgccccggcccaugcccggcacgcgcaaggucauggagaucaccgccgaguggcuguggcggacccucggccgcaacaagaagccgcgccugugcacccgggaggaguucacgaagaaggugcgcaccaacgccgcgaugggggccguguucaccgaggagaaccagugggacagcgcccgggccgcggucgaggacgaggaguucuggaagcugguggaccgcgagcgggagcuccacaagcugggcaagugcggguccugcguguacaacaugaugggcaagcgcgagaagaagcugggggaguucggcaaggccaagggcagccgggccaucugguacauguggcucggggcccgcuaccuggaguucgaggcccugggcuuccucaacgaggaccacugguucucccgggagaacagcuacuccggggucgagggcgaggggcugcacaagcugggcuacauccuccgcgacaucagcaagauccccggcggggcgauguacgccgacgacaccgccggcugggacacgcggaucaccgaggacgaccugcacaacgaggagaagaucacccagcagauggaccccgagcaccgccagcuggccaacgccaucuucaagcucaccuaccagaacaagguggugaagguccagcggcccacgccgaaggggaccgugauggacaucaucucccgcaaggaccagcggggcagcggccagguggggaccuacggccugaacaccuucaccaacauggaggcgcagcugguccgccagauggagggggagggcgugcucuccaaggccgaccuggagaacccccaccuccucgagaagaagaucacgcaguggcuggagaccaaggggguggagcggcugaagcgcauggccaucagcggcgacgacugcgucgugaagcccaucgacgaccgguucgccaacgcccuccuggcgcugaacgacaugggcaaggugcgcaaggacaucccccaguggcagccguccaagggguggcacgacuggcagcagguccccuucugcagccaccacuuccacgagcucaucaugaaggacggccggaagcugguggugcccugccgcccccaggacgagcugaucgggcgcgcccggaucucccagggcgccggguggagccucaaggagaccgccugccugggcaaggccuacgcgcagauguggucccugauguacuuccaccgccgggaccuccgccuggccagcaacgccaucugcuccgccgucccggugcacuggauccccaccagccggacgaccuggagcauccacgcgcaccaccaguggaugaccaccgaggacaugcugacgguguggaaccgcgucuggaucgaggacaaccccuggauggaggacaagacccccgugaccaccugggaggacgugccguaccucggcaagcgggaggaccaguggugcgggucccugaucggccugacgagccgcgccaccugggcccagaacauccucaccgccauccagcagguccggucccugaucggggacgaggaguuccuggacuacaugcccagcaugaagcgcuuccggaaggaggaggaguccgagggcgccaucugguga

SEQ ID NO: 10324 - RNA, 9873 nt, Artificial Sequence
  derived and/or modified CDS sequence (opt1) from DENV-3__FJ547066__SS-prME
accagccugugccucaugaugaugcugcccgcgacccuggccuuccaccucaccagccgcgacggcgagccgcggaugaucguggggaagaacgagcgcggcaagagccugcuguucaagaccgcguccgggaucaacaugugcacccucaucgccauggaccugggcgagaugugcgacgacaccgugacguacaagugcccccugaucgccgagauggagcccgaggacaucgacugcuggugcaaccucaccagcaccugggugaccuacgggacgugcaaccaggccggcgagcaccggcgcgacaagcgguccguggcccuggcgccccacgugggcauggggcuggacacccgcacccagaccuggaugagcgccgagggcgccuggcggcaggucgagaagguggagacgugggcccuccgccacccgggguucaccauccuggcgcuguuccucgcccacuacaucggcaccucccugacccagaaggucgugaucuucauccugcucaugcuggugacgcccagcaugaccaugcggugcgucggggugggcaaccgcgacuucguggagggccuguccggggccaccugggucgacguggugcucgagcacggcgggugcgucaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgugugcaagcacaccuacguggaccggggguggggcaacgggugcggccuguucgggaagggcucccuggugaccugcgccaaguuccagugccucgagcccaucgagggcaagguggugcaguacgagaaccugaaguacaccgucaucaucacggugcacaccggggaccagcaccaggugggcaacgacacccagggggucaccguggagaucacgccccaggccagcaccgucgaggccgugcugcccgaguacggcacccucgggcuggagugcuccccgcgcaccggccuggacuucaacgagaugauccuccugaccaugaagaacaaggcguggauggugcaccggcagugguucuucgaccugccccuccccuggacgagcggcgccaccaccgagacccccacguggaaccgcaaggagcugcuggucaccuucaagaacgcccacgccaagaagcaggagguggugguccucgggucccaggagggcgccaugcacaccgcgcugaccggggccacggagauccagaacagcggcgggaccuccaucuucgccggccaccugaagugccggcucaagauggacaagcuggagcugaagggcaugagcuacgccaugugccucaacaccuucgugcugaagaaggagguguccgagacccagcacgggacgauccugaucaaggucgaguacaagggcgaggacgccccgugcaagauccccuucagcaccgaggacgggcagggcaaggcgcacaacggccgccugaucaccgccaaccccguggugaccaagaaggaggagcccgucaacaucgaggccgagccgcccuucggggagagcaacaucgugaucggcaucggggacaaggcccucaagaucaacugguacaagaagggcuccagcaucgggaagauguucgaggcgacggcccggggcgcccgccggauggccauccugggcgacaccgccugggacuucggguccgugggcgggguccugaacagccucggcaagauggugcaccagaucuucggguccgcguacaccgcccuguucagcggcguguccuggaucaugaagaucggcaucgggguccugcucaccuggaucggccugaacagcaagaacacguccaugagcuucuccugcaucgugaucgggaucaucacccuguaccucggcgccgugguccaggccgacauggggugcgccaucaacuggaagggcaaggagcugaagugcggcagcgggaucuucgugaccaacgaggugcacaccuggacggagcaguacaaguuccaggcggacucccccaagcgccuggccaccgccaucgccggcgccugggagaacggggucugcggcauccgcagcaccacccggauggagaaccuccuguggaagcagaucgcgaacgagcugaacuacauccucugggagaacaacaucaagcugacggugguggucggggacaucaucggcgugcuggagcagggcaagcgcacccucacgccccagccgauggagcugaaguacuccuggaagaccugggggaaggccaagaucgugacggccgagacccagaacagcuccuucaucaucgacggccccaacacccccgagugccccagcgccucccgggcguggaacgucugggagguggaggacuacggguucggcguguucaccacgaacaucuggcugaagcuccgcgaggucuacacccagagcugcgaccaccggcugaugagcgccgccaucaaggacgagcgcgccgugcacgccgacaugggcuacuggaucgagucccagaagaacgggagcuggaagcuggagaaggcguccuucaucgaggugaagaccugcaccuggcccaagagccacacccucugguccaacggcguccuggagagcgacaugaucauccccaagucccuggccgggcccaucagccagcacaaccaccggccgggcuaccacacgcagaccgccgggcccuggcaccucggcaagcuggagcuggacuucaacuacugcgagggcaccaccguggugaucacggagaacugcgggacccgcggccccucccuccggaccaccacggucagcgggaagcugauccacgaguggugcugccgcuccugcacccugcccccgcuccgguacaugggcgaggacgggugcugguacggcauggagauccgccccaucaacgagaaggaggagaacauggucaagagccugguguccgccggcagcgggaaggucgacaacuucaccaugggcgugcugugccucgccauccuguucgaggaggugaugcgggggaaguucggcaagaagcacaugaucgcggggguccuguucaccuucgugcuccugcuguccggccagaucacguggcgcgacauggcccacacccucaucaugaucggcagcaacgccuccgaccggauggggaugggcgugaccuaccuggcccugaucgccaccuucaagauccagcccuuccucgcgcugggguucuuccugcgcaagcucacgagccgggagaaccugcugcucggcgucggccuggccauggccaccacccugcagcuccccgaggacaucgagcagauggccaacgggaucgcgcugggccugaugacccucaagcugaucacgcaguucgagaccuaccagcuguggaccgcccucgugagccugaccugcuccaacacgaucuucacccugaccguggccuggcgcaccgccacgcucauccuggccggggucagccugcucccgcugugccaguccagcuccaugcggaagaccgacuggcugcccaugaccguggcggccaugggcgugccgccccugccgcuguucaucuucagccugaaggacacccccaagcgccgcuccuggccccucaacgagggggugauggccgugggccuggucagcauccuggccuccagccuccugcggaacgacgugcccauggccggcccgcugguggccggcgggcuccugaucgccugcuacgucaucacggggaccuccgccgaccugaccguggagaaggccgccgacgugaccugggaggaggaggcggagcagacgggggucagccacaaccucaugaucaccguggacgacgacgggaccaugcgcaucaaggacgacgagaccgagaacauccugaccgugcugcucaagacggcccugcugaucgucuccggcaucuuccccuacagcauccccgccacccuccugguguggcacaccuggcagaagcagacccagcgguccggcgugcugugggacguccccagcccgcccgagacgcagaaggccgagcucgaggaggggguguaccgcaucaagcagcagggcaucuucgggaagacccaggugggcgucggggugcagaaggagggcguguuccacaccauguggcacgucacccggggcgccgugcugacgcacaacgggaagcgccuggagcccaacugggcguccgugaagaaggaccucaucagcuacggcgggggcuggcggcuguccgcccaguggcagaagggggaggagguccaggugaucgccguggagcccggcaagaacccgaagaacuuccagaccaugcccggcaucuuccagaccaccacgggggagaucggcgccaucgcgcuggacuucaagcccgggaccagcggcagcccgaucaucaaccgcgagggcaaggucguggggcuguacggcaacgggguggucaccaagaacggcggguacguguccggcaucgcccagaccaacgccgagcccgacggccccacgcccgagcucgaggaggagauguucaagaagcggaaccugaccaucauggaccugcacccggggagcggcaagacccgcaaguaccuccccgccaucgugcgggaggccaucaagcgccggcugcgcacccugauccucgcgcccacgcgggucguggccgccgagauggaggaggcccugaaggggcugcccauccgcuaccagaccaccgccaccaaguccgagcacacgggccgggagaucguggaccucaugugccacgcgaccuucaccaugcgccugcugagcccgguccgggugcccaacuacaaccucaucaucauggacgaggcccacuucaccgaccccgccuccaucgccgcccgcggguacaucagcacgcgggugggcaugggcgaggcggccgccaucuucaugaccgccacgccgcccgggaccgcggaggccuucccccaguccaacgcccccauccaggacgaggagcgcgacauccccgagcgcagcuggaacuccggcaacgaguggaucacggacuucgucgggaagaccgugugguucgugcccagcaucaaggccggcaacgacaucgccaacugccugcggaagaacgggaagaaggucauccagcugucccgcaagaccuucgacaccgaguaccagaagacgcggcucaacgacugggacuucguggugaccaccgacaucagcgagaugggcgcgaacuucaaggccgaccgcgucaucgacccccggcgcugccugaagcccgugauccugaccgacggccccgagcgggugauccucgccgggccgaugcccgucacggccgccuccgcggcccagcgccggggccgcguggggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgcggccaucgacggcgaguaccggcugaagggcgagucccgcaagaccuucguggagcucaugcggcgcggggaccugcccgucuggcuggcccacaagguggccagcgagggcaucaaguacacggaccggaaguggugcuucgacggggagcgcaacaaccagauccucgaggagaacauggacgucgagaucuggaccaaggagggcgagcggaagaagcugcgcccgcgcuggcuggacgcgcggaccuacuccgacccccucgcccugaaggaguucaaggacuucgccgccggccgcaagagcaucgcccuggaccucgugaccgagaucgggcgggugcccucccaccuggcguaccgcacgcggaacgcccuggacaaccucgucaugcugcacaccagcgagcacggcgggcgcgccuaccggcacgccguggaggagcugccggagaccauggagacccuccugcugcucggccugaugauccugcucaccggcggggccaugcuguuccugaucagcgggaaggggaucggcaagaccuccaucgggcucaucugcgugaucgucagcuccggcaugcuguggauggcggacgugccccugcaguggaucgccagcgccaucauccucgaguucuucaugauggugcugcugauccccgagcccgagaagcagcgcaccccgcaggacaaccagcucgccuacgucgugaucgggauccugacccuggccgcgaucguggccgccaacgagaugggccuccuggagacgaccaagcgggaccugggcauguccaaggagcccggggucgugagccccaccuccuaccucgacguggaccugcaccccgccagcgccuggacccuguacgcggucgccacgaccgugaucaccccgaugcuccgccacaccaucgagaacuccacggccaacgugagccuggccgcgaucgccaaccaggccgucgugcugaugggccucgacaagggguggcccaucuccaagauggaccugggcgugccccugcucgcccuggggugcuacagccaggucaacccccugacccucaccgccgcggugcugcugcucgugacccacuacgccaucaucggcccgggccugcaggccaaggccacgcgggaggcccagaagcgcaccgcggccgggaucaugaagaaccccaccgucgacggcaucaugaccaucgaccuggaccccgugaucuacgacuccaaguucgagaagcagcucggccaggugaugcugcugguccucugcgccgugcagcugcugcucaugcggacgagcugggcccugugcgaggcccugacccucgcgaccggccccaucaccacgcugugggagggcuccccggggaaguucuggaacaccaccaucgccgugagcauggccaacaucuuccgcggcuccuaccuggccggggcgggccucgccuucagcaucaugaaguccgucgggaccggccggcgcggcacggggagccagggcgagacccugggggagaaguggaagaagaagcugaaccagcucagccggaaggaguucgaccuguacaagaaguccggcaucaccgagguggaccgcaccgaggccaaggaggggcugaagcggggcgagaccacgcaccacgccgugagccgcggcuccgccaagcuccagugguucgucgagcggaacauggugauccccgaggggcgcgugaucgaccugggcugcgggcgcggcggguggagcuacuacugcgcgggccugaagaaggucaccgaggugcggggcuacaccaagggcgggcccgggcacgaggagcccgugccgauguccaccuacggcuggaaccucgucaagcugaugagcgggaaggacguguucuaccugccgcccgagaagugcgacacgcugcucugcgacaucggcgaguccagccccuccccgaccguggaggagagccgcaccauccggguccugaagaugguggagcccuggcugaagaacaaccaguucugcaucaaggugcucaaccccuacaugcccaccgucaucgagcaccuggagcgccugcagcggaaguacggcgggaugcucgugcgcaacccgcugucccggaacagcacgcacgagauguacuggaucuccaacggcaccgggaacaucgugagcuccgucaacauggugagccgccugcuccugaaccgguucaccaugacccaccgccggcccacgaucgagaaggacguggaccugggcgccggcacccgccacgucaacgccgagcccgagaccccgaacauggacgugaucggggagcggaucaagcgcaucaaggaggagcacuccagcaccuggcacuacgacgacgagaaccccuacaagacgugggccuaccacggcuccuacgaggucaaggccaccgggagcgcgagcuccaugaucaacggcguggugaagcuccugaccaagcccugggacgucgugcccauggugacccagauggccaugacggacaccaccccguucgggcagcagcgggucuucaaggagaagguggacacccgcacgccccggcccaugcccggcacccgcaaggugauggagaucaccgccgaguggcuguggcggacccucggccgcaacaagaagccgcgccugugcacgcgggaggaguucaccaagaagguccgcaccaacgccgccaugggggcgguguucaccgaggagaaccagugggacagcgcccgggccgccguggaggacgagggcuucuggaagcuggucgaccgcgagcgggagcuccacaagcuggggaagugcggcuccugcguguacaacaugauggggaagcgcgagaagaagcugggcgaguucggcaaggcgaaggggagccgggccaucugguacauguggcucggcgcccgcuaccuggaguucgaggcccugggguuccucaacgaggaccacugguucucccgggagaacagcuacuccggcguggagggggagggccugcacaagcugggcuacauccuccgcgacaucagcaagauccccgggggcgccauguacgcggacgacacggccgggugggacacccggaucaccgaggacgaccugcacaacgaggagaagaucacccagcagauggaccccgagcaccgccagcuggccaacgccaucuucaagcucacguaccagaacaaggucgugaaggugcagcggcccaccccgaagggcaccgucauggacaucaucucccgcaaggaccagcggggcagcggccaggugggcaccuacgggcugaacaccuucacgaacauggaggcccagcuggugcgccagauggagggcgaggggguccucuccaaggcggaccuggagaacccccaccuccucgagaagaagaucacccaguggcuggagaccaagggcguggagcggcugaagcgcauggccaucagcggcgacgacugcguggucaagcccaucgacgaccgguucgccaacgcccuccuggcccugaacgacauggggaaggugcgcaaggacaucccccaguggcagccguccaagggcuggcacgacuggcagcagguccccuucugcagccaccacuuccacgagcucaucaugaaggacgggcggaagcuggucgugcccugccgcccccaggacgagcugaucggccgcgcgcggaucucccagggggccggcuggagccucaaggagaccgccugccugggcaaggccuacgcccagauguggucccugauguacuuccaccgccgggaccuccgccuggcgagcaacgccaucugcuccgccgugccgguccacuggauccccacgagccggaccaccuggagcauccacgcccaccaccaguggaugaccacggaggacaugcugaccguguggaaccgcguguggaucgaggacaaccccuggauggaggacaagacccccgucaccacgugggaggacgugccguaccucgggaagcgggaggaccaguggugcggcucccugaucgggcugaccagccgcgcgaccugggcccagaacauccucaccgccauccagcagguccggucccugaucggcgacgaggaguuccuggacuacaugcccagcaugaagcgcuuccggaaggaggaggaguccgagggggccaucugguga

SEQ ID NO: 10325 - RNA, 9873 nt, Artificial Sequence
  derived and/or modified CDS sequence (opt1) from DENV-3__KF955460__SS-prME
accagccugugccucaugaugaugcugcccgcgacccuggccuuccaccucaccagccgggacggcgagccgcggaugaucguggggaagaacgagcggggcaagagccugcuguucaagaccgcguccgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgccgagggcgccuggcgccagguggagaagguggagaccugggcccuccgccacccgggguucaccauccuggcgcuguuccucgcccacuacaucggcaccucccugacccagaagguggugaucuucacgcugcucaugcuggucacccccagcaugaccaugcggugcgugggggugggcaaccgcgacuucgucgagggccuguccggggccaccuggguggacgugguccucgagcacggcgggugcgugacgaccauggccaagaacaagcccacccuggacaucgagcugcagaagaccgaggccacgcagcucgcgacccugcggaagcugugcaucgagggcaagaucaccaacaucaccacggacagccgcugccccacccagggcgaggccauccucccggaggagcaggaccagaacuacgugugcaagcacaccuacgucgaccggggguggggcaacgggugcggccuguucgggaagggcucccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccagcaccguggaggccgugcugcccgaguacggcacccucgggcuggagugcuccccgcgcaccggccuggacuucaacgagaugauccuccugacgaugaagaacaaggcguggaugguccaccggcagugguucuucgaccugccccuccccuggaccagcggcgccaccaccgagacgcccaccuggaaccgcaaggagcugcuggugaccuucaagaacgcccacgccaagaagcaggagguggucgugcucgggucccaggagggcgccaugcacaccgcgcugacgggggccaccgagauccagaacagcggcgggaccuccaucuucgccggccaccugaagugccggcucaagauggacaagcuggagcugaagggcaugagcuacgccaugugccucaacaccuucgugcugaagaaggaggucuccgagacgcagcacgggaccauccugaucaagguggaguacaagggcgaggacgccccgugcaagauccccuucagcaccgaggacgggcagggcaaggcgcacaacggccgccugaucaccgccaaccccguggucacgaagaaggaggagcccgugaacaucgaggccgagccgcccuucggggagagcaacaucgugaucggcaucgggaacaaggcccucaagaucaacugguacaagaagggcuccagcaucgggaagauguucgaggcgaccgcccggggcgcccgccggauggccauccugggcgacaccgccugggacuucggguccgucggcggggugcugaacagccucggcaagauggugcaccagaucuucggguccgcguacaccgcccuguucagcggcgucuccuggaucaugaagaucggcaucggggugcugcucacguggaucggccugaacagcaagaacaccuccaugagcuucuccugcaucgugaucgggaucaucacccuguaccucggcgccgucgugcaggccgacauggggugcgccaucaacuggaagggcaaggagcugaagugcggcagcgggaucuucgugaccaacgagguccacacguggaccgagcaguacaaguuccaggcggacucccccaagcgccuggccaccgccaucgccggcgccugggagaacggggugugcggcauccgcagcaccacgcggauggagaaccuccuguggaagcagaucgcgaacgagcugaacuacauccucugggagaacaacaucaagcugaccguggucgugggggacaucaucggcgugcuggagcagggcaagcgcacccucacgccccagccgauggagcugaaguacuccuggaagacgugggggaaggccaagaucgucaccgccgagacccagaacagcuccuucaucaucgacggccccaacacccccgagugccccagcgccucccgggcguggaacgugugggagguggaggacuacggguucggcgucuucacgaccaacaucuggcugaagcuccgcgagguguacacccagagcugcgaccaccggcugaugagcgccgccaucaaggacgagcgcgccgugcacgccgacaugggcuacuggaucgagucccagaagaacgggagcuggaagcuggagaaggcguccuucaucgaggucaagaccugcaccuggcccaagagccacacgcucugguccaacggcgugcuggagagcgacaugaucauccccaagucccuggccgggcccaucagccagcacaaccaccggccgggcuaccacacccagaccgccgggcccuggcaccucggcaagcuggagcuggacuucaacuacugcgagggcaccacgguggucaucaccgagaacugcgggacccgcggccccucccuccggaccacgaccgugagcgggaagcugauccacgaguggugcugccgcuccugcacccugcccccgcuccgguacaugggcgaggacgggugcugguacggcauggagauccgccccaucaacgagaaggaggagaacauggucaagagccuggucuccgccggcagcgggaagguggacaacuucaccaugggcgugcugugccucgccauccuguucgaggaggucaugcgggggaaguucggcaagaagcacaugaucgcgggggugcuguucacguucgugcuccugcuguccggccagaucaccuggcgcgacauggcccacacccucaucaugaucggcagcaacgccuccgaccggauggggaugggcgucaccuaccuggcccugaucgccacguucaagauccagcccuuccucgcgcugggguucuuccugcgcaagcucaccagccgggagaaccugcugcucggcgugggccuggccauggccaccacccugcagcuccccgaggacaucgagcagauggccaacgggaucgcgcugggccugaugacgcucaagcugaucacccaguucgagaccuaccagcuguggaccgcccucgugagccugacgugcuccaacaccaucuucacccugaccgucgccuggcgcacggccacccucauccuggccggggugagccugcucccgcugugccaguccagcuccaugcggaagaccgacuggcugcccaugaccgucgcggccaugggcgugccgccccugccgcuguucaucuucagccugaaggacacgcccaagcgccgcuccuggccccucaacgagggggugauggccgucggccuggugagcauccuggccuccagccuccugcggaacgacgugcccauggccggcccgcuggucgccggcgggcuccugaucgccugcuacgugaucaccgggaccuccgccgaccugaccguggagaaggccgccgacgucacgugggaggaggaggcggagcagaccggggugagccacaaccucaugaucaccguggacgacgacgggaccaugcgcaucaaggacgacgagaccgagaacauccugacgguccugcucaagaccgcccugcugaucguguccggcaucuuccccuacagcauccccgccacccuccugguguggcacaccuggcagaagcagacgcagcgguccggcguccugugggacgugcccagcccgcccgagacccagaaggccgagcucgaggaggggguguaccgcaucaagcagcagggcaucuucgggaagacccaggucggcgugggggugcagaaggagggcgucuuccacaccauguggcacgugacgcggggcgccgugcugacccacaacgggaagcgccuggagcccaacugggcguccgucaagaaggaccucaucagcuacggcgggggcuggcggcuguccgcccaguggcagaagggggaggagguccaggugaucgccgucgagcccggcaagaacccgaagaacuuccagaccaugcccggcaucuuccagaccacgaccggggagaucggcgccaucgcgcuggacuucaagcccgggaccagcggcagcccgaucaucaaccgcgagggcaaggugguggggcuguacggcaacggggucgugaccaagaacggcggguacguguccggcaucgcccagacgaacgccgagcccgacggccccacccccgagcucgaggaggagauguucaagaagcggaaccugaccaucauggaccugcacccggggagcggcaagacccgcaaguaccuccccgccaucguccgggaggccaucaagcgccggcugcgcacgcugauccucgcgcccacccgggugguggccgccgagauggaggaggcccugaaggggcugcccauccgcuaccagaccaccgccacgaaguccgagcacaccggccgggagaucgucgaccucaugugccacgcgaccuucaccaugcgccugcugagcccggugcgggugcccaacuacaaccucaucaucauggacgaggcccacuucacggaccccgccuccaucgccgcccgcggguacaucagcacccgggucggcaugggcgaggcggccgccaucuucaugaccgccacgccgcccgggacggcggaggccuucccccaguccaacgcccccauccaggacgaggagaaggacauccccgagcgcagcuggaacuccggcaacgaguggaucaccgacuucguggggaagaccgugugguucguccccagcaucaaggccggcaacgacaucgccaacugccugcgcaagaacgggaagaaggugauccagcugucccggaagaccuucgacacggaguaccagaagacccgccucaacgacugggacuucguggucaccaccgacaucagcgagaugggcgcgaacuucaaggccgaccgggugaucgacccccgccggugccugaagcccgugauccugacggacggccccgagcgcgucauccucgccgggccgaugcccgugaccgccgccuccgcggcccagcggcgcggccggguggggcgcaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgggagaaguccgcggccaucgacggcgaguaccgccugaagggcgagucccggaagacguucgucgagcucaugcgccgcggggaccugcccguguggcuggcccacaaggucgccagcgagggcaucaaguacaccgaccgcaaguggugcuucgacggggagcggaacaaccagauccucgaggagaacauggacguggagaucuggaccaaggagggcgagcgcaagaagcugcggccgcgcuggcuggacgcgcgcaccuacuccgacccccucgcccugaaggaguucaaggacuucgccgccggccgcaagagcaucgcccuggaccucgugacggagaucgggcgcguccccucccaccuggcguaccggacccgcaacgcccuggacaaccucgugaugcugcacaccagcgagcacggcgggcgggccuaccgccacgccguggaggagcugccggagaccauggagacgcuccugcugcucggccugaugauccugcucaccgggggcgccaugcuguuccugaucagcggcaaggggaucggcaagaccuccaucgggcucaucugcgucaucgugagcuccggcaugcuguggauggcggacgugccccugcaguggaucgccagcgccaucguccucgaguucuucaugauggugcugcugauccccgagcccgagaagcagcggaccccgcaggacaaccagcucgccuacguggucaucgggauccugacgcuggccgcgaucguggccgccaacgagaugggccuccuggagaccaccaagcgcgaccugggcauguccaaggagcccgggguggucagccccaccuccuaccucgacguggaccugcaccccgccagcgccuggacgcuguacgcgguggccaccaccgucaucaccccgaugcuccggcacacgaucgagaacuccaccgccaacgugagccuggccgcgaucgccaaccaggccgugguccugaugggccucgacaagggguggcccaucuccaagauggaccugggcgugccccugcucgcccuggggugcuacagccaggugaacccccugacccucaccgccgcgguccugcugcucgugacgcacuacgccaucaucggcccgggccugcaggccaaggccacccgcgaggcccagaagcggaccgcggccgggaucaugaagaaccccaccguggacggcaucaugacgaucgaccuggaccccgucaucuacgacuccaaguucgagaagcagcucggccaggugaugcugcuggugcucugcgccguccagcugcugcucaugcgcaccagcugggcccugugcgaggcccugacccucgcgaccggccccaucacgacccugugggagggcuccccggggaaguucuggaacaccaccaucgccgugagcauggccaacaucuuccggggcuccuaccuggccggggcgggccucgccuucagcaucaugaaguccguggggacgggccgccggggcaccgggagccagggcgagacccugggggagaaguggaagaagaagcugaaccagcucagccgcaaggaguucgaccuguacaagaaguccggcaucaccgaggucgaccggaccgaggccaaggaggggcugaagcgcggcgagacgacccaccacgccgugagccggggcuccgccaagcuccagugguucguggagcgcaacauggucauccccgaggggcgggugaucgaccugggcugcgggcgcggcggguggagcuacuacugcgcgggccugaagaaggugaccgagguccgcggcuacaccaagggcgggcccgggcacgaggagcccgugccgauguccacguacggcuggaacaucgugaagcucaugagcgggaaggacgucuucuaccugccgcccgagaagugcgacacccugcugugcgacaucggcgaguccagccccuccccgaccguggaggagagccggaccauccgcgugcucaagauggucgagcccuggcugaagaacaaccaguucugcaucaaggugcugaaccccuacaugcccacggugaucgagcaccucgagcggcugcagcgcaaguacggcgggaugcugguccggaacccgcucucccgcaacagcacccacgagauguacuggaucuccaacggcaccgggaacaucgugagcuccgugaacauggucagccggcugcugcucaaccgcuucaccaugacgcaccggcgccccaccaucgagaaggacguggaccugggcgccggcacccggcacgucaacgccgagcccgagaccccgaacauggacgugaucggggagcgcaucaagcggaucaaggaggagcacuccagcacguggcacuacgacgacgagaaccccuacaagaccugggccuaccacggcuccuacgaggugaaggccaccgggagcgcgagcuccaugaucaacggcgucgugaagcugcucaccaagcccugggacgugguccccauggugacgcagauggccaugaccgacaccaccccguucgggcagcagcgcguguucaaggagaaggucgacacgcggacgccccggcccaugcccggcacccggaaggugauggagaucaccgccgaguggcuguggcgcacgcugggccggaacaagaagccgcgccucugcacccgcgaggaguucaccaagaaggugcggaccaacgccgccaugggggcggucuucacggaggagaaccagugggacagcgcccgcgccgccguggaggacgaggaguucuggaagcugguggaccgggagcgcgagcugcacaagcucggcaagugcggguccugcgucuacaacaugaugggcaagcgggagaagaagcugggggaguucggcaaggcgaagggcagccgcgccaucugguacauguggcugggggcccgguaccucgaguucgaggcccugggcuuccugaacgaggaccacugguucucccgcgagaacagcuacuccgggguggagggcgaggggcuccacaagcugggcuacauccugcgggacaucagcaagauccccggcggggccauguacgcggacgacaccgccggcugggacacccgcaucaccgaggacgaccuccacaacgaggagaagaucacgcagcagauggaccccgagcaccggcagcuggccaacgccaucuucaagcugaccuaccagaacaagguggucaaggugcagcgccccaccccgaaggggaccgugauggacaucaucucccggaaggaccagcgcggcagcggccaggucgggaccuacggccucaacacguucaccaacauggaggcccagcuggugcggcagauggagggggagggcgugcuguccaaggcggaccucgagaacccccaccuccuggagaagaagaucacccaguggcucgagaccaagggggucgagcgccugaagcggauggccaucagcggcgacgacugcguggugaagcccaucgacgaccgcuucgccaacgcccugcucgcccugaacgacaugggcaagguccggaaggacaucccccaguggcagccguccaagggguggcacgacuggcagcagguccccuucugcagccaccacuuccacgagcugaucaugaaggacggccgcaagcucgugguccccugccggccccaggacgagcugaucgggcgcgcgcgcaucucccagggcgccggguggagccugaaggagacggccugccucggcaaggccuacgcccagauguggucccugauguacuuccaccggcgcgaccugcggcucgcgagcaacgccaucugcuccgccgugccggugcacuggauccccaccagccgcaccaccuggagcauccacgcccaccaccaguggaugacgaccgaggacaugcugaccgucuggaaccggguguggaucgaggacaaccccuggauggaggacaagacccccgugacgaccugggaggacaucccguaccugggcaagcgcgaggaccaguggugcgggucccucaucggccugaccagccgggcgaccugggcccagaacauccugacggccauccagcagguccgcucccucaucggggacgaggaguuccuggacuacaugcccagcaugaagcgguuccgcaaggaggaggaguccgagggcgccaucugguga

SEQ ID NO: 10326 - RNA, 9873 nt, Artificial Sequence
  derived and/or modified CDS sequence (opt1) from DENV-3__FJ461334__SS-prME
accagccugugccucaugaugaugcugcccgcgacccuggccuuccaccucaccagccgggacggcgagccgcggaugaucguggggaagaacgagcgcggcaagagccugcuguucaagaccgcguccgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgugugcaagcacaccuacgucgaccggggguggggcaacgggugcggccuguucgggaagggcucccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccagcaccguggaggccgugcugcccgaguacggcacccucgggcuggagugcuccccgcgcaccggccuggacuucaacgagaugauccuccugaccaugaagaacaaggcguggaugguccaccggcagugguucuucgaccugccccuccccuggacgagcggcgccaccaccgagacccccacguggaaccgcaaggagcugcuggugaccuucaagaacgcccacgccaagaagcaggagguggucgugcucgggucccaggagggcgccaugcacaccgcgcugaccggggccacggagauccagaacagcggcgggaccuccaucuucgccggccaccugaagugccggcucaagauggacaagcuggagcugaagggcaugagcuacgccaugugccucaacaccuucgugcugaagaaggaggucuccgagacccagcacgggacgauccugaucaagguggaguacaagggcgaggacgccccgugcaagauccccuucagcaccgaggacgggcagggcaaggcgcacaacggccgccugaucaccgccaaccccguggucaccaagaaggaggagcccgugaacaucgaggccgagccgcccuucggggagagcaacaucgugaucggcaucggggacaaggcccucaagaucaacugguacaagaagggcuccagcaucgggaagauguucgaggcgacggcccggggcgcccgccggauggccauccugggcgacaccgccugggacuucggguccgucggcggggugcugaacagccucggcaagauggugcaccagaucuucggguccgcguacaccgcccuguucagcggcgucuccuggaucaugaagaucggcaucggggugcugcucaccuggaucggccugaacagcaagaacacguccaugagcuucuccugcaucgugaucgggaucaucacccuguaccucggcgccgucgugcaggccgacauggggugcgccaucaacuggaagggcaaggagcugaagugcggcagcgggaucuucgugaccaacgagguccacaccuggacggagcaguacaaguuccaggcggacucccccaagcgccuggccaccgccaucgccggcgccugggagaacggggugugcggcauccgcagcaccacccggauggagaaccuccuguggaagcagaucgcgaacgagcugaacuacauccucugggagaacaacaucaagcugacgguggucgugggggacaucaucggcgugcuggagcagggcaagcgcacccucacgccccagccgauggagcugaaguacuccuggaagaccugggggaaggccaagaucgucacggccgagacccagaacagcuccuucaucaucgacggccccaacacccccgagugccccagcgccucccgggcguggaacgugugggagguggaggacuacggguucggcgucuucaccacgaacaucuggcugaagcuccgcgagguguacacccagagcugcgaccaccggcugaugagcgccgccaucaaggacgagcgcgccgugcacgccgacaugggcuacuggaucgagucccagaagaacgggagcuggaagcuggagaaggcguccuucaucgaggucaagaccugcaccuggcccaagagccacacccucugguccaacggcgugcuggagagcgacaugaucauccccaagucccuggccgggcccaucagccagcacaaccaccggccgggcuaccacacgcagaccgccgggcccuggcaccucggcaagcuggagcuggacuucaacuacugcgagggcaccaccguggucaucacggagaacugcgggacccgcggccccucccuccggaccaccacggugagcgggaagcugauccacgaguggugcugccgcuccugcacccugcccccgcuccgguacaugggcgaggacgggugcugguacggcauggagauccgccccaucaacgagaaggaggagaacauggucaagagccuggucuccgccggcagcgggaagguggacaacuucaccaugggcgugcugugccucgccauccuguucgaggaggucaugcgggggaaguucggcaagaagcacaugaucgcgggggugcuguucaccuucgugcuccugcuguccggccagaucacguggcgcgacauggcccacacccucaucaugaucggcagcaacgccuccgaccggauggggaugggcgucaccuaccuggcccugaucgccaccuucaagauccagcccuuccucgcgcugggguucuuccugcgcaagcucacgagccgggagaaccugcugcucggcgugggccuggccauggccaccacccugcagcuccccgaggacaucgagcagauggccaacgggaucgcgcugggccugaugacccucaagcugaucacgcaguucgagaccuaccagcuguggaccgcccucgugagccugaccugcuccaacacgaucuucacccugaccgucgccuggcgcaccgccacgcucauccuggccggggugagccugcucccgcugugccaguccagcuccaugcggaagaccgacuggcugcccaugaccgucgcggccaugggcgugccgccccugccgcuguucaucuucagccugaaggacacccccaagcgccgcuccuggccccucaacgagggggugauggccgucggccuggugagcauccuggccuccagccuccugcggaacgacgugcccauggccggcccgcuggucgccggcgggcuccugaucgccugcuacgugaucacggggaccuccgccgaccugaccguggagaaggccgccgacgucaccugggaggaggaggcggagcagacgggggugagccacaaccucaugaucaccguggacgacgacgggaccaugcgcaucaaggacgacgagaccgagaacauccugaccguccugcucaagacggcccugcugaucguguccggcaucuuccccuacagcauccccgccacccuccugguguggcacaccuggcagaagcagacccagcgguccggcguccugugggacgugcccagcccgcccgagacgcagaaggccgagcucgaggaggggguguaccgcaucaagcagcagggcaucuucgggaagacccaggucggcgugggggugcagaaggagggcgucuuccacaccauguggcacgugacccggggcgccgugcugacgcacaacgggaagcgccuggagcccaacugggcguccgucaagaaggaccucaucagcuacggcgggggcuggcggcuguccacccaguggcagaagggggaggagguccaggugaucgccgucgagcccggcaagaacccgaagaacuuccagaccaugcccggcaucuuccagaccacgaccggggagaucggcgccaucgcccuggacuucaagcccgggaccagcggcagcccgaucaucaaccgcgagggcaaggugguggggcuguacggcaacggggucgugaccaagaacggcggguacguguccggcaucgcgcagacgaacgccgagcccgacggccccacccccgagcucgaggaggagauguucaagaagcggaaccugaccaucauggaccugcacccggggagcggcaagacccgcaaguaccuccccgccaucguccgggaggccaucaagcgccggcugcgcacgcugauccucgcccccacccgggugguggcggccgagauggaggaggcccugaaggggcugcccauccgcuaccagaccaccgccacgaaguccgagcacaccggccgggagaucgucgaccucaugugccacgccaccuucaccaugcgccugcugagcccggugcgggugcccaacuacaaccucaucaucauggacgaggcgcacuucacggaccccgccuccaucgccgcccgcggguacaucagcacccgggucggcaugggcgaggccgcggccaucuucaugaccgccacgccgcccgggacggccgaggcguucccccaguccaacgcccccauccaggacgaggagcgcgacauccccgagcgcagcuggaacuccggcaacgaguggaucaccgacuucguggggaagaccgugugguucguccccagcaucaaggccggcaacgacaucgccaacugccugcggaagaacgggaagaaggugauccagcugucccgcaagaccuucgacacggaguaccagaagacccggcucaacgacugggacuucguggucaccaccgacaucagcgagaugggcgccaacuucaaggcggaccgcgugaucgacccccggcgcugccugaagcccgugauccugacggacggccccgagcgggucauccucgccgggccgaugcccgugaccgccgccuccgccgcgcagcgccggggccgcguggggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgccgcgaucgacggcgaguaccggcugaagggcgagucccgcaagacguucgucgagcucaugcggcgcggggaccugcccguguggcuggcccacaaggucgccagcgagggcaucaaguacaccgaccggaaguggugcuucgacggggagcgcaacaaccagauccucgaggagaacauggacguggagaucuggaccaaggagggcgagcggaagaagcugcgcccgcgcuggcuggacgcccggaccuacuccgacccccucgcgcugaaggaguucaaggacuucgccgccggccgcaagagcaucgcccuggaccucgugacggagaucgggcggguccccucccaccuggccuaccgcacccggaacgcgcuggacaaccucgugaugcugcacaccagcgagcacggcgggcgcgccuaccggcacgccguggaggagcugccggagaccauggagacgcuccugcugcucggccugaugauccugcucaccgggggcgccaugcuguuccugaucagcggcaaggggaucggcaagaccuccaucgggcucaucugcgucaucgugagcuccggcaugcuguggauggccgacgugccccugcaguggaucgcgagcgccaucauccucgaguucuucaugaugguccugcugauccccgagcccgagaagcagcgcaccccgcaggacaaccagcucgccuacguggugaucgggauccugacgcuggccgccaucgucgcggccaacgagaugggccuccuggagaccaccaagcgggaccugggcauguccaaggagcccgggguggugagccccaccuccuaccucgacgucgaccugcaccccgccagcgccuggacgcuguacgccguggcgaccaccgugaucaccccgaugcuccgccacacgaucgagaacuccaccgccaacgucagccuggccgccaucgcgaaccaggccguggugcugaugggccucgacaagggguggcccaucuccaagauggaccugggcgucccccugcucgcccuggggugcuacagccaggugaacccccugacccucaccgccgccgugcugcugcucgucacgcacuacgcgaucaucggcccgggccugcaggccaaggccacccgggaggcccagaagcgcaccgccgcggggaucaugaagaaccccaccguggacggcaucaugacgaucgaccuggaccccgugaucuacgacuccaaguucgagaagcagcucgggcaggucaugcugcuggugcucugcgccgugcagcugcugcucaugcggaccagcugggcccugugcgaggcccugacccucgccaccggccccaucacgacccugugggagggcuccccggggaaguucuggaacaccaccaucgcggucagcauggccaacaucuuccgcggcuccuaccuggccggggccggccucgcguucagcaucaugaaguccguggggacgggccggcgcggcaccgggagccagggcgagacccugggggagaaguggaagaagaagcugaaccagcucagccggaaggaguucgaccuguacaagaaguccggcaucaccgagguggaccgcaccgaggccaaggaggggcugaagcggggcgagacgacccaccacgccgucagccgcggcuccgccaagcuccagugguucguggagcggaacauggugauccccgaggggcgcgucaucgaccugggcugcgggcgcggcggguggagcuacuacugcgccggccugaagaaggugaccgaggugcggggcuacaccaagggcggccccgggcacgaggagcccgucccgauguccacguacggcuggaaccucgugaagcugaugagcgggaaggacguguucuaccugccgcccgagaagugcgacacccugcucugcgacaucggcgaguccagccccuccccgaccgucgaggagagccgcaccauccgggugcugaagaugguggagcccuggcugaagaacaaccaguucugcaucaagguccucaaccccuacaugcccacggugaucgagcaccuggagcgccugcagcggaaguacggcgggaugcucgugcgcaacccgcugucccggaacagcacccacgagauguacuggaucuccaacggcaccgggaacaucgucagcuccgugaacauggugagccgccugcuccugaaccgguucaccaugacgcaccgccggcccaccaucgagaaggacgucgaccugggcgcgggcacccgccacgugaacgccgagcccgagaccccgaacauggacgucaucggggagcggaucaagcgcaucaaggaggagcacuccagcacguggcacuacgacgacgagaaccccuacaagaccugggccuaccacggcuccuacgaggugaaggccaccgggagcgccagcuccaugaucaacggcguggucaagcuccugaccaagcccugggacguggugcccauggucacgcagauggcgaugaccgacaccaccccguucgggcagcagcggguguucaaggagaagguggacacgcgcacgccccggcccaugcccggcacccgcaaggucauggagaucaccgccgaguggcuguggcggacgcucggccgcaacaagaagccgcgccugugcacccgggaggaguucaccaagaaggugcgcaccaacgccgccaugggggccguguucacggaggagaaccagugggacagcgcgcgggccgccgucgaggacgaggaguucuggaagcugguggaccgcgagcgggagcuccacaagcugggcaagugcggguccugcguguacaacaugaugggcaagcgcgagaagaagcugggggaguucggcaaggccaagggcagccgggcgaucugguacauguggcucggggcccgcuaccuggaguucgaggcccugggcuuccucaacgaggaccacugguucucccgggagaacagcuacuccggggucgagggcgaggggcugcacaagcugggcuacauccuccgcgacaucagcaagauccccggcggggccauguacgccgacgacaccgcgggcugggacacccggaucaccgaggacgaccugcacaacgaggagaagaucacgcagcagauggaccccgagcaccgccagcuggccaacgccaucuucaagcucaccuaccagaacaagguggugaagguccagcggcccaccccgaaggggaccgugauggacaucaucucccgcaaggaccagcggggcagcggccagguggggaccuacggccugaacacguucaccaacauggaggcccagcugguccgccagauggagggggagggcgugcucuccaaggccgaccuggagaacccccaccuccucgagaagaagaucacccaguggcuggagaccaaggggguggagcggcugaagcgcauggcgaucagcggcgacgacugcgucgugaagcccaucgacgaccgguucgccaacgcccuccuggcccugaacgacaugggcaaggugcgcaaggacaucccccaguggcagccguccaagggguggcacgacuggcagcagguccccuucugcagccaccacuuccacgagcucaucaugaaggacggccggaagcugguggugcccugccgcccccaggacgagcugaucgggcgcgcccggaucucccagggcgcgggguggagccucaaggagacggccugccugggcaaggccuacgcccagauguggucccugauguacuuccaccgccgggaccuccgccuggccagcaacgcgaucugcuccgccgucccggugcacuggauccccaccagccggaccaccuggagcauccacgcccaccaccaguggaugacgaccgaggacaugcugaccguguggaaccgcgucuggaucgaggacaaccccuggauggaggacaagacccccgugacgaccugggaggacgugccguaccucggcaagcgggaggaccaguggugcgggucccugaucggccugaccagccgcgccaccugggcgcagaacauccucacggccauccagcagguccggucccugaucggggacgaggaguuccuggacuacaugcccagcaugaagcgcuuccggaaggaggaggaguccgagggcgccaucugguga

SEQ ID NO: 10327 - RNA, 9873 nt, Artificial Sequence
  derived and/or modified CDS sequence (opt1) from DENV-3__FJ461337__SS-prME
accagccugugccucaugaugaugcugcccgcgacccuggccuuccaccucaccagccgcgacggcgagccgcggaugaucguggggaagaacgagcgcggcaagagccugcuguucaagaccgcguccgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgcgacaagcgguccgucgcccuggcgccccacgugggcauggggcuggacacccgcacccagaccuggaugagcgccgagggcgccuggcggcaggucgagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgugugcaagcacaccuacgucgaccggggguggggcaacgggugcggccuguucgggaagggcucccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccagcaccguggaggccgugcugcccgaguacggcacccucgggcuggagugcuccccgcgcaccggccuggacuucaacgagaugauccuccugaccaugaagaacaaggcguggaugguccaccggcagugguucuucgaccugccccuccccuggacgagcggcgccaccaccgagacccccacguggaaccgcaaggagcugcuggugaccuucaagaacgcccacgccaagaagcaggagguggucgugcucgggucccaggagggcgccaugcacaccgcgcugaccggggccacggagauccagaacagcggcgggaccuccaucuucgccggccaccugaagugccggcucaagauggacaagcuggagcugaagggcaugagcuacgccaugugccucaacaccuucgugcugaagaaggaggucuccgagacccagcacgggacgauccugaucaagguggaguacaagggcgaggacgccccgugcaagauccccuucagcaccgaggacgggcagggcaaggcgcacaacggccgccugaucaccgccaaccccguggucaccaagaaggaggagcccgugaacaucgaggccgagccgcccuucggggagagcaacaucgugaucggcaucggggacaaggcccucaagaucaacugguacaagaagggcuccagcaucgggaagauguucgaggcgacggcccggggcgcccgccggauggccauccugggcgacaccgccugggacuucggguccaugggcgggguccugaacagccucggcaagauggugcaccagaucuucggguccgcguacaccgcccuguucagcggcguguccuggaucaugaagaucggcaucgggguccugcucaccuggaucggccugaacagcaagaacacguccaugagcuucuccugcaucgugaucgggaucaucacccuguaccucggcgccgugguccaggccgacauggggugcgccaucaacuggaagggcaaggagcugaagugcggcagcgggaucuucgugaccaacgaggugcacaccuggacggagcaguacaaguuccaggcggacucccccaagcgccuggccaccgccaucgccggcgccugggagaacggggucugcggcauccgcagcaccacccggauggagaaccuccuguggaagcagaucgcgaacgagcugaacuacauccucugggagaacaacaucaagcugacggugguggucggggacaucaucggcgugcuggagcagggcaagcgcacccucacgccccagccgauggagcugaaguacuccuggaagaccugggggaaggccaagaucgugacggccgagacccagaacagcuccuucaucaucgacggccccaacacccccgagugccccagcgccucccgggcguggaacgucugggagguggaggacuacggguucggcguguucaccacgaacaucuggcugaagcuccgcgaggucuacacccagagcugcgaccaccggcugaugagcgccgccaucaaggacgagcgcgccgugcacgccgacaugggcuacuggaucgagucccagaagaacgggagcuggaagcuggagaaggcguccuucaucgaggugaagaccugcaccuggcccaagagccacacccucugguccaacggcguccuggagagcgacaugaucauccccaagucccuggccgggcccaucagccagcacaaccaccggccgggcuaccacacgcagaccgccgggcccuggcaccucggcaagcuggagcuggacuucaacuacugcgagggcaccaccguggugaucacggaggacugcgggacccgcggccccucccuccggaccaccacggucagcgggaagcugauccacgaguggugcugccgcuccugcacccugcccccgcuccgguacaugggcgaggacgggugcugguacggcauggagauccgccccaucaacgagaaggaggagaacauggucaagagccugguguccgccggcagcgggaaggucgacaacuucaccaugggcgugcugugccucgccauccuguucgaggaggugaugcgggggaaguucggcaagaagcacaugaucgcggggguccuguucaccuucgugcuccugcuguccggccagaucacguggcgcgacauggcccacacccucaucaugaucggcagcaacgccuccgaccggauggggaugggcgugaccuaccuggcccugaucgccaccuucaagauccagcccuuccucgcgcugggguucuuccugcgcaagcucacgagccgggagaaccugcugcucggcgucggccuggccauggccaccacccugcagcuccccgaggacaucgagcagauggccaacgggaucgcgcugggccugaugacccucaagcugaucacgcaguucgagaccuaccagcuguggaccgcccucgugagccugaccugcuccaacacgaucuucacccugaccguggccuggcgcaccgccacgcucauccuggccggggucagccugcucccgcugugccaguccagcuccaugcggaagaccgacuggcugcccaugaccguggcggccaugggcgugccgccccugccgcuguucaucuucagccugaaggacacccccaagcgccgcuccuggccccucaacgagggggugauggccgugggccuggucagcauccuggccuccagccuccugcggaacgacgugcccauggccggcccgcugguggccggcgggcuccugaucgccugcuacgucaucacggggaccuccgccgaccugaccguggagaaggccgccgacgugaccugggaggaggaggcggagcagacgggggucagccacaaccucaugaucaccguggacgacgacgggaccaugcgcaucaaggacgacgagaccgagaacauccugaccgugcugcucaagacggcccugcugaucgucuccggcaucuuccccuacagcauccccgccacccuccugguguggcacaccuggcagaagcagacccagcgguccggcgugcugugggacguccccagcccgcccgagacgcagaaggccgagcucgaggaggggguguaccgcaucaagcagcagggcaucuucgggaagacccaggugggcgucggggugcagaaggagggcguguuccacaccauguggcacgucacccggggcgccgugcugacgcacaacgggaagcgccuggagcccaacugggcguccgugaagaaggaccucaucagcuacggcgggggcuggcggcuguccgcccaguggcagaagggggaggagguccaggugaucgccguggagcccggcaagaacccgaagaacuuccagaccaugcccggcaucuuccagaccaccgccggggagaucggcgcgaucgcccuggacuucaagcccgggacgagcggcagcccgaucaucaaccgcgagggcaaggucguggggcuguacggcaacgggguggucaccaagaacggcggguacguguccggcaucgcccagaccaacgccgagcccgacggccccacccccgagcucgaggaggagauguucaagaagcggaaccugacgaucauggaccugcacccggggagcggcaagacccgcaaguaccuccccgccaucgugcgggaggcgaucaagcgccggcugcgcacccugauccucgcccccacccgggucguggccgccgagauggaggaggcccugaaggggcugcccauccgcuaccagacgaccgcgaccaaguccgagcacaccggccgggagaucguggaccucaugugccacgccacguucaccaugcgccugcugagcccgguccgggugcccaacuacaaccucaucaucauggacgaggcccacuucaccgaccccgccuccaucgccgcgcgcggguacaucagcacccgggugggcaugggcgaggccgccgccaucuucaugacggcgacgccgcccgggaccgccgaggccuucccccaguccaacgcccccauccaggacgaggagcgcgacauccccgagcgcagcuggaacuccggcaacgaguggaucaccgacuucgucgggaagacggugugguucgugcccagcaucaaggccggcaacgacaucgcgaacugccugcggaagaacgggaagaaggucauccagcugucccgcaagaccuucgacaccgaguaccagaagacccggcucaacgacugggacuucguggugacgaccgacaucagcgagaugggcgccaacuucaaggccgaccgcgucaucgacccccggcgcugccugaagcccgugauccugaccgacggccccgagcgggugauccucgccgggccgaugcccgucaccgccgcguccgccgcccagcgccggggccgcguggggcggaacccccagaaggagaacgaccaguacaucuucacgggccagccccugaacaacgacgaggaccacgcccacuggaccgaggccaagaugcugcucgacaacaucaacaccccggaggggaucauccccgcgcuguucgagcccgagcgcgagaaguccgccgccaucgacggcgaguaccggcugaagggcgagucccgcaagaccuucguggagcucaugcggcgcggggaccugcccgucuggcuggcccacaagguggcgagcgagggcaucaaguacaccgaccggaaguggugcuucgacggggagcgcaacaaccagauccucgaggagaacauggacgucgagaucuggacgaaggagggcgagcggaagaagcugcgcccgcgcuggcuggacgcccggaccuacuccgacccccucgcccugaaggaguucaaggacuucgccgccggccgcaagagcaucgcgcuggaccucgugaccgagaucgggcgggugcccucccaccuggccuaccgcacccggaacgcccuggacaaccucgucaugcugcacacgagcgagcacggcgggcgcgccuaccggcacgccguggaggagcugccggagaccauggagacccuccugcugcucggccugaugauccugcucaccgggggcgcgaugcuguuccugaucagcggcaaggggaucggcaagacguccaucgggcucaucugcgugaucgucagcuccggcaugcuguggauggccgacgugccccugcaguggaucgccagcgccaucgugcucgaguucuucaugaugguccugcugauccccgagcccgagaagcagcgcaccccgcaggacaaccagcucgccuacguggugaucgggauccugacccuggcggccaucgucgccgccaacgagaugggccuccuggagaccacgaagcgggaccugggcauguccaaggagcccgggguggugagccccaccuccuaccucgacgucgaccugcaccccgccagcgcguggacccuguacgccguggccaccacggugaucaccccgaugcuccgccacaccaucgagaacuccaccgccaacgucagccuggcggccaucgccaaccaggccguggugcugaugggccucgacaagggguggcccaucuccaagauggaccugggcgucccccugcucgcccuggggugcuacagccaggugaacccccugacgcucaccgcggccgugcugcugcucgucacccacuacgccaucaucggcccgggccugcaggccaaggccacccgggaggcgcagaagcgcacggccgccgggaucaugaagaaccccaccguggacggcaucaugaccaucgaccuggaccccgugaucuacgacuccaaguucgagaagcagcucgggcaggucaugcugcuggugcucugcgccgugcagcugcugcucaugcggaccagcugggcccugugcgaggcgcugacgcucgccaccggccccaucaccacccugugggagggcuccccggggaaguucuggaacacgaccaucgccgucagcauggccaacaucuuccgcggcuccuaccuggcgggggccggccucgccuucagcaucaugaaguccguggggaccggccggcgcggcaccgggagccagggcgagacgcugggggagaaguggaagaagaagcugaaccagcucagccggaaggaguucgaccuguacaagaaguccggcaucaccgagguggaccgcaccgaggccaaggaggggcugaagcggggcgagaccacccaccacgccgucagccgcggcuccgcgaagcuccagugguucguggagcggaacauggugauccccgaggggcgcgucaucgaccugggcugcgggcgcggcggguggagcuacuacugcgccggccugaagaaggugacggaggugcggggcuacaccaagggcggccccgggcacgaggagcccgucccgauguccaccuacggcuggaaccucgugaagcugaugagcgggaaggacguguucuaccugccgcccgagaagugcgacacccugcucugcgacaucggcgaguccagccccuccccgacggucgaggagagccgcaccauccgggugcugaagaugguggagcccuggcugaagaacaaccaguucugcaucaagguccucaaccccuacaugcccaccgugaucgagcaccuggagcgccugcagcggaaguacggcgggaugcucgugcgcaacccgcugucccggaacagcacccacgagauguacuggaucuccaacggcacggggaacaucgucagcuccgugaacauggugagccgccugcuccugaaccgguucaccaugacccaccgccggcccaccaucgagaaggacgucgaccugggcgccggcacgcgccacgugaacgccgagcccgagaccccgaacauggacgucaucggggagcggaucaagcgcaucaaggaggagcacuccagcaccuggcacuacgacgacgagaaccccuacaagaccugggccuaccacggcuccuacgaggugaaggcgacggggagcgccagcuccaugaucaacggcguggucaagcuccugaccaagcccugggacguggugcccauggucacccagauggccaugaccgacacgaccccguucgggcagcagcggguguucaaggagaagguggacacccgcacgccccggcccaugcccggcacgcgcaaggucauggagaucaccgccgaguggcuguggcggacccucggccgcaacaagaagccgcgccugugcacccgggaggaguucacgaagaaggugcgcaccaacgccgcgaugggggccguguucaccgaggagaaccagugggacagcgcccgggccgcggucgaggacgaggaguucuggaagcugguggaccgcgagcgggagcuccacaagcugggcaagugcggguccugcguguacaacaugaugggcaagcgcgagaagaagcugggggaguucggcaaggccaagggcagccgggccaucugguacauguggcucggggcccgcuaccuggaguucgaggcccugggcuuccucaacgaggaccacugguucucccgggagaacagcuacuccggggucgagggcgaggggcugcacaagcugggcuacauccuccgcgacaucagcaagauccccggcggggcgauguacgccgacgacaccgccggcugggacacgcggaucaccgaggacgaccugcacaacgaggagaagaucacccagcagauggaccccgagcaccgccagcuggccaacgccaucuucaagcucaccuaccagaacaagguggugaagguccagcggcccacgccgaaggggaccgugauggacaucaucucccgcaaggaccagcggggcagcggccagguggggaccuacggccugaacaccuucaccaacauggaggcgcagcugguccgccagauggagggggagggcgugcucuccaaggccgaccuggagaacccccaccuccucgagaagaagaucacgcaguggcuggagaccaaggggguggagcggcugaagcgcauggccaucagcggcgacgacugcgucgugaagcccaucgacgaccgguucgccaacgcccuccuggcgcugaacgacaugggcaaggugcgcaaggacaucccccaguggcagccguccaagggguggcacgacuggcagcagguccccuucugcagccaccacuuccacgagcucaucaugaaggacggccggaagcugguggugcccugccgcccccaggacgagcugaucgggcgcgcccggaucucccagggcgccggguggagccucaaggagaccgccugccugggcaaggccuacgcgcagauguggucccugauguacuuccaccgccgggaccuccgccuggccagcaacgccaucugcuccgccgucccggugcacuggauccccaccagccggacgaccuggagcauccacgcgcaccaccaguggaugaccaccgaggacaugcugacgguguggaaccgcgucuggaucgaggacaaccccuggauggaggacaagacccccgugaccaccugggaggacgugccguaccucggcaagcgggaggaccaguggugcgggucccugaucggccugacgagccgcgccaccugggcccagaacauccucaccgccauccagcagguccggucccugaucggggacgaggaguuccuggacuacaugcccagcaugaagcgcuuccggaaggaggaggaguccgagggcgccaucugguga

SEQ ID NO: 10328 - RNA, 9873 nt, Artificial Sequence
  derived and/or modified CDS sequence (opt1) from DENV-3__FJ461338__SS-prME
accagccugugccucaugaugaugcugcccgcgacccuggccuuccaccucaccagccgggacggcgagccgcggaugaucguggggaagaacgagcggggcaagagccugcuguucaagaccgcguccgggaucaacaugugcacccucaucgccauggaccugggcgagaugugcgacgacaccgugacguacaagugcccccugguggccgagguggagcccgaggacaucgacugcuggugcaaccucaccagcaccugggugaccuacgggacgugcaaccaggccggcgagcaccggcgcgacaagcgguccguggcccuggcgccccacgugggcauggggcuggacacccgcacccagaccuggaugagcgccgagggcgccuggcggcaggucgagaagguggagacgugggcccuccgccacccgggguucaccauccuggcgcuguuccucgcccacuacaucggcaccucccugacccagaagguggucaucuucauccugcucaugcuggugacgcccagcaugaccaugcggugcgugggggucggcaaccgcgacuucguggagggccuguccggggccaccuggguggacgucgugcucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgucugcaagcacaccuacguggaccggggguggggcaacgggugcggccuguucgggaagggcucccuggugaccugcgccaaguuccagugccucgagcccaucgagggcaaggucgugcaguacgagaaccugaaguacaccgugaucaucacgguccacaccggggaccagcaccaggugggcaacgacacccagggggucaccguggagaucacgccccaggccagcaccguggaggccguccugcccgaguacggcacccucgggcuggagugcuccccgcgcaccggccuggacuucaacgagaugauccuccugaccaugaagaacaaggcguggauggugcaccggcagugguucuucgaccugccccuccccuggacgagcggcgccaccaccgagacccccacguggaacaagaaggagcugcuggugaccuucaagaacgcccacgccaagaagcaggaggucguggugcucgggucccaggagggcgccaugcacaccgcgcugaccggggccacggagauccagaacagcggcgggaccuccaucuucgccggccaccugaagugccgccucaagauggacaagcuggagcugaagggcaugagcuacgccaugugccucaacaccuucguccugaagaaggagguguccgagacccagcacgggacgauccugaucaagguggaguacaagggcgaggacgccccgugcaagauccccuucagcaccgaggacgggcagggcaaggcgcacaacggccggcugaucaccgccaaccccgucgugaccaagaaggaggagcccgugaacaucgaggccgagccgcccuucggggagagcaacaucgucaucggcaucggggacaaggcccucaagaucaacugguacaagaagggcuccagcaucgggaagauguucgaggcgacggcccgcggcgcccggcgcauggccauccugggcgacaccgccugggacuucggguccgugggcggggugcugaacagccucggcaagaugguccaccagaucuucggguccgcguacaccgcccuguucagcggcguguccuggaucaugaagaucggcaucggggugcugcucaccuggaucggccugaacagcaagaacacguccaugagcuucuccugcaucgucaucgggaucaucacccuguaccucggcgccguggugcaggccgacauggggugcgccaucaacuggaagggcaaggagcugaagugcggcagcgggaucuucgucaccaacgaggugcacaccuggacggagcaguacaaguuccaggcggacucccccaagcggcuggccaccgccaucgccggcgccugggagaacggggugugcggcauccgcagcaccacccgcauggagaaccuccuguggaagcagaucgcgaacgagcugaacuacauccucugggagaacaacaucaagcugacggucguggugggggacaucaucggcguccuggagcagggcaagcggacccucacgccccagccgauggagcugaaguacuccuggaagaccugggggaaggccaagaucgugacggccgagacccagaacagcuccuucaucaucgacggccccaacacccccgagugccccagcgccucccgcgcguggaacgugugggaggucgaggacuacggguucggcguguucaccacgaacaucuggcugaagcuccgggagguguacacccagagcugcgaccaccgccugaugagcgccgccaucaaggacgagcgggccguccacgccgacaugggcuacuggaucgagucccagaagaacgggagcuggaagcuggagaaggcguccuucaucgaggugaagaccugcaccuggcccaagagccacacccucugguccaacggcgugcuggagagcgacaugaucauccccaagucccuggccgggcccaucagccagcacaaccaccgcccgggcuaccacacgcagaccgccgggcccuggcaccucggcaagcuggagcuggacuucaacuacugcgagggcaccaccgucgugaucacggagaacugcgggacccggggccccucccuccgcaccaccacggugagcgggaagcugauccacgaguggugcugccgguccugcacccugcccccgcuccgcuacaugggcgaggacgggugcugguacggcauggagauccggcccaucaacgagaaggaggagaacauggucaagagccugguguccgccggcagcgggaagguggacaacuucaccaugggcguccugugccucgccauccuguucgaggaggugaugcgcgggaaguucggcaagaagcacaugaucgcgggggugcuguucaccuucguccuccugcuguccggccagaucacguggcgggacauggcccacacccucaucaugaucggcagcaacgccuccgaccgcauggggaugggcgugaccuaccuggcccugaucgccaccuucaagauccagcccuuccucgcgcugggguucuuccugcggaagcucacgagccgcgagaaccugcugcucggcgugggccuggccauggccaccacccugcagcuccccgaggacaucgagcagauggccaacgggaucgcgcugggccugaugacccucaagcugaucacgcaguucgagaccuaccagcuguggaccgcccucgucagccugaccugcuccaacacgaucuucacccugaccguggccuggcggaccgccacgcucauccuggccggggucagccugcucccgcugugccaguccagcuccaugcgcaagaccgacuggcugcccaugaccguggcggccaugggcgugccgccccugccgcuguucaucuucagccugaaggacacccccaagcggcgcuccuggccccucaacgagggggucauggccgugggccuggugagcauccuggccuccagccuccugcgcaacgacguccccauggccggcccgcugguggccggcgggcuccugaucgccugcuacgugaucacggggaccuccgccgaccugaccgucgagaaggccgccgacgugaccugggaggaggaggcggagcagacgggggugagccacaaccucaugaucaccgucgacgacgacgggaccaugcggaucaaggacgacgagaccgagaacauccugaccgugcugcucaagacggcccugcugaucguguccggcaucuuccccuacagcauccccgccacccuccuggucuggcacaccuggcagaagcagacccagcgcuccggcgugcugugggacgugcccagcccgcccgagacgcagaaggccgagcucgaggagggggucuaccggaucaagcagcagggcaucuucgggaagacccaggugggcguggggguccagaaggagggcguguuccacaccauguggcacgugacccgcggcgccguccugacgcacaacgggaagcggcuggagcccaacugggcguccgugaagaaggaccucaucagcuacggcgggggcuggcgccuguccgcccaguggcagaagggggaggaggugcaggucaucgccguggagcccggcaagaacccgaagaacuuccagaccaugcccggcaucuuccagaccaccacgggggagaucggcgccaucgcgcuggacuucaagcccgggaccagcggcagcccgaucaucaaccgggagggcaagguggucgggcuguacggcaacgggguggugaccaagaacggcggguacgucuccggcaucgcccagaccaacgccgagcccgacggccccacgcccgagcucgaggaggagauguucaagaagcgcaaccugaccaucauggaccugcacccggggagcggcaagacccggaaguaccuccccgccaucgugcgcgaggccaucaagcggcgccugcggacccugauccucgcgcccacgcgcguggucgccgccgagauggaggaggcccugaaggggcugcccauccgguaccagaccaccgccaccaaguccgagcacacgggccgcgagaucguggaccucaugugccacgcgaccuucaccaugcggcugcugagcccggugcgcguccccaacuacaaccucaucaucauggacgaggcccacuucaccgaccccgccuccaucgccgcccggggguacaucagcacgcgcgugggcaugggcgaggcggccgccaucuucaugaccgccacgccgcccgggaccgcggaggccuucccccaguccaacgcccccauccaggacgaggagcgggacauccccgagcgcagcuggaacuccggcaacgaguggaucacggacuucguggggaagaccgucugguucgugcccagcaucaaggccggcaacgacaucgccaacugccugcgcaagaacgggaagaaggugauccagcugucccggaagaccuucgacaccgaguaccagaagacgcgccucaacgacugggacuucgucgugaccaccgacaucagcgagaugggcgcgaacuucaaggccgaccgggugaucgacccccgccggugccugaagcccgucauccugaccgacggccccgagcgcgugauccucgccgggccgaugcccgugacggccgccuccgcggcccagcggcgcggccgggucgggcgcaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgggagaaguccgcggccaucgacggcgaguaccgccugaagggcgagucccggaagaccuucguggagcucaugcgccgcggggaccugcccgucuggcuggcccacaagguggccagcgagggcaucaaguacacggaccgcaaguggugcuucgacggggagcggaacaaccagauccucgaggagaacauggacguggagaucuggaccaaggagggcgagcgcaagaagcugcggccgcgcuggcuggacgcgcgcaccuacuccgacccccucgcccugaaggaguucaaggacuucgccgccggccgcaagagcaucgcccuggaccucgucaccgagaucgggcgcgugcccucccaccuggcguaccggacgcgcaacgcccuggacaaccucgugaugcugcacaccagcgagcacggcgggcgggccuaccgccacgccgucgaggagcugccggagaccauggagacccuccugcugcucggccugaugauccugcucaccggcggggccaugcuguuccugaucagcgggaaggggaucggcaagaccuccaucgggcucaucugcgugaucgugagcuccggcaugcuguggauggcggacgucccccugcaguggaucgccagcgccaucgugcucgaguucuucaugauggugcugcugauccccgagcccgagaagcagcggaccccgcaggacaaccagcucgccuacgucgugaucgggauccugacccuggccgcgaucguggccgccaacgagaugggccuccuggagacgaccaagcgcgaccugggcauguccaaggagcccggggucgugagccccaccuccuaccucgacguggaccugcaccccgccagcgccuggacccuguacgcggucgccacgaccgugaucaccccgaugcuccggcacaccaucgagaacuccacggccaacgugagccuggccgcgaucgccaaccaggccgucgugcugaugggccucgacaagggguggcccaucuccaagauggaccugggcgugccccugcucgcccuggggugcuacagccaggucaacccccugacccucaccgccgcggugcugcugcucgugacccacuacgccaucaucggcccgggccugcaggccaaggccacgcgcgaggcccagaagcggaccgcggccgggaucaugaagaaccccaccgucgacggcaucaugaccaucgaccuggaccccgugaucuacgacuccaaguucgagaagcagcucggccaggugaugcugcugguccucugcgccgugcagcugcugcucaugcgcacgagcugggcccugugcgaggcccugacccucgcgaccggccccaucaccacgcugugggagggcuccccggggaaguucuggaacaccaccaucgccgugagcauggccaacaucuuccggggcuccuaccuggccggggcgggccucgccuucagcaucaugaaguccgucgggaccggccgccggggcacggggagccagggcgagacccugggggagaaguggaagaagaagcugaaccagcucagccgcaaggaguucgaccuguacaagaaguccggcaucaccgagguggaccggaccgaggccaaggaggggcugaagcgcggcgagaccacgcaccacgccgugagccggggcuccgccaagcuccagugguucgucgagcgcaacauggugauccccgaggggcgggugaucgaccugggcugcgggcgcggcggguggagcuacuacugcgcgggccugaagaaggucaccgaggugcgcggcuacaccaagggcggccccgggcacgaggagcccgugccgauguccaccuacggcuggaacaucgucaagcucaugagcgggaaggacguguucuaccugccgcccgagaagugcgacacgcugcugugcgacaucggcgaguccagccccuccccgaccguggaggagagccggaccauccgcguccucaagaugguggagcccuggcugaagaacaaccaguucugcaucaaggugcugaaccccuacaugcccaccgucaucgagcaccucgagcggcugcagcgcaaguacggcgggaugcuggugcggaacccgcucucccgcaacagcacgcacgagauguacuggaucuccaacggcaccgggaacaucgugagcuccgucaacauggugagccggcugcugcucaaccgcuucaccaugacccaccggcgccccacgaucgagaaggacgucgaccugggcgccggcacccggcacgugaacgccgagcccgagaccccgaacauggacgugaucggggagcgcaucaagcggaucaaggaggagcacuccagcaccuggcacuacgacgacgagaaccccuacaagacgugggccuaccacggcuccuacgaggucaaggccaccgggagcgcgagcuccaugaucaacggcguggugaagcugcucaccaagcccugggacgucgugcccauggugacccagauggccaugacggacaccaccccguucgggcagcagcgcgucuucaaggagaagguggacacccggacgccccgccccaugcccggcacccggaaggugauggagaucaccgccgaguggcuguggcgcacccugggccggaacaagaagccgcgccucugcacgcgcgaggaguucaccaagaagguccggaccaacgccgccaugggggcgguguucaccgaggagaaccagugggacagcgcccgcgccgccguggaggacgaggaguucuggaagcuggucgaccgggagcgcgagcugcacaagcucggcaagugcggguccugcguguacaacaugaugggcaagcgggagaagaagcugggggaguucggcaaggcgaagggcagccgcgccaucugguacauguggcugggggcccgguaccucgaguucgaggcccugggcuuccugaacgaggaccacugguucucccgcgagaacagcuacuccgggguggagggcgaggggcuccacaagcugggcuacauccugcgggacaucagcaagauccccggcggggccauguacgcggacgacacggccggcugggacacccgcaucaccgaggacgaccuccacaacgaggagaagaucacccagcagauggaccccgagcaccggcagcuggccaacgccaucuucaagcugacguaccagaacaaggucgugaaggugcagcgccccaccccgaaggggaccgucauggacaucaucucccggaaggaccagcgcggcagcggccagguggggaccuacggccucaacaccuucacgaacauggaggcccagcuggugcggcagauggagggggagggcguccuguccaaggcggaccucgagaacccccaccuccuggagaagaagaucacccaguggcucgagaccaaggggguggagcgccugaagcggauggccaucagcggcgacgacugcguggucaagcccaucgacgaccgcuucgccaacgcccugcucgcccugaacgacaugggcaaggugcggaaggacaucccccaguggcagccguccaagggguggcacgacuggcagcagguccccuucugcagccaccacuuccacgagcugaucaugaaggacggccgcaagcucgucgugcccugccggccccaggacgagcugaucgggcgcgcgcgcaucucccagggcgccggguggagccugaaggagaccgccugccucggcaaggccuacgcccagauguggucccugauguacuuccaccggcgcgaccugcggcucgcgagcaacgccaucugcuccgccgugccgguccacuggauccccacgagccgcaccaccuggagcauccacgcccaccaccaguggaugaccacggaggacaugcugaccguguggaaccggguguggaucgaggacaaccccuggauggaggacaagacccccgucaccacgugggaggacgugccguaccugggcaagcgcgaggaccaguggugcgggucccucaucggccugaccagccgggcgaccugggcccagaacauccugaccgccauccagcagguccgcucccucaucggggacgaggaguuccuggacuacaugcccagcaugaagcgguuccgcaaggaggaggaguccgagggcgccaucugguga

SEQ ID NO: 10329 - RNA, 9873 nt, Artificial Sequence
  derived and/or modified CDS sequence (opt1) from DENV-3__FJ562103__SS-prME
accagccugugccucaugaugaugcugcccgcgacccuggccuuccaccucaccagccgcgacggcgagccgcggaugaucguggggaagaacgagcgcggcaagagccugcuguucaagaccgcguccgggaucaacaugugcacccucaucgccauggaccugggcgagaugugcgacgacaccgugaccuaccggugcccccugaucgccgagguggagcccgaggacaucgacugcuggugcaaccucaccagcaccugggugaccuacgggaccugcaaccaggccggcgagcaccgccgggacaagcgcuccguggcccuggcgccccacgugggcauggggcuggacacccggacccagaccuggaugagcgccgagggcgccuggcgccagguggagaagguggagaccugggcccuccggcacccgggguucaccauccuggcgcuguuccucgcccacuacaucggcaccucccugacccagaagguggugaucuucacgcugcucaugcuggucacccccagcaugaccaugcgcugcgugggggugggcaaccgggacuucgucgagggccuguccggggccaccuggguggacgugguccucgagcacggcgggugcgugacgaccauggccaagaacaagcccacccuggacaucgagcugcagaagaccgaggccacgcagcucgcgacccugcgcaagcugugcaucgagggcaagaucaccaacaucaccacggacagccggugccccacccagggcgaggccauccucccggaggagcaggaccagaacuacgugugcaagcacaccuacgucgaccgcggguggggcaacgggugcggccuguucgggaagggcucccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccagcaccguggaggccgugcugcccgaguacggcacccucgggcuggagugcuccccgcggaccggccuggacuucaacgagaugauccuccugacgaugaagaacaaggcguggaugguccaccgccagugguucuucgaccugccccuccccuggaccagcggcgccaccaccgagacgcccaccuggaaccggaaggagcugcuggugaccuucaagaacgcccacgccaagaagcaggagguggucgugcucgggucccaggagggcgccaugcacaccgcgcugacgggggccaccgagauccagaacagcggcgggaccuccaucuucgccggccaccugaagugccgccucaagauggacaagcuggagcugaagggcaugagcuacgccaugugccucaacaccuucgugcugaagaaggaggucuccgagacgcagcacgggaccauccugaucaagguggaguacaagggcgaggacgccccgugcaagauccccuucagcaccgaggacgggcagggcaaggcgcacaacggccggcugaucaccgccaaccccguggucacgaagaaggaggagcccgugaacaucgaggccgagccgcccuucggggagagcaacaucgugaucggcaucgggaacaaggcccucaagaucaacugguacaagaagggcuccagcaucgggaagauguucgaggcgaccgcccgcggcgcccggcgcauggccauccugggcgacaccgccugggacuucggguccgucggcggggugcugaacagccucggcaagauggugcaccagaucuucggguccgcguacaccgcccuguucagcggcgucuccuggaucaugaagaucggcaucggggugcugcucacguggaucggccugaacagcaagaacaccuccaugagcuucuccugcaucgugaucgggaucaucacccuguaccucggcgccgucgugcaggccgacauggggugcgccaucaacuggaagggcaaggagcugaagugcggcagcgggaucuucgugaccaacgagguccacacguggaccgagcaguacaaguuccaggcggacucccccaagcgccuggccaccgccaucgccggcgccugggagaacggggugugcggcauccggagcaccacgcgcauggagaaccuccuguggaagcagaucgcgaacgagcugaacuacauccucugggagaacaacaucaagcugaccguggucgugggggacaucaucggcgugcuggagcagggcaagcggacccucacgccccagccgauggagcugaaguacuccuggaagacgugggggaaggccaagaucgucaccgccgagacccagaacagcuccuucaucaucgacggccccaacacccccgagugccccagcgccucccgcgcguggaacgugugggagguggaggacuacggguucggcgucuucacgaccaacaucuggcugaagcuccgggagguguacacccagagcugcgaccaccgccugaugagcgccgccaucaaggacgagcgggccgugcacgccgacaugggcuacuggaucgagucccagaagaacgggagcuggaagcuggagaaggcguccuucaucgaggucaagaccugcaccuggcccaagagccacacgcucugguccaacggcgugcuggagagcgacaugaucauccccaagucccuggccgggcccaucagccagcacaaccaccgcccgggcuaccacacccagaccgccgggcccuggcaccucggcaagcuggagcuggacuucaacuacugcgagggcaccacgguggucaucaccgagaacugcgggacccggggccccucccuccgcaccacgaccgugagcgggaagcugauccacgaguggugcugccgguccugcacccugcccccgcuccgcuacaugggcgaggacgggugcugguacggcauggagauccggcccaucaacgagaaggaggagaacauggucaagagccuggucuccgccggcagcgggaagguggacaacuucaccaugggcgugcugugccucgccauccuguucgaggaggucaugcgcgggaaguucggcaagaagcacaugaucgcgggggugcuguucacguucgugcuccugcuguccggccagaucaccuggcgggacauggcccacacccucaucaugaucggcagcaacgccuccgaccgcauggggaugggcgucaccuaccuggcccugaucgccacguucaagauccagcccuuccucgcgcugggguucuuccugcggaagcucaccagccgcgagaaccugcugcucggcgugggccuggccauggccaccacccugcagcuccccgaggacaucgagcagauggccaacgggaucgcgcugggccugaugacgcucaagcugaucacccaguucgagaccuaccagcuguggaccgcccucgugagccugacgugcuccaacaccaucuucacccugaccgucgccuggcggacggccacccucauccuggccggggugagccugcucccgcugugccaguccagcuccaugcgcaagaccgacuggcugcccaugaccgucgcggccaugggcgugccgccccugccgcuguucaucuucagccugaaggacacgcccaagcgccgguccuggccccucaacgagggggugauggccgucggccuggugagcauccuggccuccagccuccugcgcaacgacgugcccauggccggcccgcuggucgccggcgggcuccugaucgccugcuacgugaucaccgggaccuccgccgaccugaccguggagaaggccgccgacgucacgugggaggaggaggcggagcagaccggggugagccacaaccucaugaucaccguggacgacgacgggaccaugcggaucaaggacgacgagaccgagaacauccugacgguccugcucaagaccgcccugcugaucguguccggcaucuuccccuacagcauccccgccacccuccugguguggcacaccuggcagaagcagacgcagcgcuccggcguccugugggacgugcccagcccgcccgagacccagaaggccgagcucgaggaggggguguaccggaucaagcagcagggcaucuucgggaagacccaggucggcgugggggugcagaaggagggcgucuuccacaccauguggcacgugacgcgcggcgccgugcugacccacaacgggaagcggcuggagcccaacugggcguccgucaagaaggaccucaucagcuacggcgggggcuggcgccuguccgcccaguggcagaagggggaggagguccaggugaucgccgucgagcccggcaagaacccgaagaacuuccagaccaugcccggcaucuuccagaccacgaccggggagaucggcgccaucgcgcuggacuucaagcccgggaccagcggcagcccgaucaucaaccgggagggcaaggugguggggcuguacggcaacggggucgugaccaagaacggcggguacguguccggcaucgcccagacgaacgccgagcccgacggccccacccccgagcucgaggaggagauguucaagaagcgcaaccugaccaucauggaccugcacccggggagcggcaagacccggaaguaccuccccgccaucguccgcgaggccaucaagcggcgccugcggacgcugauccucgcgcccacccgcgugguggccgccgagauggaggaggcccugaaggggcugcccauccgguaccagaccaccgccacgaaguccgagcacaccggccgcgagaucgucgaccucaugugccacgcgaccuucaccaugcggcugcugagcccggugcgcgugcccaacuacaaccucaucaucauggacgaggcccacuucacggaccccgccuccaucgccgcccggggguacaucagcacccgcgucggcaugggcgaggcggccgccaucuucaugaccgccacgccgcccgggacggcggaggccuucccccaguccaacgcccccauccaggacgaggagaaggacauccccgagcgcagcuggaacuccggcaacgaguggaucaccgacuucguggggaagaccgugugguucguccccagcaucaaggccggcaacgacaucgccaacugccugcggaagaacgggaagaaggugauccagcugucccgcaagaccuucgacacggaguaccagaagacccggcucaacgacugggacuucguggucaccaccgacaucagcgagaugggcgcgaacuucaaggccgaccgcgugaucgacccccggcgcugccugaagcccgugauccugacggacggccccgagcgggucauccucgccgggccgaugcccgugaccgccgccuccgcggcccagcgccggggccgcguggggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgcggccaucgacggcgaguaccggcugaagggcgagucccgcaagacguucgucgagcucaugcggcgcggggaccugcccguguggcuggcccacaaggucgccagcgagggcaucaaguacaccgaccggaaguggugcuucgacggggagcgcaacaaccagauccucgaggagaacauggacguggagaucuggaccaaggagggcgagcggaagaagcugcgcccgcgcuggcuggacgcgcggaccuacuccgacccccucgcccugaaggaguucaaggacuucgccgccggccgcaagagcaucgcccuggaccucgugacggagaucgggcggguccccucccaccuggcguaccgcacccggaacgcccuggacaaccucgugaugcugcacaccagcgagcacggcgggcgcgccuaccggcacgccguggaggagcugccggagaccauggagacgcuccugcugcucggccugaugauccugcucaccgggggcgccaugcuguuccugaucagcggcaaggggaucggcaagaccuccaucgggcucaucugcgucaucgugagcuccggcaugcuguggauggcggacgugccccugcaguggaucgccagcgccaucguccucgaguucuucaugauggugcugcugauccccgagcccgagaagcagcgcaccccgcaggacaaccagcucgccuacguggucaucgggauccugacgcuggccgcgaucguggccgccaacgagaugggccuccuggagaccaccaagcgggaccugggcauguccaaggagcccgggguggucagccccaccuccuaccucgacguggaccugcaccccgccagcgccuggacgcuguacgcgguggccaccaccgucaucaccccgaugcuccgccacacgaucgagaacuccaccgccaacgugagccuggccgcgaucgccaaccaggccgugguccugaugggccucgacaagggguggcccaucuccaagauggaccugggcgugccccugcucgcccuggggugcuacagccaggugaacccccugacccucaccgccgcgguccugcugcucgugacgcacuacgccaucaucggcccgggccugcaggccaaggccacccgggaggcccagaagcgcaccgcggccgggaucaugaagaaccccaccguggacggcaucaugacgaucgaccuggaccccgucaucuacgacuccaaguucgagaagcagcucggccaggugaugcugcuggugcucugcgccguccagcugcugcucaugcggaccagcugggcccugugcgaggcccugacccucgcgaccggccccaucacgacccugugggagggcuccccggggaaguucuggaacaccaccaucgccgugagcauggccaacaucuuccgcggcuccuaccuggccggggcgggccucgccuucagcaucaugaaguccguggggacgggccggcgcggcaccgggagccagggcgagacccugggggagaaguggaagaagaagcugaaccagcucagccggaaggaguucgaccuguacaagaaguccggcaucaccgaggucgaccgcaccgaggccaaggaggggcugaagcggggcgagacgacccaccacgccgugagccgcggcuccgccaagcuccagugguucguggagcggaacauggucauccccgaggggcgcgugaucgaccugggcugcgggcgcggcggguggagcuacuacugcgcgggccugaagaaggugaccgagguccggggcuacaccaagggcgggcccgggcacgaggagcccgugccgauguccacguacggcuggaacaucgugaagcucaugagcgggaaggacgucuucuaccugccgcccgagaagugcgacacccugcugugcgacaucggcgaguccagccccuccccgaccguggaggagagccgcaccauccgggugcucaagauggucgagcccuggcugaagaacaaccaguucugcaucaaggugcugaaccccuacaugcccacggugaucgagcaccucgagcgccugcagcggaaguacggcgggaugcugguccgcaacccgcucucccggaacagcacccacgagauguacuggaucuccaacggcaccgggaacaucgugagcuccgugaacauggucagccgccugcugcucaaccgguucaccaugacgcaccgccggcccaccaucgagaaggacguggaccugggcgccggcacccgccacgucaacgccgagcccgagaccccgaacauggacgugaucggggagcggaucaagcgcaucaaggaggagcacuccagcacguggcacuacgacgacgagaaccccuacaagaccugggccuaccacggcuccuacgaggugaaggccaccgggagcgcgagcuccaugaucaacggcgucgugaagcugcucaccaagcccugggacgugguccccauggugacgcagauggccaugaccgacaccaccccguucgggcagcagcggguguucaaggagaaggucgacacgcgcacgccccggcccaugcccggcacccgcaaggugauggagaucaccgccgaguggcuguggcggacgcugggccgcaacaagaagccgcgccucugcacccgggaggaguucaccaagaaggugcgcaccaacgccgccaugggggcggucuucacggaggagaaccagugggacagcgcccgggccgccguggaggacgaggaguucuggaagcugguggaccgcgagcgggagcugcacaagcucggcaagugcggguccugcgucuacaacaugaugggcaagcgcgagaagaagcugggggaguucggcaaggcgaagggcagccgggccaucugguacauguggcugggggcccgcuaccucgaguucgaggcccugggcuuccugaacgaggaccacugguucucccgggagaacagcuacuccgggguggagggcgaggggcuccacaagcugggcuacauccugcgcgacaucagcaagauccccggcggggccauguacgcggacgacaccgccggcugggacacccggaucaccgaggacgaccuccacaacgaggagaagaucacgcagcagauggaccccgagcaccgccagcuggccaacgccaucuucaagcugaccuaccagaacaagguggucaaggugcagcggcccaccccgaaggggaccgugauggacaucaucucccgcaaggaccagcggggcagcggccaggucgggaccuacggccucaacacguucaccaacauggaggcccagcuggugcgccagauggagggggagggcgugcuguccaaggcggaccucgagaacccccaccuccuggagaagaagaucacccaguggcucgagaccaagggggucgagcggcugaagcgcauggccaucagcggcgacgacugcguggugaagcccaucgacgaccgguucgccaacgcccugcucgcccugaacgacaugggcaagguccgcaaggacaucccccaguggcagccguccaagggguggcacgacuggcagcagguccccuucugcagccaccacuuccacgagcugaucaugaaggacggccggaagcucgugguccccugccgcccccaggacgagcugaucgggcgcgcgcggaucucccagggcgccggguggagccugaaggagacggccugccucggcaaggccuacgcccagauguggucccugauguacuuccaccgccgggaccugcgccucgcgagcaacgccaucugcuccgccgugccggugcacuggauccccaccagccggaccaccuggagcauccacgcccaccaccaguggaugacgaccgaggacaugcugaccgucuggaaccgcguguggaucgaggacaaccccuggauggaggacaagacccccgugacgaccugggaggacaucccguaccugggcaagcgggaggaccaguggugcgggucccucaucggccugaccagccgcgcgaccugggcccagaacauccugacggccauccagcagguccggucccucaucggggacgaggaguuccuggacuacaugcccagcaugaagcgcuuccggaaggaggaggaguccgagggcgccaucugguga

SEQ ID NO: 10330 - RNA, 9873 nt, Artificial Sequence
  derived and/or modified CDS sequence (opt1) from DENV-3__FJ898456__SS-prME
accagccugugccucaugaugaugcugcccgccacccuggccuuccaccucaccucccgggacggcgagccccggaugaucguggggaagaacgagcgcggcaagagccugcuguucaagaccgccuccgggaucaacaugugcacccucaucgccauggaccugggcgagaugugcgacgacaccgugaccuacaagugcccccugaucaccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagacguggaugagcgcggagggcgccuggcgccagguggagaagguggagaccugggccuuccgccaccccggguucaccauccucgcccuguuccuggcgcacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacgugaccacggacagccgcugccccacccagggcgaggcgauccugcccgaggagcaggaccagaacuacgucugcaagcacaccuacguggaccggggguggggcaacgggugcggccucuucgggaagggcucccuggugaccugcgccaaguuccagugccuggagagcaucgagggcaaggccguccagcacgagaaccucaaguacacggugaucaucaccgugcacaccggggaccagcaccaggucggcaacgagacccagggggugacggccgagaucacgccccaggccuccaccgucgaggcgauccugcccgaguacggcacccuggggcucgagugcagcccccgcaccggccuggacuucaacgagaugauccugcucacgaugaagaacaaggccuggauggugcaccggcagugguucuucgaccugccgcugcccuggaccuccggcgccaccaccgagacgcccaccuggaacaagaaggagcuccuggugaccuucaagaacgcccacgccaagaagcaggaggucguggugcuggggagccaggagggcgcgaugcacaccgcccucacgggggccaccgagauccagaccuccggcgggaccagcaucuucgccggccaccugaagugccgccugaagauggacaagcucgagcugaagggcauguccuacgccaugugccugaacgcguucguccucaagaaggaggugagcgagacgcagcacgggaccauccugaucaagguggaguacaagggcgaggacgcccccugcaagaucccguucagcaccgaggacgggcagggcaaggcccacaacggccggcugaucaccgccaaccccaucgucacgaagaaggaggagcccgugaacaucgaggcggagcccccguucggggaguccaacaucgugaucggcaucggggacaaggcccugaagaucaacugguacaagaagggcagcuccaucgggaagauguucgaggccaccgcccgcggcgcccggcgcauggcgauccucggcgacaccgccugggacuucgggagcgucggcggggugcugaacucccugggcaagauggugcaccagaucuucgggagcgccuacaccgcccucuucuccggcgucagcuggaucaugaagaucggcaucggggugcugcugacguggaucggccucaacuccaagaacaccagcauguccuucagcugcaucgugaucgggaucaucacccuguaccugggcgccgucgugcaggcggacauggggugcgugaucaacuggaagggcaaggagcucaagugcggcuccgggaucuucgucaccaacgaggugcacacguggaccgagcaguacaaguuccaggccgacagccccaagcggcuggccaccgccaucgccggcgcgugggagaacggggugugcggcauccgcuccaccacgcgcauggagaaccugcucuggaagcagaucgccaacgagcugaacuacauccugugggagaacaacaucaagcucaccaucgucgugggggacgugaucggcauccuggagcagggcaagcggacccugacgccccagcccauggagcucaaguacagcuggaagacgugggggaaggccaagaucgucaccgccgagacccagaacuccagcuucaucaucgacggcccgaacacccccgagugccccuccgcgagccgcgccuggaacgugugggagguggaggacuacggguucggcgucuucacgaccaacaucuggcugaagcugcgggagauguacacccagcucugcgaccaccgccugaugagcgccgccgugaaggacgagcgggccgugcacgcggacaugggcuacuggaucgagucccagaagaacgggagcuggaagcuggagaaggccucccucaucgaggucaagaccugcaccuggcccaagagccacacgcugugguccaacggcgugcuggagagcgacaugaucaucccgaagucccucgccgggcccaucagccagcacaacuaccgccccggcuaccacacccagaccgccgggccguggcaccugggcaagcuggagcucgacuucaacuacugcgagggcaccacgguggucaucaccgagaacugcgggacccggggccccucccugcgcaccacgaccgugagcgggaagcugauccacgaguggugcugccgguccugcacccugccgccccuccgcuacaugggcgaggacgggugcugguacggcauggagauccggccgaucaacgagaaggaggagaacauggucaagagccuggucuccgccggcagcgggaaggcggacaacuucaccaugggcgugcucugccuggccaucuucuucgaggaggugaugcgcgggaaguucggcaagaagcacaugaucgccggggcccuguucacguucguccuccugcuguccggccagaucaccuggcgggacauggcccacacccucaucaugaucggcagcaacgcguccgaccgcauggggaugggcgugaccuaccuggcccugaucgccacguucaagauccagcccuuccucgcccugggguucuuccugcggaagcucaccagccgcgagaaccugcugcucggcgugggccuggcgauggccaccacccugcagcuccccgaggacaucgagcagauggccaacgggaucgcccugggccugauggcccucaagcugaucacgcaguucgagaccuaccagcuguggaccgcgcucgucagccugaugugcuccaacaccaucuucacgcugaccguggccuggcggaccgccacccucauccuggccgugaucagccugcuccccgucugccaguccagcuccaugcgcaagacggacuggcugccgaugaccguggccgcgaugggggugcccagccugccccucuucaucuucucccugaaggacacccugaagcggcgcagcuggccccucaacgagggcgucauggccguggggcuggucuccauccuggccagcuccuuccuccgcaacgacgugccgauggccggcccccugguggccggcgggcugcucaucgcgugcuacgucaucaccggcacgagcgccgaccugaccguggagaaggccgccgacgugaccugggaggaggaggccgagcagaccggggucucccacaaccugaugaucacgguggacgacgacggcaccaugcggaucaaggacgacgagaccgagaacauccucaccgugcugcugaagaccgcgcuccugaucgucagcgggaucuuccccuacuccauccccgccacgcugcucguguggcacaccuggcagaagcagacccagcgcagcggcgugcugugggacgucccgagcccgcccgagacccagaaggccgagcuggaggagggcguguaccggaucaagcagcaggggaucuucggcaagacccaggugggggucggcgugcagaaggaggggguguuccacaccauguggcacgucacccgcggcgccgugcucacccacaacggcaagcggcuggagcccaacugggcgaacgugaagaaggaccugaucagcuacgggggcggguggaagcucuccgcccaguggcagaagggcgaggagguccaggugaucgccguggagccggggaagaaccccaagagcuuccagacgaugcccggcaucuuccagaccaccaccggcgagaucggggccaucgcccuggacuucaagcccggcacgagcggguccccgaucaucaaccgcgagggcaaggucgugggccuguacgggaacggcguggucaccaagaacgggggcuacgugagcgggaucgcgcagaccaacgccgagcccgacggccccaccccggagcuggaggaggagauguucaagaagcggaaccucacgaucauggaccugcaccccggcuccgggaagacccgcaaguaccugcccgccaucgugcgggaggccaucaagcgccggcuccgcacccugauccuggcccccacccgggucguggcggccgagauggaggaggcccucaagggccugccgauccgcuaccagacgaccgccaccaagagcgagcacaccgggcgggagaucguggaccugaugugccacgccacguucaccaugcgccuccugucccccguccgggugcccaacuacaaccugaucgugauggacgaggcgcacuucaccgaccccgccagcaucgccgcccgcggcuacaucuccacccgggucgggaugggcgaggcggccgccaucuucaugacggccaccccgcccggcaccgccgacgcguucccccagagcaacgcccccauccaggacgaggagcgcgacaucccggagcgguccuggaacagcgggaacgaguggaucaccgacuucgccggcaagacggugugguucgugcccuccaucaaggccgggaacgacaucgccaacugccuccgcaagaacggcaagaaggucauccagcugagccgcaagaccuucaacaccgaguaccagaagaccaagcugaacgacugggacuucguggugacgaccgacaucuccgagaugggggcgaacuucaaggccgaccgggucaucgacccccgccggugccucaagcccgugauccugaccgacggcccggagcgcgugauccuggccggccccaugcccgucaccguggccagcgccgcgcagcggcgcgggcgggugggccgcaacccccagaaggagaacgaccaguacaucuucacggggcagccgcucaacaacgacgaggaccacgcccacuggaccgaggccaagaugcugcuggacaacaucaacacccccgagggcaucauccccgcccucuucgagcccgagcgggagaaguccgcggccaucgacggggaguaccgccugaagggcgagagccggaagaccuucgucgagcugaugcgccggggcgaccucccgguguggcuggcccacaagguggccuccgaggggaucaaguacaccgaccgcaaguggugcuucgacggcgagcggaacaaccagauccuggaggagaacauggacgucgagaucuggacgaaggagggggagaagaagaagcuccgcccccgguggcuggacgcccgcaccuacagcgacccccuggcgcucaaggaguucaaggacuucgccgccggccggaaguccaucgcccuggaccuggugaccgagaucggccgcguccccagccaccucgcccaccgcacccggaacgcgcuggacaaccuggugaugcuccacacgagcgagcacgggggccgcgccuaccggcacgccguggaggagcugccggagaccauggagacccugcuccugcuggggcucaugauccugcugaccggcggggccaugcuguuccugaucuccggcaagggcaucgggaagacgagcaucggccugaucugcgucguggccuccagcgggaugcucuggauggcggacgugccccugcaguggaucgccuccgccaucguccuggaguucuucaugauggugcuccugauccccgagccggagaagcagcgcacgccccaggacaaccagcuggccuacguggucaucggcauccucacccuggccgcgaucguggccgccaacgagauggggcugcucgagaccacgaagcgggaccugggcaugagcaaggagcccggcguggucucccccaccagcuaccuggacguggaccuccacccggccuccgcguggacccuguacgccguggccaccacggucaucacccccaugcugcgccacaccaucgagaacagcaccgccaacgugucccucgccgcgaucgccaaccaggccgugguccugauggggcuggacaagggcuggcccaucagcaagauggaccucggggugccccugcuggcccucggcugcuacucccaggugaacccgcugacgcugaccgccgcgguccuccugcuggugacccacuacgccaucaucgggcccggccuccaggccaaggccacccgggaggcccagaagcgcacggcggccggcaucaugaagaaccccaccguggacgggaucaugaccaucgaccuggaccccgucaucuacgacagcaaguucgagaagcagcugggccaggugaugcuccuggugcugugcgccguccagcuccugcugaugcggaccuccugggccuucugcgaggcgcucacgcuggccaccgggccgaucaccacccugugggagggcagccccggcaaguucuggaacacgaccaucgccguguccauggccaacaucuuccgcgggagcuaccucgccggcgcggggcuggccuucuccaucaugaaguccgugggcaccgggaagcggggcaccggcagccagggggagacgcugggcgagaaguggaagaagaagcucaaccagcugagccgcaaggaguucgaccuguacaagaaguccgggaucaccgaggucgagcggaccgaggccaaggagggccucaagcgcggggagaucacccaccacgccgugucccggggcagcgccaagcugcagugguucguggagcgcaacauggucauccccgagggccgggugaucgaccuggggugcggccgcgggggcugguccuacuacugcgcggggcucaagaaggugaccgagguccggggcuacacgaagggcgggcccggccacgaggagccggugcccaugagcaccuacggguggaacaucgugaagcugauguccggcaaggacgucuucuaccugccgcccgagaagugcgacacccuccugugcgacaucggggagagcuccccgagccccaccguggaggagucccgcacgauccgggugcugaagauggucgagcccuggcugaagaacaaccaguucugcaucaaggugcucaaccccuacaugccgaccgugaucgagcaccuggagcgccugcagcgcaagcacggcggcaugcucguccggaacccccugagccgcaacuccacccacgagauguacuggaucagcaacgggaccggcaacaucguguccagcgugaacauggucucccggcugcuccugaaccgcuucacgaugacccaccggcgccccaccaucgagaaggacguggaccugggggccggcacccggcacgugaacgccgagcccgagacgccgaacauggacgucaucggcgagcgcauccggcgcaucaaggaggagcacagcuccaccuggcacuacgacgacgagaaccccuacaagaccugggccuaccacgggagcuacgaggugaaggccaccggcagcgcguccagcaugaucaacggggucgugaagcuccugacgaagcccugggacguggucccgauggugacccagauggccaugaccgacaccacgcccuucggccagcagcggguguucaaggagaaggucgacacccgcacgccccggcccaugccggggacccgcaaggugauggagaucacggccgaguggcuguggcggacccucggccgcaacaagcggccccgccugugcacccgggaggaguucaucaagaaggugcgcaccaacgccgcgaugggcgccgucuucacggaggagaaccagugggacuccgcccgcgccgccguggaggacgaggaguucuggaagcugguggaccgggagcgcgagcuccacaagcuggggaagugcggcagcugcgucuacaacaugauggggaagcgggagaagaagcugggcgaguucgggaaggcgaagggcucccgcgccaucugguacauguggcucggcgcccgguaccuggaguucgaggcccugggguuccucaacgaggaccacugguucagccgcgagaacuccuacagcggcguggagggggagggccugcacaagcugggguacauccuccgggacaucuccaagauccccggcggcgccauguacgcggacgacaccgccgggugggacacccgcaucaccgaggacgaccugcacaacgaggagaagaucacgcagcagauggaccccgagcaccggcgccuggccaacgccaucuucaagcucaccuaccagaacaagguggucaaggugcagcggccgacccccaagggcaccgugauggacaucaucagccgcaaggaccagcggggguccggccaggucggcacguacgggcugaacaccuucaccaacauggaggcccagcugauccgccagauggagggcgagggggugcucagcaaggcggaccuggagaacccccaccuccucgagaagaaggugacccaguggcuggagaccaagggcgucgagcggcugaagcgcauggccaucuccggggacgacugcguggugaagcccaucgacgaccgguucgccaacgcccuccuggcccugaacgacaugggcaagguccgcaaggacaucccgcaguggcagcccagcaagggcuggcacgacuggcagcagguccccuucugcucccaccacuuccacgagcucaucaugaaggacgggcggaagcuggugguccccugccgcccgcaggacgagcugaucggccgggcgcgcaucagccagggggccggcuggucccuccgcgagacggccugccuggggaaggccuacgcgcagaugugggcccugauguacuuccaccggcgcgaccuccggcuggccagcaacgccaucugcuccgccgugcccgugcacuggguccccaccagccgcaccaccuggagcauccacgcgcaccaccaguggaugacgaccgaggacaugcugaccguguggaaccggguguggaucgaggacaaccccuggauggaggacaagaccccggucacgaccugggaggacgugcccuaccucggcaagcgcgaggaccaguggugcggcucccugaucgggcuggccagccgggccaccugggcccagaacauccucaccgccauccagcagguccgcucccugaucggcaacgaggaguuccuggacuacaugcccagcaugaagcgguuccgcaaggaggaggaguccgagggggcgaucugguga

SEQ ID NO: 10331 - RNA, 9873 nt, Artificial Sequence
  derived and/or modified CDS sequence (opt1) from DENV-3__JN697379__SS-prME
accagccugugccucaugaugaugcugcccgccacccuggccuuccaccucacgucccgcgacggcgagccgcggaugaucguggggaagaacgagcgcggcaagagccugcuguucaagaccgcguccgggaucaacaugugcacccucaucgccauggaccugggcgagaugugcgacgacaccgucacguacaagugcccccacaucaccgagguggagcccgaggacaucgacugcuggugcaaccugaccagcaccugggugacguacgggaccugcaaccaggccggcgagcaccggcgcgacaagcgguccgucgcccucgccccccacgugggcauggggcuggacacccgcacccagacguggaugagcgcggagggcgccuggcggcagguggagaaggucgagaccugggcccugcgccacccgggguucaccauccucgcccuguuccuggcgcacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacaucaccacggacagccgcugccccacccagggcgaggcgauccugccggaggagcaggaccagaacuacgugugcaagcacaccuacgucgaccggggguggggcaacgggugcggccucuucgggaagggcucccuggugaccugcgccaaguuccagugccuggagagcaucgagggcaaggugguccagcacgagaaccucaaguacacggugaucaucaccgugcacaccggggaccagcaccaggucggcaacgagacccagggggugacggccgagaucaccucccaggccagcaccgccgaggucauccugcccgaguacggcacccuggggcucgagugcuccccccgcaccggccuggacuucaacgagaugauccugcucacgaugaagaacaaggcguggauggugcaccggcagugguucuucgaccugccccugccguggaccagcggcgccaccaccgagacgcccaccuggaaccgcaaggagcuccuggugaccuucaagaacgcccacgccaagaagcaggaggucguggugcuggggucccaggagggcgccaugcacaccgcgcucacgggggccaccgagauccagaccagcggcgggaccuccaucuucgccggccaccugaagugccggcugaagauggacaagcucaagcugaagggcaugagcuacgccaugugccugaacacguucguccucaagaaggaggugagcgagacccagcacgggaccauccugaucaagguggaguacaagggcgaggacgcccccugcaagauccccuucuccaccgaggacgggcagggcaaggcgcacaacggccgccugaucacggccaacccggucgugaccaagaaggaggagcccgugaacaucgaggccgagccccccuucggggagagcaacaucgucaucggcaucggggacaaggcccugaagaucaacugguaccggaagggcuccagcaucgggaagauguucgaggcgaccgcccgcggcgcccggcgcauggccauccucggcgacaccgccugggacuucggguccgugggcggggugcugaacagccugggcaagaugguccaccagaucuucggguccgcguacacggcccucuucagcggcguguccuggaucaugaagaucggcaucggggugcugcugaccuggaucggccucaacagcaagaacaccuccaugagcuucuccugcaucgccaucgggaucaucacccuguaccugggcgucguggugcaggccgacauggggugcgucaucaacuggaagggcaaggagcucaagugcggcagcgggaucuucgugacgaacgaggugcacaccuggaccgagcaguacaaguuccaggccgacuccccgaagcgccuggcgaccgccaucgccggcgccugggagaacggggucugcggcauccggagcacgacccgcauggagaaccugcucuggaagcagaucgccaacgagcugaacuacauccugugggagaacaacaucaagcucaccgugguggucggggacaucaccggcgugcuggagcagggcaagcggacgcugaccccccagcccauggagcucaaguacuccuggaagaccugggggaaggcgaagaucgugaccgccgagacgcagaacagcuccuucaucaucgacggccccagcaccccggagugccccagcgccucccgcgccuggaacgucugggagguggaggacuacggguucggcguguucaccaccaacaucuggcugaagcugcgggaggucuacacccagcucugcgaccaccgccugaugagcgcggccgugaaggacgagcgggccgugcacgccgacaugggcuacuggaucgagucccagaagaacgggagcuggaagcuggagaaggccucccucaucgaggucaagacgugcaccuggcccaagagccacacccugugguccaacggcgugcuggagagcgacaugaucauccccaagucccucgcggggccgaucagccagcacaaccaccgccccggcuaccacacccagacggccgggcccuggcaccugggcaagcuggagcucgacuucaacuacugcgagggcaccaccguggucaucuccgagaacugcgggacccggggcccgagccugcgcacgaccaccguguccgggaagcugauccacgaguggugcugccggagcugcacccuccccccccugcgcuacaugggcgaggacgggugcugguacggcauggagauccggcccaucaacgagaaggaggagaacauggugaagucccuggccagcgccggcuccgggaaggucgacaacuucacgaugggcgugcucugccuggccauccuguucgaggaggugaugcgcgggaaguucggcaagaagcacaugaucgcggggguccucuucaccuucgugcugcugcucagcggccagaucaccuggcgggacauggcccacacccugaucaugaucggcagcaacguguccgaccgcauggggaugggcgucacguaccuggcccucaucgccaccuucaagauccagccguuccuggcccugggguucuuccuccggaagcugaccagccgcgagaaccugcuccugggcgugggccuggcgauggccgccacccuccggcugcccgaggacaucgagcagauggccaacgggaucgcgcugggccucauggcccugaagcugaucacgcaguucgagaccuaccagcucuggaccgcccuggugucccugaccugcagcaacacgaucuucacccucaccgucgccuggcgcaccgccacgcugauccuggcggggaucucccuccugcccgugugccagagcuccagcaugcgcaagaccgacuggcugcccaugaccgucgccgccaugggcgugccgccccucccccuguucaucuucucccugaaggacacccucaagcggcgcagcuggccccugaacgagggggugauggccgucggccugguguccauccucgccagcucccugcugcggaacgacgugccgauggcgggcccccucgucgccgggggccugcugaucgccugcuacgugaucacggggaccagcgccgaccucaccguggagaaggccgcggacgucaccugggaggaggaggccgagcagacgggcgugucccacaaccugaugaucaccguggacgacgacgggaccaugcgcaucaaggacgacgagaccgagaacauccugaccguccuccugaagacggcccugcucaucgugagcggcaucuuccccuacuccauccccgccacccugcugguguggcacaccuggcagaagcagacccagcggagcggcguccucugggacgugccguccccccccgagacgcagaaggccgagcuggaggaggggguguaccgcaucaagcagcagggcaucuucgggaagacccaggucggcgugggggugcagaaggagggcgucuuccacaccauguggcacgugacccggggcgcggugcugacgcacaacgggaagcgccucgagcccaacugggccagcgucaagaaggaccugaucagcuacggcgggggcuggcggcuguccgcccaguggcagaagggggaggaggugcaggugaucgccgucgagccgggcaagaaccccaagaacuuccagaccaugcccggcaucuuccagaccaccacgggggagaucggcgcgaucgcccuggacuucaagcccgggaccagcggcuccccgaucaucaaccgcgagggcaaggugguggggcucuacggcaacggggucgugaccaagaacggcggguacgugagcggcaucgcccagaccaacgccgagcccgacggccccacgccggagcuggaggaggagauguucaagaagcggaaccugaccaucauggaccuccaccccggguccggcaagacccgcaaguaccugcccgccaucguccgggaggcgaucaagcgccggcugcgcacccucauccuggcccccacgcgggugguggccgccgagauggaggaggcccugaaggggcucccgauccgcuaccagaccaccgcgaccaagagcgagcacacgggccgggagaucgucgaccugaugugccacgccaccuucaccaugcgccugcucucccccgugcgggugcccaacuacaaccugaucaucauggacgaggcccacuucaccgaccccgccagcaucgccgcgcgcggguacaucuccacgcgcgucggcaugggcgaggccgccgccaucuucaugaccgcgaccccgcccgggaccgccgacgccuucccccagagcaacgcccccauccaggacgaggagcgggacaucccggagcgcuccuggaacagcggcaacgaguggaucacggacuucguggggaagaccgugugguucguccccuccaucaaggccggcaacgacaucgcgaacugccugcggaagaacgggaagaaggugauccagcucagccgcaagaccuucgacaccgaguaccagaagacgaagcugaacgacugggacuucguggucaccaccgacaucuccgagaugggcgccaacuucaaggccgaccgggugaucgacccccgccggugccugaagcccgugauccucaccgacggcccggagcgcgucauccuggccgggcccaugcccgugacgguggccagcgcggcccagcggcgcggccgggucgggcgcaacccccagaaggagaacgaccaguacaucuucaugggccagccgcugaacaacgacgaggaccacgcccacuggaccgaggccaagaugcuccuggacaacaucaacacccccgaggggaucauccccgcccuguucgagcccgagcgggagaaguccgcggccaucgacggcgaguaccgccucaagggcgagagccggaagaccuucguggagcugaugcgccggggggaccugccggucuggcucgcccacaagguggccuccgagggcaucaaguacaccgaccgcaaguggugcuucgacggggagcggaacaaccagauccuggaggagaacauggacguggagaucuggacgaaggagggcgagaagaagaagcugcgcccccgcuggcucgacgcgcggaccuacagcgacccccuggcccugaaggaguucaaggacuucgccgccggccgcaagagcaucgcccucgaccuggucaccgagaucgggcgggugcccucccaccuggcgcaccgcacccggaacgcccucgacaaccuggugaugcugcacacgagcgagcacggcgggcgcgccuaccggcacgccgucgaggagcucccggagaccauggagacccugcugcuccugggccugaugauccuccugaccgggggcgccaugcuguuccucaucuccggcaaggggaucggcaagacgagcaucgggcugaucugcgugaucgcguccagcggcaugcuguggauggccgacgugccccuccaguggaucgccuccgccaucguccuggaguucuucaugauggugcugcucauccccgagccggagaagcagcgcaccccccaggacaaccagcuggccuacguggucaucgggauccugacccucgcggccaucguggccgccaacgagaugggccugcuggagaccacgaagcgggaccucggcaugagcaaggagcccgggguggucucccccaccagcuaccuggacguggaccugcacccggccuccgcguggacccucuacgccguggccaccacggucaucacccccaugcugcgccacaccaucgagaacagcaccgccaacgugucccuggcggccaucgccaaccaggccgugguccucaugggccuggacaagggguggcccaucagcaagauggaccugggcgugccccuccuggcccuggggugcuacucccaggugaacccgcucacgcuggcggccgccguccugcuccuggugacccacuacgccaucaucggccccggccugcaggccaaggcgacccgggaggcccagaagcgcaccgccgccgggaucaugaagaaccccacgguggacggcaucaugaccaucgaccucgaccccgucaucuacgacagcaaguucgagaagcagcuggggcaggugaugcugcucgugcugugcgccguccagcugcuccugaugcggaccuccugggcgcugugcgaggugcucacccuggccacgggcccgaucaccacccugugggagggcagccccgggaaguucuggaacaccacgaucgccguguccauggccaacaucuuccgcggcagcuaccucgcgggggccggccuggccuucagcaucaugaaguccgucgggaccggcaagcggggcaccgggagccagggcgagacccugggggagaaguggaagaagaagcucaaccagcugucccgcaaggaguucgaccuguacaagaagagcggcaucacggagguggaccggaccgaggccaaggaggggcucaagcgcggcgagaucacccaccacgccgugucccggggcagcgcgaagcugcagugguucgucgagcgcaacauggugauccccgaggggcgggugaucgaccugggcugcgggcgcggcgggugguccuacuacugcgccggccucaagaaggucaccgaggugcgcggcuacaccaaggggggccccgggcacgaggagccggugcccaugagcacguacggcuggaacaucgucaagcugauguccgggaaggacguguucuaccugccccccgagaagugcgacacccugcucugcgacaucggcgagagcuccccgagccccaccguggaggagucccggaccauccgcguccugaagaugguggagcccuggcugaagaacaaccaguucugcaucaaggugcucaaccccuacaugccgacggucaucgagcaccuggagcggcugcagcgcaagcacggcgggaugcucgugcggaacccccugagccgcaacuccacccacgagauguacuggaucagcaacggcaccgggaacaucguguccagcgucaacauggugucccggcugcuccugaaccgcuucaccaugacgcaccggcgccccaccaucgagaaggacgucgaccugggcgccggcacccggcacgugaacgccgagcccgagaccccgaacauggacgugaucggggagcgcaucaagcggaucaaggaggagcacagcagcacguggcacuacgacgacgagaaccccuacaagaccugggccuaccacggcuccuacgaggucaaggcgaccgggagcgccuccagcaugaucaacggcguggugaagcuccugaccaagcccugggacgucgugccgauggugacgcagauggccaugaccgacaccacccccuucgggcagcagcgcgucuucaaggagaagguggacacgcggaccccccgccccaugccgggcacccggaaggugauggagaucaccgccgaguggcuguggcgcacgcucggccggaacaagcgcccccgccugugcacccgggaggaguucaccaagaagguccgcaccaacgccgcgaugggggccguguucacggaggagaaccagugggacuccgcccgggccgcgguggaggacgaggaguucuggaagcuggucgaccgcgagcgggagcuccacaagcugggcaagugcgggagcugcguguacaacaugaugggcaagcgcgagaagaagcugggggaguucggcaaggccaagggcucccgggccaucugguacauguggcucggggcccgcuaccuggaguucgaggcccugggcuuccucaacgaggaccacugguucagccgggagaacuccuacagcgggguggagggcgaggggcugcacaagcugggcuacauccuccgcgacaucuccaagauccccggcggggcgauguacgccgacgacaccgccggcugggacacccggaucaccgaggacgaccugcacaacgaggagaagaucacgcagcagauggaccccgagcaccgccagcuggccaacgccaucuucaagcucaccuaccagaacaaggucgugaaggugcagcggccgacccccaaggggaccgucauggacaucaucagccgcaaggaccagcggggcuccggccagguggggacguacggccugaacaccuucaccaacauggaggcgcagcugauccgccagauggagggggagggcgugcucagcaaggccgaccuggagaacccccacccccuggagaagaagaucacccaguggcucgagaccaagggggucgagcggcugaagcgcauggccaucuccggcgacgacugcguggugaagccgaucgacgaccgguucgccaacgcccugcucgcgcugaacgacaugggcaagguccgcaaggacaucccccaguggcagcccagcaagggguggcacgacuggcagcaggugcccuucugcucccaccacuuccacgagcugaucaugaaggacggccggaagcucguggucccgugccgcccccaggacgagcugaucgggcgcgcccggaucagccagggcgccggguggucccugcgcgagacggccugccucggcaaggccuacgcgcagauguggacccugauguacuuccaccggcgcgaccugcggcucgccagcaacgccaucugcagcgccgugcccgugcacuggguccccaccucccgcaccacguggagcauccacgcgcaccaccaguggaugaccaccgaggacaugcugaccguguggaaccggguguggaucgaggacaacccguggauggaggacaagacgcccgucaccaccugggaggacgugcccuaccugggcaagcgcgaggaccaguggugcgggucccucaucggccugaccagccgggccacgugggcccagaacauccugaccgccauccagcaggugcgcucccucaucgggaacgaggaguuccuggacuacaugcccagcaugaagcgguuccgcaaggaggaggaguccgagggcgccaucugguga

SEQ ID NO: 10332 - RNA, 9873 nt, Artificial Sequence
  derived and/or modified CDS sequence (opt1) from DENV-3__JQ045687__SS-prME
accagccugugccucaugaugaugcugcccgcgacccuggccuuccaccucaccagccgggacggcgagccgcggaugaucguggggaagaacgagcgcggcaagagccugcuguucaagaccgcguccgggaucaacaugugcacccucaucgccauggaccugggcgagaugugcgacgacaccgugaccuacaagugcccccugguggccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgccgagggcgccuggcggcaggucgagaagguggagacgugggcccuccgccacccgggguucaccauccuggcgcuguuccucgcccacuacaucggcaccucccugacccagaagguggucaucuucauccugcucaugcuggugacgcccagcaugaccaugcggugcgugggggucggcaaccgcgacuucguggagggccuguccggggccaccuggguggacgucgugcucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgucugcaagcacaccuacguggaccggggguggggcaacgggugcggccuguucgggaagggcucccuggugaccugcgccaaguuccagugccucgagcccaucgagggcaaggucgugcaguacgagaaccugaaguacaccgugaucaucacgguccacaccggggaccagcaccaggugggcaacgacacccagggggucaccguggagaucacgccccaggccagcaccguggaggccguccugcccgaguacggcacccucgggcuggagugcuccccgcgcaccggccuggacuucaacgagaugauccuccugaccaugaagaacaaggcguggauggugcaccggcagugguucuucgaccugccccuccccuggacgagcggcgccaccaccgagacccccacguggaacaagaaggagcugcuggugaccuucaagaacgcccacgccaagaagcaggaggucguggugcucgggucccaggagggcgccaugcacaccgcgcugaccggggccacggagauccagaacagcggcgggaccuccaucuucgccggccaccugaagugccgccucaagauggacaagcuggagcugaagggcaugagcuacgccaugugccucaacaccuucguccugaagaaggagguguccgagacccagcacgggacgauccugaucaagguggaguacaagggcgaggacgccccgugcaagauccccuucagcaccgaggacgggcagggcaaggcgcacaacggccggcugaucaccgccaaccccgucgugaccaagaaggaggagcccgugaacaucgaggccgagccgcccuucggggagagcaacaucgucaucggcaucggggacaaggcccucaagaucaacugguacaagaagggcuccagcaucgggaagauguucgaggcgacggcccgcggcgcccggcgcauggccauccugggcgacaccgccugggacuucggguccgugggcggggugcugaacagccucggcaagaugguccaccagaucuucggguccgcguacaccgcccuguucagcggcguguccuggaucaugaagaucggcaucggggugcugcucaccuggaucggccugaacagcaagaacacguccaugagcuucuccugcaucgucaucgggaucaucacccuguaccucggcgccguggugcaggccgacauggggugcgccaucaacuggaagggcaaggagcugaagugcggcagcgggaucuucgucaccaacgaggugcacaccuggacggagcaguacaaguuccaggcggacucccccaagcggcuggccaccgccaucgccggcgccugggagaacggggugugcggcauccgcagcaccacccgcauggagaaccuccuguggaagcagaucgcgaacgagcugaacuacauccucugggagaacaacaucaagcugacggucguggugggggacaucaucggcguccuggagcagggcaagcggacccucacgccccagccgauggagcugaaguacuccuggaagaccugggggaaggccaagaucgugacggccgagacccagaacagcuccuucaucaucgacggccccaacacccccgagugccccagcgccucccgcgcguggaacgugugggaggucgaggacuacggguucggcguguucaccacgaacaucuggcugaagcuccgggagguguacacccagagcugcgaccaccgccugaugagcgccgccaucaaggacgagcgggccguccacgccgacaugggcuacuggaucgagucccagaagaacgggagcuggaagcuggagaaggcguccuucaucgaggugaagaccugcaccuggcccaagagccacacccucugguccaacggcgugcuggagagcgacaugaucauccccaagucccuggccgggcccaucagccagcacaaccaccgcccgggcuaccacacgcagaccgccgggcccuggcaccucggcaagcuggagcuggacuucaacuacugcgagggcaccaccgucgugaucacggagaacugcgggacccggggccccucccuccgcaccaccacggugagcgggaagcugauccacgaguggugcugccgguccugcacccugcccccgcuccgcuacaugggcgaggacgggugcugguacggcauggagauccggcccaucaacgagaaggaggagaacauggucaagagccugguguccgccggcagcgggaagguggacaacuucaccaugggcguccugugccucgccauccuguucgaggaggugaugcgcgggaaguucggcaagaagcacaugaucgcgggggugcuguucaccuucguccuccugcuguccggccagaucacguggcgggacauggcccacacccucaucaugaucggcagcaacgccuccgaccgcauggggaugggcgugaccuaccuggcccugaucgccaccuucaagauccagcccuuccucgcgcugggguucuuccugcggaagcucacgagccgcgagaaccugcugcucggcgugggccuggccauggccaccacccugcagcuccccgaggacaucgagcagauggccaacgggaucgcgcugggccugaugacccucaagcugaucacgcaguucgagaccuaccagcuguggaccgcccucgucagccugaccugcuccaacacgaucuucacccugaccguggccuggcggaccgccacgcucauccuggccggggucagccugcucccgcugugccaguccagcuccaugcgcaagaccgacuggcugcccaugaccguggcggccaugggcgugccgccccugccgcuguucaucuucagccugaaggacacccccaagcggcgcuccuggccccucaacgagggggucauggccgugggccuggugagcauccuggccuccagccuccugcgcaacgacguccccauggccggcccgcugguggccggcgggcuccugaucgccugcuacgugaucacggggaccuccgccgaccugaccgucgagaaggccgccgacgugaccugggaggaggaggcggagcagacgggggugagccacaaccucaugaucaccgucgacgacgacgggaccaugcggaucaaggacgacgagaccgagaacauccugaccgugcugcucaagacggcccugcugaucguguccggcaucuuccccuacagcauccccgccacccuccuggucuggcacaccuggcagaagcagacccagcgcuccggcgugcugugggacgugcccagcccgcccgagacgcagaaggccgagcucgaggagggggucuaccggaucaagcagcagggcaucuucgggaagacccaggugggcguggggguccagaaggagggcguguuccacaccauguggcacgugacccgcggcgccguccugacgcacaacgggaagcggcuggagcccaacugggcguccgugaagaaggaccucaucagcuacggcgggggcuggcgccuguccgcccaguggcagaagggggaggaggugcaggucaucgccguggagcccggcaagaacccgaagaacuuccagaccaugcccggcaucuuccagaccaccacgggggagaucggcgccaucgcgcuggacuucaagcccgggaccagcggcagcccgaucaucaaccgggagggcaagguggucgggcuguacggcaacgggguggugaccaagaacggcggguacgucuccggcaucgcccagaccaacgccgagcccgacggccccacgcccgagcucgaggaggagauguucaagaagcgcaaccugaccaccauggaccugcacccggggagcggcaagacccggaaguaccuccccgccaucgugcgcgaggccaucaagcggcgccugcggacgcugauccucgcgcccacccgcguggucgccgccgagauggaggaggcccugaaggggcugcccauccgguaccagaccaccgccacgaaguccgagcacaccggccgcgagaucguggaccucaugugccacgcgaccuucaccaugcggcugcugagcccggugcgcguccccaacuacaaccucaucaucauggacgaggcccacuucacggaccccgccuccaucgccgcccggggguacaucagcacccgcgugggcaugggcgaggcggccgccaucuucaugaccgccacgccgcccgggacggcggaggccuucccccaguccaacgcccccauccaggacgaggagcgggacauccccgagcgcagcuggaacuccggcaacgaguggaucaccgacuucguggggaagaccgucugguucgugcccagcaucaaggccggcaacgacaucgccaacugccugcgcaagaacgggaagaaggugauccagcugucccggaagaccuucgacacggaguaccagaagacccgccucaacgacugggacuucgucgugaccaccgacaucagcgagaugggcgcgaacuucaaggccgaccgggugaucgacccccgccggugccugaagcccgucauccugacggacggccccgagcgcgugauccucgccgggccgaugcccgugaccgccgccuccgcggcccagcggcgcggccgggucgggcgcaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgggagaaguccgcggccaucgacggcgaguaccgccugaagggcgagucccggaagacguucguggagcucaugcgccgcggggaccugcccgucuggcuggcccacaagguggccagcgagggcaucaaguacaccgaccgcaaguggugcuucgacggggagcggaacaaccagauccucgaggagaacauggacguggagaucuggaccaaggagggcgagcgcaagaagcugcggccgcgcuggcuggacgcgcgcaccuacuccgacccccucgcccugaaggaguucaaggacuucgccgccggccgcaagagcaucgcccuggaccucgucacggagaucgggcgcgugcccucccaccuggcguaccggacccgcaacgcccuggacaaccucgugaugcugcacaccagcgagcacggcgggcgggccuaccgccacgccgucgaggagcugccggagaccauggagacgcuccugcugcucggccugaugauccugcucaccgggggcgccaugcuguuccugaucagcggcaaggggaucggcaagaccuccaucgggcucaucugcgugaucgugagcuccggcaugcuguggauggcggacgucccccugcaguggaucgccagcgccaucgugcucgaguucuucaugauggugcugcugauccccgagcccgagaagcagcggaccccgcaggacaaccagcucgccuacgucgugaucgggauccugacgcuggccgcgaucguggccgccaacgagaugggccuccuggagaccaccaagcgcgaccugggcauguccaaggagcccggggucgugagccccaccuccuaccucgacguggaccugcaccccgccagcgccuggacgcuguacgcggucgccaccaccgugaucaccccgaugcuccggcacacgaucgagaacuccaccgccaacgugagccuggccgcgaucgccaaccaggccgucgugcugaugggccucgacaagggguggcccaucuccaagauggaccugggcgugccccugcucgcccuggggugcuacagccaggucaacccccugacccucaccgccgcggugcugcugcucgugacgcacuacgccaucaucggcccgggccugcaggccaaggccacccgcgaggcccagaagcggaccgcggccgggaucaugaagaaccccaccgucgacggcaucaugacgaucgaccuggaccccgugaucuacgacuccaaguucgagaagcagcucggccaggugaugcugcugguccucugcgccgugcagcugcugcucaugcgcaccagcugggcccugugcgaggcccugacccucgcgaccggccccaucacgacccugugggagggcuccccggggaaguucuggaacaccaccaucgccgugagcauggccaacaucuuccggggcuccuaccuggccggggcgggccucgccuucagcaucaugaaguccgucgggacgggccgccggggcaccgggagccagggcgagacccugggggagaaguggaagaagaagcugaaccagcucagccgcaaggaguucgaccuguacaagaaguccggcaucaccgagguggaccggaccgaggccaaggaggggcugaagcgcggcgagacgacccaccacgccgugagccggggcuccgccaagcuccagugguucgucgagcgcaacauggugauccccgaggggcgggugaucgaccugggcugcgggcgcggcggguggagcuacuacugcgcgggccugaagaaggucaccgaggugcgcggcuacaccaagggcgggcccgggcacgaggagcccgugccgauguccacguacggcuggaacaucgucaagcucaugagcgggaaggacguguucuaccugccgcccgagaagugcgacacccugcugugcgacaucggcgaguccagccccuccccgaccguggaggagagccggaccauccgcguccucaagaugguggagcccuggcugaagaacaaccaguucugcaucaaggugcugaaccccuacaugcccacggucaucgagcaccucgagcggcugcagcgcaaguacggcgggaugcuggugcggaacccgcucucccgcaacagcacccacgagauguacuggaucuccaacggcaccgggaacaucgugagcuccgucaacauggugagccggcugcugcucaaccgcuucaccaugacgcaccggcgccccaccaucgagaaggacgucgaccugggcgccggcacccggcacgugaacgccgagcccgagaccccgaacauggacgugaucggggagcgcaucaagcggaucaaggaggagcacuccagcacguggcacuacgacgacgagaaccccuacaagaccugggccuaccacggcuccuacgaggucaaggccaccgggagcgcgagcuccaugaucaacggcguggugaagcugcucaccaagcccugggacgucgugcccauggugacgcagauggccaugaccgacaccaccccguucgggcagcagcgcgucuucaaggagaagguggacacgcggacgccccggcccaugcccggcacccggaaggugauggagaucaccgccgaguggcuguggcgcacgcugggccggaacaagaagccgcgccucugcacccgcgaggaguucaccaagaagguccggaccaacgccgccaugggggcgguguucacggaggagaaccagugggacagcgcccgcgccgccguggaggacgaggaguucuggaagcuggucgaccgggagcgcgagcugcacaagcucggcaagugcggguccugcguguacaacaugaugggcaagcgggagaagaagcugggggaguucggcaaggcgaagggcagccgcgccaucugguacauguggcugggggcccgguaccucgaguucgaggcccugggcuuccugaacgaggaccacugguucucccgcgagaacagcuacuccgggguggagggcgaggggcuccacaagcugggcuacauccugcgggacaucagcaagauccccggcggggccauguacgcggacgacaccgccggcugggacacccgcaucaccgaggacgaccuccacaacgaggagaagaucacgcagcagauggaccccgagcaccggcagcuggccaacgccaucuucaagcugaccuaccagaacaaggucgugaaggugcagcgccccaccccgaaggggaccgucauggacaucaucucccggaaggaccagcgcggcagcggccagguggggaccuacggccucaacacguucaccaacauggaggcccagcuggugcggcagauggagggggagggcguccuguccaaggcggaccucgagaacccccaccuccuggagaagaagaucacccaguggcucgagaccaaggggguggagcgccugaagcggauggccaucagcggcgacgacugcguggucaagcccaucgacgaccgcuucgccaacgcccugcucgcccugaacgacaugggcaaggugcggaaggacaucccccaguggcagccguccaagggguggcacgacuggcagcagguccccuucugcagccaccacuuccacgagcugaucaugaaggacggccgcaagcucgucgugcccugccggccccaggacgagcugaucgggcgcgcgcgcaucucccagggcgccggguggagccugaaggagacggccugccucggcaaggccuacgcccagauguggucccugauguacuuccaccggcgcgaccugcggcucgcgagcaacgccaucugcuccgccgugccgguccacuggauccccaccagccgcaccaccuggagcauccacgcccaccaccaguggaugacgaccgaggacaugcugaccguguggaaccggguguggaucgaggacaaccccuggauggaggacaagacccccgucacgaccugggaggacgugccguaccugggcaagcgcgaggaccaguggugcgggucccucaucggccugaccagccgggcgaccugggcccagaacauccugacggccauccagcagguccgcucccucaucggggacgaggaguuccuggacuacaugcccagcaugaagcgguuccgcaaggaggaggaguccgagggcgccaucugguga

SEQ ID NO: 10333 - RNA, 9873 nt, Artificial Sequence
  derived and/or modified CDS sequence (opt1) from DENV-3__JQ045689__SS-prME
accagccugugccucaugaugaugcugcccgcgacccuggccuuccaccucaccagccgcgacggcgagccgcggaugaucguggggaagaacgagcgcggcaagagccugcuguucaagaccgcguccgggaucaacaugugcacccucaucgccauggaccugggcgagaugugcgacgacaccgucaccuacaagugcccccugaucgccgagguggagcccgaggacaucgacugcuggugcaaccucaccagcaccugggugaccuacgggacgugcaaccaggccggcgagcaccggcgcgacaagcgguccgucgcccuggcgccccacgugggcauggggcuggacacccgcacccagaccuggaugagcgccgagggcgccuggcggcaguucgagaagguggagacgugggcccuccgccacccgggguucaccauccuggcgcuguuccucgcccacuacaucggcaccucccugacccagaaggucgugaucuucauccugcucaugcuggugacgcccagcaugaccaugcggugcgucggggugggcaaccgcgacuucguggagggccuguccggggccaccugggucgacguggugcucgagcacggcgggugcgucaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgugugcaagcacaccuacguggaccggggguggggcaacgggugcggccuguucgggaagggcucccuggugaccugcgccaaguuccagugccucgagcccaucgagggcaagguggugcaguacgagaaccugaaguacaccgucaucaucacggugcacaccggggaccagcaccaggugggcaacgacacccagggggucaccguggagaucacgccccaggccagcaccgucgaggccgugcugcccgaguacggcacccucgggcuggagugcuccccgcgcaccggccuggacuucaacgagaugauccuccugaccaugaagaacaaggcguggauggugcaccggcagugguucuucgaccugccccuccccuggacgagcggcgccaccaccgagacccccacguggaaccgcaaggagcugcuggucaccuucaagaacgcccacgccaagaagcaggagguggugguccucgggucccaggagggcgccaugcacaccgcgcugaccggggccacggagauccagaacagcggcgggaccuccaucuucgccggccaccugaagugccggcucaagauggacaagcuggagcugaagggcaugagcuacgccaugugccucaacaccuucgugcugaagaaggagguguccgagacccagcacgggacgauccugaucaaggucgaguacaagggcgaggacgccccgugcaagauccccuucagcaccgaggacgggcagggcaaggcgcacaacggccgccugaucaccgccaaccccguggugaccaagaaggaggagcccgucaacaucgaggccgagccgcccuucggggagagcaacaucgugaucggcaucggggacaaggcccucaagaucaacugguacaagaagggcuccagcaucgggaagauguucgaggcgacggcccggggcgcccgccggauggccauccugggcgacaccgccugggacuucggguccgugggcgggguccugaacagccucggcaagauggugcaccagaucuucggguccgcguacaccgcccuguucagcggcguguccuggaucaugaagaucggcaucgggguccugcucaccuggaucggccugaacagcaagaacacguccaugagcuucuccugcaucgugaucgggaucaucacccuguaccucggcgccgugguccaggccgacauggggugcgccaucaacuggaagggcaaggagcugaagugcggcagcgggaucuucgugaccaacgaggugcacaccuggacggagcaguacaaguuccaggcggacucccccaagcgccuggccaccgccaucgccggcgccugggagaacggggucugcggcauccgcagcaccacccggauggagaaccuccuguggaagcagaucgcgaacgagcugaacuacauccucugggagaacaacaucaagcugacggugguggucggggacaucaucggcgugcuggagcagggcaagcgcacccucacgccccagccgauggagcugaaguacuccuggaagaccugggggaaggccaagaucgugacggccgagacccagaacagcuccuucaucaucgacggccccaacacccccgagugccccagcgccucccgggcguggaacgucugggagguggaggacuacggguucggcguguucaccacgaacaucuggcugaagcuccgcgaggucuacacccagagcugcgaccaccggcugaugagcgccgccaucaaggacgagcgcgccgugcacgccgacaugggcuacuggaucgagucccagaagaacgggagcuggaagcuggagaaggcguccuucaucgaggugaagaccugcaccuggcccaagagccacacccucugguccaacggcguccuggagagcgacaugaucauccccaagucccuggccgggcccaucagccagcacaaccaccggccgggcuaccacacgcagaccgccgggcccuggcaccucggcaagcuggagcuggacuucaacuacugcgagggcaccaccguggugaucacggagaacugcgggacccgcggccccucccuccggaccaccacggucagcgggaagcugauccacgaguggugcugccgcuccugcacccugcccccgcuccgguacaugggcgaggacgggugcugguacggcauggagauccgccccaucaacgagaaggaggagaacauggucaagagccugguguccgccggcagcgggaaggucgacaacuucaccaugggcgugcugugccucgccauccuguucgaggaggugaugcgggggaaguucggcaagaagcacaugaucgcggggguccuguucaccuucgugcuccugcuguccggccagaucacguggcgcgacauggcccacacccucaucaugaucggcagcaacgccuccgaccggauggggaugggcgugaccuaccuggcccugaucgccaccuucaagauccagcccuuccucgcgcugggguucuuccugcgcaagcucacgagccgggagaaccugcugcucggcgucggccuggccauggccaccacccugcagcuccccgaggacaucgagcagauggccaacgggaucgcgcugggccugaugacccucaagcugaucacgcaguucgagaccuaccagcuguggaccgcccucgugagccugaccugcuccaacacgaucuucacccugaccguggccuggcgcaccgccacgcucauccuggccggggucagccugcucccgcugugccaguccagcuccaugcggaagaccgacuggcugcccaugaccguggcggccaugggcgugccgccccugccgcuguucaucuucagccugaaggacacccccaagcgccgcuccuggccccucaacgagggggugauggccgugggccuggucagcauccuggccuccagccuccugcggaacgacgugcccauggccggcccgcugguggccggcgggcuccugaucgccugcuacgucaucacggggaccuccgccgaccugaccguggagaaggccgccgacgugaccugggaggaggaggcggagcagacgggggucagccacaaccucaugaucaccguggacgacgacgggaccaugcgcaucaaggacgacgagaccgagaacauccugaccgugcugcucaagacggcccugcugaucgucuccggcaucuuccccuacagcauccccgccacccuccugguguggcacaccuggcagaagcagacccagcgguccggcgugcugugggacguccccagcccgcccgagacgcagaaggccgagcucgaggaggggguguaccgcaucaagcagcagggcaucuucgggaagacccaggugggcgucggggugcagaaggagggcguguuccacaccauguggcacgucacccggggcgccgugcugacgcacaacgggaagcgccuggagcccaacugggcguccgugaagaaggaccucaucagcuacggcgggggcuggcggcuguccgcccaguggcagaagggggaggagguccaggugaucgccguggagcccggcaagaacccgaagaacuuccagaccaugcccggcaucuuccagaccaccacgggggagaucggcgccaucgcgcuggacuucaagcccgggaccagcggcagcccgaucaucaaccgcgagggcaaggucguggggcuguacggcaacgggguggucaccaagaacggcggguacguguccggcaucgcccagaccaacgccgagcccgacggccccacgcccgagcucgaggaggagauguucaagaagcggaaccugaccaucauggaccugcacccggggagcggcaagacccgcaaguaccuccccgccaucgugcgggaggccaucaagcgccggcugcgcacccugauccucgcgcccacgcgggucguggccgccgagauggaggaggcccugaaggggcugcccauccgcuaccagaccaccgccaccaaguccgagcacacgggccgggagaucguggaccucaugugccacgcgaccuucaccaugcgccugcugagcccgguccgggugcccaacuacaaccucaucaucauggacgaggcccacuucaccgaccccgccuccaucgccgcccgcggguacaucagcacgcgggugggcaugggcgaggcggccgccaucuucaugaccgccacgccgcccgggaccgcggaggccuucccccaguccaacgcccccauccaggacgaggagcgcgacauccccgagcgcagcuggaacuccggcaacgaguggaucacggacuucgucgggaagaccgugugguucgugcccagcaucaaggccggcaacgacaucgccaacugccugcggaagaacgggaagaaggucauccagcugucccgcaagaccuucgacaccgaguaccagaagacgcggcucaacgacugggacuucguggugaccaccgacaucagcgagaugggcgcgaacuucaaggccgaccgcgucaucgacccccggcgcugccugaagcccgugauccugaccgacggccccgagcgggugauccucgccgggccgaugcccgucacggccgccuccgcggcccagcgccggggccgcguggggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgcggccaucgacggcgaguaccggcugaagggcgagucccgcaagaccuucguggagcucaugcggcgcggggaccugcccgucuggcuggcccacaagguggccagcgagggcaucaaguacacggaccggaaguggugcuucgacggggagcgcaacaaccagauccucgaggagaacauggacgucgagaucuggaccaaggagggcgagcggaagaagcugcgcccgcgcuggcuggacgcgcggaccuacuccgacccccucgcccugaaggaguucaaggacuucgccgccggccgcaagagcaucgcccuggaccucgugaccgagaucgggcgggugcccucccaccuggcgcaccgcacgcggaacgcccuggacaaccucgucaugcugcacaccagcgagcacggcgggcgcgccuaccggcacgccguggaggagcugccggagaccauggagacccuccugcugcucggccugaugauccugcucaccgggggcgccaugcuguuccugaucagcggcaaggggaucggcaagaccuccaucgggcucaucugcgugaucgucagcuccggcaugcuguggauggcggacgugccccugcaguggaucgccagcgccaucgugcucgaguucuucaugaugguccugcugauccccgagcccgagaagcagcgcaccccgcaggacaaccagcucgccuacguggugaucgggauccugacccuggccgcgaucgucgccgccaacgagaugggccuccuggagacgaccaagcgggaccugggcauguccaaggagcccgggguggugagccccaccuccuaccucgacgucgaccugcaccccgccagcgccuggacccuguacgcgguggccacgaccgugaucaccccgaugcuccgccacaccaucgagaacuccacggccaacgucagccuggccgcgaucgccaaccaggccguggugcugaugggccucgacaagggguggcccaucuccaagauggaccugggcgucccccugcucgcccuggggugcuacagccaggugaacccccugacccucaccgccgcggugcugcugcucgucacccacuacgccaucaucggcccgggccugcaggccaaggccacgcgggaggcccagaagcgcaccgcggccgggaucaugaagaaccccaccguggacggcaucaugaccaucgaccuggaccccgugaucuacgacuccaaguucgagaagcagcucgggcaggucaugcugcuggugcucugcgccgugcagcugcugcucaugcggacgagcugggcccugugcgaggcccugacccucgcgaccggccccaucaccacgcugugggagggcuccccggggaaguucuggaacaccaccaucgccgucagcauggccaacaucuuccgcggcuccuaccuggccggggcgggccucgccuucagcaucaugaaguccguggggaccggccggcgcggcacggggagccagggcgagacccugggggagaaguggaagaagaagcugaaccagcucagccggaaggaguucgaccuguacaagaaguccggcaucaccgagguggaccgcaccgaggccaaggaggggcugaagcggggcgagaccacgcaccacgccgucagccgcggcuccgccaagcuccagugguucguggagcggaacauggugacccccgaggggcgcgucaucgaccugggcugcgggcgcggcggguggagcuacuacugcgcgggccugaagaaggugaccgaggugcggggcuacaccaagggcggccccgggcacgaggagcccgucccgauguccacguacggcuggaacaucgugaagcucaugagcgggaaggacguguucuaccugccgcccgagaagugcgacacccugcugugcgacaucggcgaguccagccccuccccgaccgucgaggagagccgcaccauccgggugcucaagaugguggagcccuggcugaagaacaaccaguucugcaucaagguccugaaccccuacaugcccacggugaucgagcaccucgagcgccugcagcggaaguacggcgggaugcuggugcgcaacccgcucucccggaacagcacccacgagauguacuggaucuccaacggcaccgggaacaucgucagcuccgugaacauggugagccgccugcugcucaaccgguucaccaugacgcaccgccggcccaccaucgagaaggacgucgaccugggcgccggcacccgccacgugaacgccgagcccgagaccccgaacauggacgucaucggggagcggaucaagcgcaucaaggaggagcacuccagcacguggcacuacgacgacgagaaccccuacaagaccugggccuaccacggcuccuacgaggugaaggccaccgggagcgcgagcuccaugaucaacggcguggucaagcugcucaccaagcccugggacguggugcccauggucacgcagauggccaugaccgacaccaccccguucgggcagcagcggguguucaaggagaagguggacacgcgcacgccccggcccaugcccggcacccgcaaggucauggagaucaccgccgaguggcuguggcggacgcugggccgcaacaagaagccgcgccucugcacccgggaggaguucaccaagaaggugcgcaccaacgccgccaugggggcgguguucacggaggagaaccagugggacagcgcccgggccgccgucgaggacgaggaguucuggaagcugguggaccgcgagcgggagcugcacaagcucggcaagugcggguccugcguguacaacaugaugggcaagcgcgagaagaagcugggggaguucggcaaggcgaagggcagccgggccaucugguacauguggcugggggcccgcuaccucgaguucgaggcccugggcuuccugaacgaggaccacugguucucccgggagaacagcuacuccggggucgagggcgaggggcuccacaagcugggcuacauccugcgcgacaucagcaagauccccggcggggccauguacgcggacgacaccgccggcugggacacccggaucaccgaggacgaccuccacaacgaggagaagaucacgcagcagauggaccccgagcaccgccagcuggccaacgccaucuucaagcugaccuaccagaacaagguggugaagguccagcggcccaccccgaaggggaccgugauggacaucaucucccgcaaggaccagcggggcagcggccagguggggaccuacggccucaacacguucaccaacauggaggcccagcugguccgccagauggagggggagggcgugcuguccaaggcggaccucgagaacccccaccuccuggagaagaagaucacccaguggcucgagaccaaggggguggagcggcugaagcgcauggccaucagcggcgacgacugcgucgugaagcccaucgacgaccgguucgccaacgcccugcucgcccugaacgacaugggcaaggugcgcaaggacaucccccaguggcagccguccaagggguggcacgacuggcagcagguccccuucugcagccaccacuuccacgagcugaucaugaaggacggccggaagcucguggugcccugccgcccccaggacgagcugaucgggcgcgcgcggaucucccagggcgccggguggagccugaaggagacggccugccucggcaaggccuacgcccagauguggucccugauguacuuccaccgccgggaccugcgccucgcgagcaacgccaucugcuccgccgucccggugcacuggauccccaccagccggaccaccuggagcauccacgcccaccaccaguggaugacgaccgaggacaugcugaccguguggaaccgcgucuggaucgaggacaaccccuggauggaggacaagacccccgugacgaccugggaggacaucccguaccugggcaagcgggaggaccaguggugcgggucccucaucggccugaccagccgcgcgaccugggcccagaacauccugacggccauccagcagguccggucccucaucggggacgaggaguuccuggacuacaugcccagcaugaagcgcuuccggaaggaggaggaguccgagggcgccaucugguga

SEQ ID NO: 10334 - RNA, 9873 nt, Artificial Sequence
  derived and/or modified CDS sequence (opt1) from DENV-3__JQ045691__SS-prME
accagccugugccucaugaugaugcugcccgcgacccuggccuuccaccucaccagccgggacggcgagccgcggaugaucguggggaagaacgagcggggcaagagccugcuguucaagaccgcguccgggaucaacaugugcacccucaucgccauggaccugggcgagaugugcgacgacaccgugacguacaagugcccccugaucgccgagguggagcccgaggacaucgacugcuggugcaaccucaccagcaccugggugaccuacgggacgugcaaccaggccggcgagcaccggcgcgacaagcgguccguggcccuggcgccccacaucggcauggggcuggacacccgcacccagaccuggaugagcgccgagggcgccuggcggcaggucgagaagguggagacgugggcccuccgccacccgggguucaccauccuggcgcuguuccucgcccacuacaucggcaccucccugacccagaaggucgugaucuucauccugcucaugcuggugacgcccagcaugaccaugcggugcgucggggugggcaaccgcgacuucguggagggccuguccggggccaccugggucgacguggugcucgagcacggcgggugcgucaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgugugcaagcacaccuacguggaccggggguggggcaacgggugcggccuguucgggaagggcucccuggugaccugcgccaaguuccagugccucgagcccaucgagggcaagguggugcaguacgagaaccugaaguacaccgucaucaucacggugcacaccggggaccagcaccaggugggcaacgacacccagggggucaccguggagaucacgccccaggccagcaccgucgaggccauccugcccgaguacggcacccucgggcuggagugcuccccgcgcaccggccuggacuucaacgagaugauccuccugaccaugaagaacaaggcguggauggugcaccggcagugguucuucgaccugccccuccccuggacgagcggcgccaccaccgagacccccacguggaaccgcaaggagcugcuggugaccuucaagaacgcccacgccaagaagcaggaggucguggugcucgggucccaggagggcgccaugcacaccgcgcugaccggggccacggagauccagaucagcggcgggaccuccaucuucgccggccaccugaagugccggcucaagauggacaagcuggagcugaagggcaugagcuacgccaugugccucaacaccuucguccugaagaaggagguguccgagacccagcacgggacgauccugaucaagguggaguacaagggcgaggacgccccgugcaagauccccuucagcaccgaggacgggcagggcaaggcgcacaacggccgccugaucaccgccaaccccgucgugaccaagaaggaggagcccgugaacaucgaggccgagccgcccuucggggagagcaacaucgucaucggcaucggggacaaggcccucaagaucaacugguacaagaagggcuccagcaucgggaagauguucgaggcgacggcccggggcgcccgccggauggccauccugggcgacaccgccugggacuucggguccgugggcggggugcugaacagccucggcaagaugguccaccagaucuucggguccgcguacaccgcccuguucagcggcguguccuggaucaugaagaucggcaucggggugcugcucaccuggaucggccugaacagcaagaacacguccaugagcuucuccugcaucgucaucgggaucaucacccuguaccucggcgccguggugcaggccgacauggggugcgccaucaacuggaagggcaaggagcugaagugcggcagcgggaucuucgucaccaacgaggugcacaccuggacggagcaguacaaguuccaggcggacucccccaagcgccuggccaccgccaucgccggcgccugggagaacggggugugcggcauccgcagcaccacccggauggagaaccuccuguggaagcagaucgcgaacgagcugaacuacauccucugggagaacaacaucaagcugacggucguggugggggacaucaucggcguccuggagcagggcaagcgcacccucacgccccagccgauggagcugaaguacuccuggaagaccugggggaaggccaagaucgugacggccgagacccagaacagcuccuucaucaucgacggccccaacacccccgagugccccagcgccucccgggcguggaacgugugggaggucgaggacuacggguucggcguguucaccacgaacaucuggcugaagcuccgcgagguguacacccagagcugcgaccaccggcugaugagcgccgccaucaaggacgagcgcgccguccacgccgacaugggcuacuggaucgagucccagaagaacgggagcuggaagcuggagaaggcguccuucaucgaggugaagaccugcaccuggcccaagagccacacccucugguccaacggcgugcuggagagcgacaugaucauccccaagucccuggccgggcccaucagccagcacaaccaccggccgggcuaccacacgcagaccgccgggcccuggcaccucggcaagcuggagcuggacuucaacuacugcgagggcaccaccgucgugaucacggagaacugcgggacccgcggccccucccuccggaccaccacggugagcgggaagcugauccacgaguggugcugccgcuccugcacccugcccccgcuccgguacaugggcgaggacgggugcugguacggcauggagauccgccccaucaacgagaaggaggagaacauggucaagagccugguguccgccggcagcgggaagguggacaacuucaccaugggcguccugugccucgccauccuguucgaggaggugaugcgggggaaguucggcaagaagcacaugaucgcgggggugcuguucaccuucguccuccugcuguccggccagaucacguggcgcgacauggcccacacccucaucaugaucggcagcaacgccuccgaccggauggggaugggcgugaccuaccuggcccugaucgccaccuucaagauccagcccuuccucgcgcugggguucuuccugcgcaagcucacgagccgggagaaccugcugcucggcgugggccuggccauggccaccacccugcagcuccccgaggacaucgagcagauggccaacgggaucgcgcugggccugaugacccucaagcugaucacgcaguucgagaccuaccagcuguggaccgcccucgucagccugaccugcuccaacacgaucuucacccugaccguggccuggcgcaccgccacgcucauccuggccggggugagccugcucccgcugugccaguccagcuccaugcggaagaccgacuggcugcccaugaccgucgcggccaugggcgugccgccccucccgcuguucaucuucagccugaaggacacccccaagaagcgcuccuggccccucaacgagggggucauggccgugggccuggugagcauccuggccuccagccuccugcgcaacgacguccccauggccggcccgcugguggccggcgggcuccugaucgccugcuacgugaucacggggaccuccgccgaccugaccgucgagaaggccgccgacgugaccugggaggaggaggcggagcagacgggggugagccacaaccucaugaucaccgucgacgacgacgggaccaugcggaucaaggacgacgagaccgagaacauccugaccgugcugcucaagacggcccugcugaucguguccggcaucuuccccuacagcauccccgccacccuccuggucuggcacaccuggcagaagcagacccagcgcuccggcgugcugugggacgugcccagcccgcccgagacgcagaaggccgagcucgaggagggggucuaccggaucaagcagcagggcaucuucgggaagacccaggugggcguggggguccagaaggagggcguguuccacaccauguggcacgugacccgcggcgccguccugacgcacaacgggaagcggcuggagcccaacugggcguccgugaagaaggaccucaucagcuacggcgggggcuggcgccuguccgcccaguggcagaagggggaggaggugcaggucaucgccguggagcccggcaagaacccgaagaacuuccagaccaugcccggcaucuuccagaccaccacgggggagaucggcgccaucgcgcuggacuucaagcccgggaccagcggcagcccgaucaucaaccgggagggcaagguggucgggcuguacggcaacgggguggugaccaagaacggcggguacgucuccggcaucgcccagaccaacgccgagcccgacggccccacgcccgagcucgaggaggagauguucaagaagcgcaaccugaccaucauggaccugcacccggggagcggcaagacccggaaguaccuccccgccaucgugcgcgaggccaucaagcggcgccugcggacccugauccucgcgcccacgcgcguggucgccgccgagauggaggaggcccugaaggggcugcccauccgguaccagaccaccgccaccaaguccgagcacacgggccgcgagaucguggaccucaugugccacgcgaccuucaccaugcggcugcugagcccggugcgcguccccaacuacaaccucaucaucauggacgaggcccacuucaccgaccccgccuccaucgccgcccggggguacaucagcacgcgcgugggcaugggcgaggcggccgccaucuucaugaccgccacgccgcccgggaccgcggaggccuucccccaguccaacgcccccauccaggacgaggagcgggacauccccgagcgcagcuggaacuccggcaacgaguggaucacggacuucguggggaagaccgucugguucgugcccagcaucaaggccggcaacgacaucgccaacugccugcgcaagaacgggaagaaggugauccagcugucccggaagaccuucgacaccgaguaccagaagacgcgccucaacgacugggacuucgucgugaccaccgacaucagcgagaugggcgcgaacuucaaggccgaccgggugaucgacccccgccggugccugaagcccgucauccugaccgacggccccgagcgcgugauccucgccgggccgaugcccgugacggccgccuccgcggcccagcggcgcggccgggucgggcgcaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgggagaaguccgcggccaucgacggcgaguaccgccugaagggcgagucccggaagaccuucguggagcucaugcgccgcggggaccugcccguguggcuggcccacaaggucgccagcgagggcaucaaguacacggaccgcaaguggugcuucgacggggagcggaacaaccagauccucgaggagaacauggacguggagaucuggaccaaggagggcgagcgcaagaagcugcggccgcgcuggcuggacgcgcgcaccuacuccgacccccucgcccugaaggaguucaaggacuucgccgccggccgcaagagcaucgcccuggaccucgucaccgagaucgggcgcgugcccucccaccuggcgcaccggacgcgcaacgcccuggacaaccucgugaugcugcacaccagcgagcacggcgggcgggccuaccgccacgccgucgaggagcugccggagaccauggagacccuccugcugcucggccugaugauccugcucaccggcggggccaugcuguuccugcucagcgggaaggggaucggcaagaccuccaucgggcugaucugcgugaucgugagcuccggcaugcuguggauggcggacgucccccuccaguggaucgccagcgccaucgugcuggaguucuucaugauggugcugcucauccccgagcccgagaagcagcggaccccgcaggacaaccagcuggccuacgucgugaucgggauccugacccucgccgcgaucguggccgccaacgagaugggccugcuggagacgaccaagcgcgaccucggcauguccaaggagcccggggucgugagccccaccuccuaccuggacguggaccugcaccccgccagcgccuggacccucuacgcggucgccacgaccgugaucaccccgaugcugcggcacaccaucgagaacuccacggccaacgugagccuggccgcgaucgccaaccaggccgucgugcucaugggccuggacaagggguggcccaucuccaagauggaccugggcgugccccuccuggcccuggggugcuacagccaggucaacccccucacccugaccgccgcggugcugcuccuggugacccacuacgccaucaucggcccgggccugcaggccaaggccacgcgcgaggcccagaagcggaccgcggccgggaucaugaagaaccccaccgucgacggcaucaugaccaucgaccucgaccccgugaucuacgacuccaaguucgagaagcagcugggccaggugaugcugcucguccugugcgccgugcagcugcuccugaugcgcacgagcugggcccugugcgaggcccucacccuggcgaccggccccaucaccacgcugugggagggcuccccggggaaguucuggaacaccaccaucgccgugagcauggccaacaucuuccggggcuccuaccucgccggggcgggccuggccuucagcaucaugaaguccgucgggaccggccgccggggcacggggagccagggcgagacccugggggagaaguggaagaagaagcucaaccagcugagccgcaaggaguucgaccuguacaagaaguccggcaucaccgagguggaccggaccgaggccaaggaggggcucaagcgcggcgagaccacgcaccacgccgugagccggggcuccgccaagcugcagugguucgucgagcgcaacauggugauccccgaggggcgggugaucgaccugggcugcgggcgcggcggguggagcuacuacugcgcgggccucaagaaggucaccgaggugcgcggcuacaccaagggcggccccgggcacgaggagcccgugccgauguccaccuacggcuggaaccuggucaagcugaugagcgggaaggacguguucuaccugccgcccgagaagugcgacacgcuccugugcgacaucggcgaguccagccccuccagcaccguggaggagucccggaccauccgcguccugaagaugguggagccguggcucaagaacaaccaguucugcaucaaggugcugaaccccuacaugcccaccgucaucgagcaccuggagcggcuccagcgcaaguacggcgggaugcuggugcggaacccccugagccgcaacuccacgcacgagauguacuggaucagcaacggcaccgggaacaucguguccagcgucaacauggugucccggcuccugcugaaccgcuucaccaugacccaccggcgcccgacgaucgagaaggacguggaccucggcgccggcacccggcacgucaacgccgagcccgagacccccaacauggacgugaucggggagcgcaucaagcggaucaaggaggagcacagcuccaccuggcacuacgacgacgagaacccguacaagacgugggccuaccacggcagcuacgaggucaaggccaccgggagcgcguccagcaugaucaacggcguggugaagcugcugaccaagcccugggacgucgugcccauggugacccagauggccaugacggacaccacccccuucgggcagcagcgcgucuucaaggagaagguggacacccggacgccgcgcgccaugcccggcacccggaaggugauggagaucaccgccgaguggcucuggcgcacccugggccggaacaagaagccccgccugugcacgcgcgaggaguucaccaagaagguccggaccaacgccgcgaugggggccguguucaccgaggagaaccagugggacuccgcccgcgccgcgguggaggacgaggaguucuggaagcucgucgaccgggagcgcgagcugcacaagcugggcaagugcgggagcugcguguacaacaugaugggcaagcgggagaagaagcucggggaguucggcaaggccaagggcucccgcgccaucugguacauguggcugggggcccgguaccuggaguucgaggcccucggcuuccugaacgaggaccacugguucagccgcgagaacuccuacagcgggguggagggcgaggggcugcacaagcucggcuacauccugcgggacaucuccaagauccccggcggggcgauguacgccgacgacacggccggcugggacacccgcaucaccgaggacgaccugcacaacgaggagaagaucacccagcagauggacccggagcaccggcagcucgccaacgccaucuucaagcugacguaccagaacaaggucgugaaggugcagcgccccacccccaaggggaccgucauggacaucaucagccggaaggaccagcgcggcuccggccagguggggaccuacggccugaacaccuucacgaacauggaggcgcagcucgugcggcagauggagggggagggcguccugagcaaggccgaccuggagaacucccaccuccuggagaagaagaucacccaguggcuggagaccaaggggguggagcgccucaagcggauggccaucagcggcgacgacugcguggucaagcccaucgacgaccgcuucgccaacgcccugcuggcgcucaacgacaugggcaaggugcggaaggacaucccgcaguggcagcccuccaagggguggcacgacuggcagcagguccccuucugcagccaccacuuccacgagcugaucaugaaggacggccgcaagcuggucgugcccugccggccgcaggacgagcucaucgggcgcgcccgcaucucccagggcgccggguggagccugaaggagaccgccugccugggcaaggccuacgcgcagauguggucccucauguacuuccaccggcgcgaccugcggcuggccagcaacgccaucugcagcgccgugcccguccacuggauccccacgucccgcaccaccuggagcauccacgcgcaccaccaguggaugaccacggaggacaugcucaccguguggaaccggguguggaucgaggacaaccccuggauggaggacaagaccccggucaccacgugggaggacgugcccuaccugggcaagcgcgaggaccaguggugcgggucccugaucggccucaccagccgggccaccugggcccagaacauccugaccgccauccagcagguccgcucccugaucggggacgaggaguuccucgacuacaugcccagcaugaagcgguuccgcaaggaggaggaguccgagggcgccaucugguga

SEQ ID NO: 10335 - RNA, 9873 nt, Artificial Sequence
  derived and/or modified CDS sequence (opt1) from DENV-3__JQ045692__SS-prME
accagccugugccucaugaugaugcugcccgcgacccuggccuuccaccucaccagccgcgacggcgagccgcggaugaucguggggaagaacgagcgcggcaagagccugcuguucaagaccgcguccgggaucaacaugugcacccucaucgccauggaccugggcgagaugugcgacgacaccgugacguacaagugcccccugaucgccgagguggagcccgaggacaucgacugcuggugcaaccucaccagcaccugggugaccuacgggacgugcaaccaggccggcgagcaccggcgcgacaagcgguccgucgcccuggcgccccacgugggcauggggcuggacacccgcacccagaccuggaugagcgccgagggcgccuggcggcaggucgagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgugugcaagcacaccuacgucgaccggggguggggcaacgggugcggccuguucgggaagggcucccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccagcaccguggaggccauccugcccgaguacggcacccucgggcuggagugcuccccgcgcaccggccuggacuucaacgagaugauccuccugaccaugaagaacaaggcguggauggugcaccggcagugguucuucgaccugccccuccccuggacgagcggcgccaccaccgagacccccacguggaaccgcaaggagcugcuggucaccuucaagaacgcccacgccaagaagcaggagguggugguccucgggucccaggagggcgccaugcacaccgcgcugaccggggccacggagauccagaucagcggcgggaccuccaucuucgccggccaccugaagugccggcucaagauggacaagcuggagcugaagggcaugagcuacgccaugugccucaacaccuucgugcugaagaaggagguguccgagacccagcacgggacgauccugaucaaggucgaguacaagggcgaggacgccccgugcaagauccccuucagcaccgaggacgggcagggcaaggcgcacaacggccgccugaucaccgccaaccccguggugaccaagaaggaggagcccgucaacaucgaggccgagccgcccuucggggagagcaacaucgugaucggcaucggggacaaggcccucaagaucaacugguacaagaagggcuccagcaucgggaagauguucgaggcgacggcccggggcgcccgccggauggccauccugggcgacaccgccugggacuucggguccgugggcgggguccugaacagccucggcaagauggugcaccagaucuucggguccgcguacaccgcccuguucagcggcguguccuggaucaugaagaucggcaucgggguccugcucaccuggaucggccugaacagcaagaacacguccaugagcuucuccugcaucgugaucgggaucaucacccuguaccucggcgccgugguccaggccgacauggggugcgccaucaacuggaagggcaaggagcugaagugcggcagcgggaucuucgugaccaacgaggugcacaccuggacggagcaguacaaguuccaggcggacucccccaagcgccuggccaccgccaucgccggcgccugggagaacggggucugcggcauccgcagcaccacccggauggagaaccuccuguggaagcagaucgcgaacgagcugaacuacauccucugggagaacaacaucaagcugacggugguggucggggacaucaucggcgugcuggagcagggcaagcgcacccucacgccccagccgauggagcugaaguacuccuggaagaccugggggaaggccaagaucgugacggccgagacccagaacagcuccuucaucaucgacggccccaacacccccgagugccccagcgccucccgggcguggaacgucugggagguggaggacuacggguucggcguguucaccacgaacaucuggcugaagcuccgcgaggucuacacccagagcugcgaccaccggcugaugagcgccgccaucaaggacgagcgcgccgugcacgccgacaugggcuacuggaucgagucccagaagaacgggagcuggaagcuggagaaggcguccuucaucgaggugaagaccugcaccuggcccaagagccacacccucugguccaacggcguccuggagagcgacaugaucauccccaagucccuggccgggcccaucagccagcacaaccaccggccgggcuaccacacgcagaccgccgggcccuggcaccucggcaagcuggagcuggacuucaacuacugcgagggcaccaccguggugaucacggagaacugcgggacccgcggccccucccuccggaccaccacggucagcgggaagcugauccacgaguggugcugccgcuccugcacccugcccccgcuccgguacaugggcgaggacgggugcugguacggcauggagauccgccccaucaacgagaaggaggagaacauggucaagagccugguguccgccggcagcgggaaggucgacaacuucaccaugggcgugcugugccucgccauccuguucgaggaggugaugcgggggaaguucggcaagaagcacaugaucgcggggguccuguucaccuucgugcuccugcuguccggccagaucacguggcgcgacauggcccacacccucaucaugaucggcagcaacgccuccgaccggauggggaugggcgugaccuaccuggcccugaucgccaccuucaagauccagcccuuccucgcgcugggguucuuccugcgcaagcucacgagccgggagaaccugcugcucggcgucggccuggccauggccaccacccugcagcuccccgaggacaucgagcagauggccaacgggaucgcgcugggccugaugacccucaagcugaucacgcaguucgagaccuaccagcuguggaccgcccucgugagccugaccugcuccaacacgaucuucacccugaccguggccuggcgcaccgccacgcucauccuggccggggucagccugcucccgcugugccaguccagcuccaugcggaagaccgacuggcugcccaugaccguggcggccaugggcgugccgccccucccgcuguucaucuucagccugaaggacacccccaagcgccgcuccuggccccucaacgagggggugauggccgugggccuggucagcauccuggccuccagccuccugcggaacgacgugcccauggccggcccgcugguggccggcgggcuccugaucgccugcuacgucaucacggggaccuccgccgaccugaccguggagaaggccgccgacgugaccugggaggaggaggcggagcagacgggggucagccacaaccucaugaucaccguggacgacgacgggaccaugcgcaucaaggacgacgagaccgagaacauccugaccgugcugcucaagacggcccugcugaucgucuccggcaucuuccccuacagcauccccgccacccuccugguguggcacaccuggcagaagcagacccagcgguccggcgugcugugggacguccccagcccgcccgaggcccagaaggccgagcucgaggaggggguguaccgcaucaagcagcagggcaucuucgggaagacccaggugggcgucggggugcagaaggagggcguguuccacaccauguggcacgucacccggggcgcggugcugacccacaacgggaagcgccuggagcccaacugggccuccgugaagaaggaccucaucagcuacggcgggggcuggcggcuguccgcccaguggcagaagggggaggagguccaggugaucgccguggagcccggcaagaacccgaagaacuuccagacgaugcccggcaucuuccagaccaccaccggggagaucggcgcgaucgcccuggacuucaagcccgggacgagcggcagcccgaucaucaaccgcgagggcaaggucguggggcuguacggcaacgggguggucaccaagaacggcggguacguguccggcaucgcccagaccaacgccgagcccgacggccccacccccgagcucgaggaggagauguucaagaagcggaaccugacgaucauggaccugcacccggggagcggcaagacccgcaaguaccuccccgccaucgugcgggaggcgaucaagcgccggcugcgcacccugauccucgcccccacccgggucguggccgccgagauggaggaggcccugaaggggcugcccauccgcuaccagacgaccgcgaccaaguccgagcacaccggccgggagaucguggaccucaugugccacgccacguucaccaugcgccugcugagcccgguccgggugcccaacuacaaccucaucaucauggacgaggcccacuucaccgaccccgccuccaucgccgcgcgcggguacaucagcacccgggugggcaugggcgaggccgccgccaucuucaugacggcgacgccgcccgggaccgccgaggccuucccccaguccaacgcccccauccaggacgaggagcgcgacauccccgagcgcagcuggaacuccggcaacgaguggaucaccgacuucgucgggaagacggugugguucgugcccagcaucaaggccggcaacgacaucgcgaacugccugcggaagaacgggaagaaggucauccagcugucccgcaagaccuucgacaccgaguaccagaagacccggcucaacgacugggacuucguggugacgaccgacaucagcgagaugggcgccaacuucaaggccgaccgcgucaucgacccccggcgcugccugaagcccgugauccugaccgacggccccgagcgggugauccucgccgggccgaugcccgucaccgccgcguccgccgcccagcgccggggccgcguggggcggaacccccagaaggagaacgaccaguacaucuucacgggccagccccugaacaacgacgaggaccacgcccacuggaccgaggccaagaugcugcucgacaacaucaacaccccggaggggaucauccccgcgcuguucgagcccgagcgcgagaaguccgccgccaucgacggcgaguaccggcugaagggcgagucccgcaagaccuucguggagcucaugcggcgcggggaccugcccgucuggcuggcccacaagguggcgagcgagggcaucaaguacaccgaccggaaguggugcuucgacggggagcgcaacaaccagauccucgaggagaacauggacgucgagaucuggacgaaggagggcgagcggaagaagcugcgcccgcgcuggcuggacgcccggaccuacuccgacccccucgcccugaaggaguucaaggacuucgccgccggccgcaagagcaucgcgcuggaccucgugaccgagaucgggcgggugcccucccaccuggcccaccgcacccggaacgcccuggacaaccucgucaugcugcacacgagcgagcacggcgggcgcgccuaccggcacgccguggaggagcugccggagaccauggagaccuuccuccugcugggccucaugauccugcugaccgggggcgcgaugcuguuccugcugagcggcaaggggaucggcaagacguccaucgggcucaucugcgugaucgucagcuccggcaugcuguggauggccgacgugccccugcaguggaucgccagcgccaucgugcucgaguucuucaugaugguccugcugauccccgagcccgagaagcagcgcaccccgcaggacaaccagcucgccuacguggugaucgggauccugacccuggcggccaucgucgccgccaacgagaugggccuccuggagaccacgaagcgggaccugggcauguccaaggagcccgggguggugagccccaccuccuaccucgacgucgaccugcaccccgccagcgcguggacccuguacgccguggccaccacggugaucaccccgaugcuccgccacaccaucgagaacuccaccgccaacgucagccuggcggccaucgccaaccaggccguggugcugaugggccucgacaagggguggcccaucuccaagauggaccugggcgucccccugcucgcccuggggugcuacagccaggugaacccccugacgcucaccgcggccgugcugcugcucgucacccacuacgccaucaucggcccgggccugcaggccaaggccacccgggaggcgcagaagcgcacggccgccgggaucaugaagaaccccaccguggacggcaucaugaccaucgaccuggaccccgugaucuacgacuccaaguucgagaagcagcucgggcaggucaugcugcuggugcucugcgccgugcagcugcugcucaugcggaccagcugggcccugugcgaggcgcugacgcucgccaccggccccaucaccacccugugggagggcuccccggggaaguucuggaacacgaccaucgccgucagcauggccaacaucuuccgcggcuccuaccuggcgggggccggccucgccuucagcaucaugaaguccguggggaccggccggcgcggcaccgggagccagggcgagacgcugggggagaaguggaagaagaagcugaaccagcucagccggaaggaguucgaccuguacaagaaguccggcaucaccgagguggaccgcaccgaggccaaggaggggcugaagcggggcgagaccacccaccacgccgucagccgcggcuccgcgaagcuccagugguucguggagcggaacauggugauccccgaggggcgcgucaucgaccugggcugcgggcgcggcggguggagcuacuacugcgccggccugaagaaggugacggaggugcggggcuacaccaagggcggccccgggcacgaggagcccgucccgauguccaccuacggcuggaaccucgugaagcugaugagcgggaaggacguguucuaccugccgcccgagaagugcgacacccugcucugcgacaucggcgaguccagccccuccagcacggucgaggagucccgcaccauccgggugcugaagaugguggagccguggcugaagaacaaccaguucugcaucaagguccucaaccccuacaugcccaccgugaucgagcaccuggagcgccugcagcggaaguacggcgggaugcucgugcgcaacccccugagccggaacuccacccacgagauguacuggaucagcaacggcacggggaacaucgucuccagcgugaacauggugucccgccugcuccugaaccgguucaccaugacccaccgccggccgaccaucgagaaggacgucgaccugggcgccggcacgcgccacgugaacgccgagcccgagacccccaacauggacgucaucggggagcggaucaagcgcaucaaggaggagcacagcuccaccuggcacuacgacgacgagaacccguacaagaccugggccuaccacggcagcuacgaggugaaggcgacggggagcgccuccagcaugaucaacggcguggucaagcuccugaccaagcccugggacguggugcccauggucacccagauggccaugaccgacacgacccccuucgggcagcagcggguguucaaggagaagguggacacccgcaccccgcgggccaugcccggcacgcgcaaggucauggagaucaccgccgaguggcuguggcggacccucggccgcaacaagaagccccgccugugcacccgggaggaguucacgaagaaggugcgcaccaacgcggccaugggggccguguucaccgaggagaaccagugggacuccgcccgggcggccgucgaggacgaggaguucuggaagcugguggaccgcgagcgggagcuccacaagcugggcaagugcgggagcugcguguacaacaugaugggcaagcgcgagaagaagcugggggaguucggcaaggccaagggcucccgggccaucugguacauguggcucggggcccgcuaccuggaguucgaggcgcugggcuuccucaacgaggaccacugguucagccgggagaacuccuacagcggggucgagggcgaggggcugcacaagcugggcuacauccuccgcgacaucuccaagauccccggcggggccauguacgccgacgacaccgccggcugggacacgcggaucaccgaggacgaccugcacaacgaggagaagaucacccagcagauggacccggagcaccgccagcuggccaacgcgaucuucaagcucaccuaccagaacaagguggugaagguccagcggcccacgcccaaggggaccgugauggacaucaucagccgcaaggaccagcggggcuccggccagguggggaccuacggccugaacaccuucaccaacauggaggcccagcugguccgccagauggagggggagggcgugcucagcaaggccgaccuggagaacccccaccuccucgagaagaagaucacgcaguggcuggagaccaaggggguggagcggcugaagcgcauggccaucuccggcgacgacugcgucgugaagccgaucgacgaccgguucgccaacgcgcuccuggcccugaacgacaugggcaaggugcgcaaggacaucccccaguggcagcccagcaagggguggcacgacuggcagcagguccccuucugcucccaccacuuccacgagcucaucaugaaggacggccggaagcugguggugccgugccgcccccaggacgagcugaucgggcgcgcccggaucagccagggcgccggguggucccucaaggagaccgccugccugggcaaggcguacgcccagauguggagccugauguacuuccaccgccgggaccuccgccuggccuccaacgccaucugcagcgcgguccccgugcacuggauccccaccagccggacgaccugguccauccacgcccaccaccaguggaugaccaccgaggacaugcugacgguguggaaccgcgucuggaucgaggacaacccguggauggaggacaagacccccgugaccaccugggaggacgugcccuaccucggcaagcgggaggaccaguggugcgggagccugaucggccugacgucccgcgccaccugggcccagaacauccucaccgccauccagcagguccggagccugaucggggacgaggaguuccuggacuacaugcccuccaugaagcgcuuccggaaggaggaggagagcgagggcgcgaucugguga

SEQ ID NO: 10336 - RNA, 9873 nt, Artificial Sequence
  derived and/or modified CDS sequence (opt1) from DENV-3__JQ045694__SS-prME
accagccugugccucaugaugaugcugcccgcgacccuggccuuccaccucaccagccgggacggcgagccgcggaugaucguggggaagaacgagcgcggcaagagccugcuguucaagaccgcgagcgggaucaacaugugcacccucaucgccauggaccugggcgagaugugcgacgacaccgugacguacaagugcccccugaucgccgagguggagcccgaggacaucgacugcuggugcaaccucaccagcaccugggugaccuacgggacgugcaaccaggccggcgagcaccggcgcgacaagcgguccguggcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgugugcaagcacaccuacgucgaccggggguggggcaacgggugcggccuguucgggaagggcucccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccagcaccguggaggccgugcugcccgaguacggcacccucgggcuggagugcuccccgcgcaccggccuggacuucaacgagaugauccuccugaccaugaagaacaaggcguggaugguccaccggcagugguucuucgaccugccccuccccuggacgagcggcgccaccaccgagacccccacguggaaccgcaaggagcugcuggugaccuucaagaacgcccacgccaagaagcaggagguggucgugcucgggucccaggagggcgccaugcacaccgcgcugaccggggccacggagauccagaacagcggcgggaccuccaucuucgccggccaccugaagugccggcucaagauggacaagcuggagcugaagggcaugagcuacgccaugugccucaacaccuucgugcugaagaaggaggucuccgagacccagcacgggacgauccugaucaagguggaguacaagggcgaggacgccccgugcaagauccccuucagcaccgaggacgggcagggcaaggcgcacaacggccgccugaucaccgccaaccccguggucaccaagaaggaggagcccgugaacaucgaggccgagccgcccuucggggagagcaacaucgugaucggcaucggggacaaggcccucaagaucaacugguacaagaagggcuccagcaucgggaagauguucgaggcgacggcccggggcgcccgccggauggccauccugggcgacaccgccugggacuucggguccgucggcggggugcugaacagccucggcaagauggugcaccagaucuucggguccgcguacaccgcccuguucagcggcgucuccuggaucaugaagaucggcaucggggugcugcucaccuggaucggccugaacagcaagaacacguccaugagcuucuccugcaucgugaucgggaucaucacccuguaccucggcgccgucgugcaggccgacauggggugcgccaucaacuggaagggcaaggagcugaagugcggcagcgggaucuucgugaccaacgagguccacaccuggacggagcaguacaaguuccaggcggacucccccaagcgccuggccaccgccaucgccggcgccugggagaacggggugugcggcauccgcagcaccacccggauggagaaccuccuguggaagcagaucgcgaacgagcugaacuacauccucugggagaacaacaucaagcugacgguggucgugggggacaucaucggcgugcuggagcagggcaagcgcacccucacgccccagccgauggagcugaaguacuccuggaagaccugggggaaggccaagaucgucacggccgagacccagaacagcuccuucaucaucgacggccccaacacccccgagugccccagcgccucccgggcguggaacgugugggagguggaggacuacggguucggcgucuucaccacgaacaucuggcugaagcuccgcgagguguacacccagagcugcgaccaccggcugaugagcgccgccaucaaggacgagcgcgccgugcacgccgacaugggcuacuggaucgagucccagaagaacgggagcuggaagcuggagaaggcguccuucaucgaggucaagaccugcaccuggcccaagagccacacccucugguccaacggcgugcuggagagcgacaugaucauccccaagucccuggccgggcccaucagccagcacaaccaccggccgggcuaccacacgcagaccgccgggcccuggcaccucggcaagcuggagcuggacuucaacuacugcgagggcaccaccguggucaucacggagaacugcgggacccgcggccccucccuccggaccaccacggugagcgggaagcugauccacgaguggugcugccgcuccugcacccugcccccgcuccgguacaugggcgaggacgggugcugguacggcauggagauccgccccaucaacgagaaggaggagaacauggucaagagccuggucuccgccggcagcgggaagguggacaacuucaccaugggcgugcugugccucgccauccuguucgaggaggucaugcgggggaaguucggcaagaagcacaugaucgcgggggugcuguucaccuucgugcuccugcuguccggccagaucacguggcgcgacauggcccacacccucaucaugaucggcagcaacgccuccgaccggauggggaugggcgucaccuaccuggcccugaucgccaccuucaagauccagcccuuccucgcgcugggguucuuccugcgcaagcucacgagccgggagaaccugcugcucggcgugggccuggccauggccaccacccugcagcuccccgaggacaucgagcagauggccaacgggaucgcgcugggccugaugacccucaagcugaucacgcaguucgagaccuaccagcuguggaccgcccucgugagccugaccugcuccaacacgaucuucacccugaccgucgccuggcgcaccgccacgcucauccuggccggggugagccugcucccgcugugccaguccagcuccaugcggaagaccgacuggcugcccaugaccgucgcggccaugggcgugccgccccugccgcuguucaucuucagccugaaggacacccccaagcgccgcuccuggccccucaacgagggggugauggccgucggccuggugagcauccuggccuccagccuccugcggaacgacgugcccauggccggcccgcuggucgccggcgggcuccugaucgccugcuacgugaucacggggaccuccgccgaccugaccguggagaaggccgccgacgucaccugggaggaggaggcggagcagacgggggugagccacaaccucaugaucaccguggacgacgacgggaccaugcgcaucaaggacgacgagaccgagaacauccugaccguccugcucaagacggcccugcugaucguguccggcaucuuccccuacagcauccccgccacccuccugguguggcacaccuggcagaagcagacccagcgguccggcguccugugggacgugcccagcccgcccgagacgcagaaggccgagcucgaggaggggguguaccgcaucaagcagcagggcaucuucgggaagacccaggucggcgugggggugcagaaggagggcgucuuccacaccauguggcacgugacccggggcgccgugcugacgcacaacgggaagcgccuggagcccaacugggcguccgucaagaaggaccucaucagcuacggcgggggcuggcggcuguccgcccaguggcagaagggggaggagguccaggugaucgccgucgagcccggcaagaacccgaagaacuuccagaccaugcccggcaucuuccagaccaccacgggggagaucggcgccaucgcgcuggacuucaagcccgggaccagcggcagcccgaucaucaaccgcgagggcaaggugguggggcuguacggcaacggggucgugaccaagaacggcggguacguguccggcaucgcccagaccaacgccgagcccgacggccccacgcccgagcucgaggaggagauguucaagaagcggaaccugaccaucauggaccugcacccggggagcggcaagacccgcaaguaccuccccgccaucguccgggaggccaucaagcgccggcugcgcacccugauccucgcgcccacgcgggugguggccgccgagauggaggaggcccugaaggggcugcccauccgcuaccagaccaccgccaccaaguccgagcacacgggccgggagaucgucgaccucaugugccacgcgaccuucaccaugcgccugcugagcccgauccgggugcccaacuacaaccucaucaucauggacgaggcccacuucaccgaccccgccuccaucgccgcccgcggguacaucagcacgcgggugggcaugggcgaggcggccgccaucuucaugaccgccacgccgcccgggaccgcggaggccuucccccaguccaacgcccccauccaggacgaggagcgcgacauccccgagcgcagcuggaacuccggcaacgaguggaucacggacuucgucgggaagaccgugugguucgugcccagcaucaaggccggcaacgacaucgccaacugccugcggaagaacgggaagaaggucauccagcugucccgcaagaccuucgacaccgaguaccagaagacgcggcucaacgacugggacuucguggugaccaccgacaucagcgagaugggcgcgaacuucaaggccgaccgcgucaucgacccccggcgcugccugaagcccgugauccugaccgacggccccgagcgggugauccucgccgggccgaugcccgucacggccgccuccgcggcccagcgccggggccgcguggggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgcggccaucgacggcgaguaccggcugaagggcgagucccgcaagaccuucguggagcucaugcggcgcggggaccugcccgucuggcuggcccacaagguggccagcgagggcaucaaguacacggaccggaaguggugcuucgacggggagcgcaacaaccagauccucgaggagaacauggacgucgagaucuggaccaaggagggcgagcggaagaagcugcgcccgcgcuggcuggacgcgcggaccuacuccgacccccucgcccugaaggaguucaaggacuucgccgccggccgcaagagcaucgcccuggaccucgugaccgagaucgggcgggugcccucccaccuggcguaccgcacgcggaacgcccuggacaaccucgucaugcugcacaccagcgagcacggcgggcgcgccuaccggcacgccguggaggagcugccggagaccauggagacccuccugcugcucggccugaugauccugcucaccgggggcgccaugcuguuccugaugagcggcaaggggaucggcaagaccuccaucgggcucaucugcgugaucgucagcuccggcaugcuguggauggcggacgugccccugcaguggaucgccagcgccaucgugcucgaguucuucaugaugguccugcugauccccgagcccgagaagcagcgcaccccgcaggacaaccagcucgccuacguggugaucgggauccugacccuggccgcgaucgucgccgccaacgagaugggccuccuggagacgaccaagcgggaccugggcauguccaaggagcccgggguggugagccccaccuccuaccucgacgucgaccugcaccccgccagcgccuggacccuguacgcgguggccacgaccgugaucaccccgaugcuccgccacaccaucgagaacuccacggccaacgucagccuggccgcgaucgccaaccaggccguggugcugaugggccucgacaagggguggcccaucuccaagauggaccugggcgucccccugcucgcccuggggugcuacagccaggugaacccccugacccucaccgccgcggugcugcugcucgucacccacuacgccaucaucggcccgggccugcaggccaaggccacgcgggaggcccagaagcgcaccgcggccgggaucaugaagaaccccaccguggacggcaucaugaccaucgaccuggaccccgugaucuacgacuccaaguucgagaagcagcucgggcaggucaugcugcuggugcucugcgccgugcagcugcugcucaugcggacgagcugggcccugugcgaggcccugacccucgcgaccggccccaucaccacgcugugggagggcuccccggggaaguucuggaacaccaccaucgccgucagcauggccaacaucuuccgcggcuccuaccuggccggggcgggccucgccuucagcaucaugaaguccguggggaccggccggcgcggcacggggccccagggcgagacccugggggagaaguggaagaagaagcugaaccagcucagccggaaggaguucgaccuguacaagaaguccggcaucaccgagguggaccgcaccgaggccaaggaggggcugaagcggggcgagaccacgcaccacgccgucucccgcggcagcgccaagcuccagugguucguggagcggaacauggugauccccgaggggcgcgucaucgaccugggcugcgggcgcggcgggugguccuacuacugcgcgggccugaagaaggugaccgaggugcggggcuacaccaagggcggccccgggcacgaggagccgguccccaugagcaccuacggcuggaaccucgugaagcugauguccgggcgcgacguguucuaccugccgcccgagaagugcgacacgcugcucugcgacaucggcgagagcuccccgagccccaccgucgaggagucccggaccauccgcgugcugaagaugguggagcccuggcugaagaacaaccaguucugcaucaagguccucaaccccuacaugccgaccgugaucgagcaccuggagcggcugcagcgcaaguacggcgggaugcucgugcggaacccccugagccgcaacuccacgcacgagauguacuggaucagcaacggcaccgggaacaucgucuccagcgugaacauggugucccggcugcuccugaaccgcuucaccaugacccaccggcgccccacgaucgagaaggacgucgaccugggcgccggcacccggcacgugaacgccgagccggagacccccaacauggacgucaucggggagcgcaucaagcggaucaaggaggagcacagcuccaccuggcacuacgacgacgagaaccccuacaagacgugggccuaccacggcagcuacgaggugaaggccaccggguccgcgagcagcaugaucaacggcguggucaagcuccugaccaagcccugggacguggugccgauggucacccagauggccaugacggacaccacccccuucgggcagcagcgcguguucaaggagaagguggacacccggacgccccgccccaugccgggcacccggaaggucauggagaucaccgccgaguggcuguggcgcacccucggccgcaacaagaagccccggcugugcacgcgcgaggaguucaccaagaaggugcggaccaacgccgccaugggggcgguguucaccgaggagaaccagugggacuccgcccgcgccgccgucgaggacgaggaguucuggaagcugguggaccgggagcgcgagcuccacaagcugggcaagugcgggagcugcguguacaacaugaugggcaagcgggagaagaagcugggggaguucggcaaggcgaagggcucccgcgccaucugguacauguggcucggggcccgguaccuggaguucgaggcccugggcuuccucaacgaggaccacugguucagccgcgagaacuccuacagcggggucgagggcgaggggcugcacaagcugggcuacauccuccgggacaucuccaagauccccggcggggccauguacgcggacgacacggccggcugggacacccgcaucaccgaggacgaccugcacaacgaggagaagaucacccagcagauggaccccgagcaccggcagcuggccaacgccaucuucaagcucacguaccagaacaagguggugaagguccagcgcccgacccccaaggggaccgugauggacaucaucagccggaaggaccagcgcggcuccggccagguggggaccuacggccugaacaccuucacgaacauggaggcccagcugguccggcagauggagggggagggcgugcucagcaaggcggaccuggagaacccccaccuccucgagaagaagaucacccaguggcuggagaccgaggggguggagcgccugaagcggauggccaucuccggcgacgacugcgucgugaagcccaucgacgaccgcuucgccaacgcccuccuggcccugaacgacaugggcaaggugcggaaggacaucccgcaguggcagcccagcaagggguggcacgacuggcagcagguccccuucugcucccaccacuuccacgagcucaucaugaaggacggccgcaagcugguggugcccugccgcccgcaggacgagcugaucgggcgggcgcgcaucagccagggcgccggguggucccucaaggagaccgccugccugggcaaggccuacgcccagauguggagccugauguacuuccaccggcgcgaccuccggcuggcguccaacgccaucugcagcgccguccccgugcacuggauccccacgucccgcaccaccuggagcauccacgcccaccaccaguggaugaccacggaggacaugcugaccguguggaaccgggucuggaucgaggacaaccccuggauggaggacaagaccccggugaccacgugggaggacgugcccuaccucggcaagcgcgaggaccaguggugcgggagccugaucggccugaccucccgggcgaccugggcccagaacauccucaccgccauccagcagguccgcagccugaucggggacgaggaguuccuggacuacaugcccuccaugaagcgguuccgcaaggaggaggagagcgagggcgccaucugguga

SEQ ID NO: 10337 - RNA, 9873 nt, Artificial Sequence
  derived and/or modified CDS sequence (opt1) from DENV-3__GU363549__SS-prME
accagccugugccucaugaugauccugcccgccgcccuggcguuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgggacaagcgguccguggcccucgcgccccacgugggcauggggcuggacacccggacccagaccuggaugagcgccgagggcgccuggcggcaggucgagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgagcaggggaaggcccacaacggccgccugaucacggccaaccccgucgugaccaagaaggaggagcccgugaacaucgaggccgagccgcccuucggcgagagcaacaucgucaucgggaucggcgacaacgcgcugaagaucaacugguacaagaagggguccagcaucggcaagauguucgaggccaccgcccgcggggcccgccggauggccauccugggcgacaccgcgugggacuucggcuccgucgggggcgugcucaacagccuggggaagaugguccaccagaucuucggcuccgccuacacggcccuguucagcgggguguccugggugaugaagaucggcaucggcguccuccugaccuggaucgggcugaacagcaagaacaccuccaugagcuucuccugcaucgccaucggcaucaucacccucuaccugggggccguggugcaggcggacaugggcugcgucaucaacuggaaggggaaggagcugaagugcggcagcggcaucuucgugacgaacgaggugcacaccuggaccgagcaguacaaguuccaggccgacucccccaagcgccucgccaccgccaucgccggggcgugggagaacggcgucugcgggauccgcagcacgacccggauggagaaccugcuguggaagcagaucgccaacgagcucaacuacauccugugggagaacaacaucaagcugaccgugguggucggcgacaccaucggggugcucgagcagggcaagcgcacgcugacgccccagccgauggagcugaaguacuccuggaagaccuggggcaaggccaagaucgugaccgccgagacgcagaacagcuccuucaucaucgacgggcccaacacccccgagugccccagcgcgucccgggccuggaacgucugggagguggaggacuacggcuucgggguguucaccaccaacaucuggcucaagcugcgcgaggucuacacccagaugugcgaccaccggcugaugagcgccgccgugaaggacgagcgcgccgugcacgcggacaugggcuacuggaucgagagccagaagaacggcuccuggaagcucgagaaggccagccugaucgaggucaagacgugcaccuggccgaagucccacacccuguggagcaacggggugcucgaguccgacaugaucauccccaagagccuggccggccccaucucccagcacaacuaccggccgggguaccacacccagacggccggccccuggcaccuggggaagcucgagcuggacuucaacuacugcgagggcaccaccguggucaucaccgagaacugcggcacgcgcgggcccagccugcggaccaccaccguguccggcaagcucauccacgaguggugcugccgcagcugcacgcugcccccgcugcgguacaugggggaggacggcugcugguacgggauggagauccgccccaucuccgagaaggaggagaacauggucaagagccucgucuccgccggcagcggcaagguggacaacuucaccaugggggugcugugccuggcgauccucuucgaggaggucaugcggggcaaguucgggaagaagcacaugaucgccggcguguuccugaccuucaugcugcuccuguccgggcagaucaccuggcgcgacauggcccacacgcugaucaugaucggcagcaacgccuccgaccggaugggcaugggggugaccuaccucgcccugaucgcgaccuucaagauccagcccuuccuggcccucggcuucuuccugcgcaagcugaccagccgggagaaccuccugcugggggucggccucgccauggccacgaccauccagcugcccgaggacaucgagcagauggcgaacggcaucgcccuggggcucauggcccugaagcugaucacccaguucgagaccuaccagcucuggacggcccugaucagccugaccugcuccaacaccaucuucacccucacgguggccuggcgcaccgcgacccugauccuggccggcgugagccuccugccggucugccaguccagcuccaugcggaagaccgacuggcugcccaugacgguggccgccaugggggugccgccccucccgcuguucaucuucagccugaaggacacccucaagcgccgcuccuggccccugaacgagggcgugauggccguggggcuggucagcauccucgcguccagccugcugcggaacgacgugcccauggccggcccccucguggccggcgggcugcugaucgccugcuacgucaucaccggcaccuccgccgaccucacgguggagaaggcggccgacgugaccugggaggaggaggccgagcagaccggggucagccacaaccugaugaucaccguggacgacgacggcaccaugcgcaucaaggacgacgagacggagaacauccugaccgugcuccugaagaccgcccugcucaucgucuccgggaucuucccguacagcauccccgccacccugcugguguggcacacguggcagaagcagacccagcgguccggcgugcucugggacguccccagcccgcccgagacccagaaggcggagcuggaggagggcguguaccgcaucaagcagcaggggauccugggcaagacccaggugggggucggcgugcagaaggaggggguguuccacacgauguggcacgucacccggggcgccgugcucacccacaacggcaagcgccuggagcccaacugggccuccgugaagaaggaccugaucagcuacgggggcggguggcggcucuccgcccaguggcagaagggcgaggagguccaggugaucgcgguggagcccgggaagaaccccaagaacuuccagaccaugcccggcacguuccagaccaccaccggcgagaucggggccaucgcccuggacuucaagcccggcacgagcgggagccccaucaucaaccgcgagggcaaggucgugggccuguacgggaacggcguggucaccaagaacgggggcuacguguccgggaucgcccagaccaacgccgagccggacggccccacccccgagcuggaggaggagauguucaagaagcggaaccucacgaucauggaccugcaccccggcagcgggaagacccgcaaguaccugccggcgaucgugcgggaggccaucaagcgccggcuccgcacccugauccuggcccccacccgggucguggccgccgagauggaggaggcgcucaagggccugcccauccgcuaccagacgaccgccaccaaguccgagcacaccgggcgggagaucguggaccugaugcgccacgccacguucaccaugcggcuccugagccccguccgcgugccgaacuacaaccugaucaucauggacgaggcccacuucaccgaccccgccuccaucgcggcccggggcuacaucagcacccgcguggggaugggcgaggccgccgcgaucuucaugacggccacgccgcccggcaccgccgacgccuucccgcaguccaacgcccccauccaggacgaggagcgcgacauccccgagcggagcuggaacuccgggaacgaguggaucaccgacuucgcgggcaagacggucugguucgugcccagcaucaaggccgggaacgacaucgccaacugccuccgcaagaacggcaagaaggugauccagcugucccggaagaccuucgacaccgaguaccagaagaccaagcugaacgacugggacuucgucgugacgaccgacaucagcgagaugggggccaacuucaaggccgaccgcgugaucgacccgcggcgcugccucaagcccgucauccugaccgacggccccgagcgggugauccuggcgggccccaugccggugaccgucgccuccgccgcccagcgccgggggcgcgugggccggaacccccagaaggagaacgaccaguacaucuucaccgggcagccccucaacaacgacgaggaccacgcccacuggacggaggcgaagaugcugcuggacaacaucaacacccccgagggcaucaucccggcccucuucgagcccgagcgcgagaaguccgccgccaucgacggggaguaccggcugaagggcgagucccgcaagaccuucguggagcugaugcggcgcggcgaccuccccgucuggcuggcgcacaagguggccagcgaggggaucaaguacaccgaccggaaguggugcuucgacggccagcgcaacaaccagauccuggaggagaacauggacgucgagaucuggacgaaggagggggagaagaagaagcuccggccccgcuggcuggacgcccgcaccuacuccgacccgcuggcccucaaggaguucaaggacuucgccgcgggccgcaagagcaucgcccuggaccuggugaccgagaucggccgcgugcccucccaccucgcccaccggacccgcaacgcccuggacaaccuggucaugcuccacacgagcgagcacgggggccgggccuaccgccacgcgguggaggagcugcccgagaccauggagacccugcuccugcuggggcucaugauccugcugaccggcggggccaugcuguuccugaucagcggcaagggcaucgggaagacguccaucggccugaucugcgugaucgccagcuccgggaugcucuggauggccgagaucccgcugcaguggaucgccagcgcgaucguccuggaguucuucaugauggugcuccugauccccgagcccgagaagcagcggacgccccaggacaaccagcuggccuacguggucaucggcauccucacccuggccgccaucaucgccgcgaacgagauggggcugcucgagaccacgaagcgcgaccugggcauguccaaggagccgggcguggugagccccaccuccuaccuggacgucgaccuccaccccgccagcgccuggacccuguacgccguggcgaccacggugaucacccccaugcugcggcacaccaucgagaacuccaccgccaacgucagccucgccgccaucgccaaccaggcgguggugcugauggggcuggacaagggcuggccgaucuccaagauggaccucggggucccccugcuggcccucggcugcuacagccaggugaacccccugacgcugaccgccgccgugcuccugcuggucacccacuacgccaucaucgggcccggccuccaggcgaaggccacccgcgaggcccagaagcggacggccgccggcaucaugaagaacccgaccguggacgggaucaucaccaucgaccuggaccccgugaucuacgacuccaaguucgagaagcagcugggccaggucaugcuccuggugcugugcgcggugcagcuccugcugaugcgcaccagcugggcccucugcgaggcccugacgcuggccaccgggcccaucaccacccucugggagggcucccccggcaaguucuggaacacgaccaucgcggucagcauggccaacaucuuccggggguccuaccuggccggcgccgggcuggccuucagcaucaugaaguccgugggcaccgggaagcgcggcaccggcagccagggggagacccucggcgagaaguggaagaagaagcugaaccagcugagccggaaggaguucgaccucuacaagaaguccgggaucacggagguggaccgcaccgaggcgaaggagggccugaagcgcggggagaccacccaccacgccgucagccgcggcuccgccaagcugcagugguucguggagcggaacauggugaucccggagggccgcgucaucgaccucgggugcggccgcgggggcuggagcuacuacugcgccgggcugaagaaggugacggaggugcgcggcuacaccaagggcgggcccggccacgaggagcccguccccauguccacccacggguggaacaucgugaagcugaugagcggcaaggacguguucuaccucccgcccgagaagugcgacacccugcugugcgacaucggggaguccagccccucccccacggucgaggagagccgcaccauccgggugcugaagaugguggagccguggcucaagaacaaccaguucugcaucaagguccugaaccccuacaugcccgccgugaucgagcaccuggagcgccuccagcggaagcacggcggcaugcuggugcgcaacccccugucccggaacagcacccacgagauguacuggaucuccaacgggaccggcaacaucgucagcuccgugaacauggugagccgccuccugcugaaccgguucacgaugacccaccgccggccgaccaucgagaaggacgucgaccucggggcgggcacccgccacgugaacgccgagcccgagacgcccaacauggacgugaucggcgagcggauccgccggaucaaggaggagcacaacuccaccuggcacuacgacgacgagaacccguacaagaccugggccuaccacgggagcuacgaggucaaggccaccggcuccgccagcagcaugaucaacgggguggucaagcugcugacgaagcccugggacguggugcccauggucacccagauggcgaugaccgacaccacgcccuucggccagcagcgcguguucaaggagaagguggacacccggaccccgcgccccaugcccgggacccggaaggucauggagaucacggccgaguggcucuggcgcacccugggccggaacaagcgcccccgccugugcacccgggaggaguucaccaagaaggugcgcacgaacgccgccaugggcgcgguguucaccgaggagaaccagugggacuccgccaaggccgccgucgaggacgaggaguucuggaagcucguggaccgggagcgcgagcugcacaagcuggggaagugcggcagcugcguguacaacaugauggggaagcgggagaagaagcucggcgaguucgggaaggccaagggcucccgcgcgaucugguacauguggcugggcgcccgguaccuggaguucgaggcccucggguuccugaacgaggaccacugguucagccgcgagaacuccuacagcggcgucgagggggagggccugcacaagcucggguacauccugcgggacaucuccaagaucccgggcggcgccauguacgccgacgacaccgcggggugggacacccgcaucacggaggacgaccugcacaacgaggagaagaucacccagcagaugaaccccgagcaccggcuccuggccaacgccaucuucaagcugaccuaccagaacaagguggugaagguccagcgccccacccccaccggcacggugauggacaucaucagccggaaggaccagcgcggguccggccaggugggcaccuacgggcucaacaccuucaccaacauggaggcccagcugguccggcagauggagggcgagggggugcugagcaaggccgaccucgagaacccgcaccuccccgagaagaagaucacgcaguggcuggagaccaagggcguggagcgccucaagcggauggcgaucuccggggacgacugcgucgugaagcccaucgacgaccgcuucgccaacgcccugcuggcccucaacgacaugggcaaggugcggaaggacaucccccaguggcagccgagcaagggcuggcacgacuggcagcagguccccuucugcucccaccacuuccacgagcugaucaugaaggacgggcgcaagcugguggugcccugccggccccaggacgagcucaucggccgcgcccgcaucagccagggggcgggcuggucccugcgggagaccgccugccuggggaaggccuacgcccagauguggagccucauguacuuccaccgccgggaccugcgccuggcguccaacgccaucugcagcgccgucccggugcacugggugcccaccucccggacgaccuggagcauccacgcccaccaccaguggaugaccaccgaggacaugcucacggucuggaaccgcguguggaucgaggacaaccccuggauggaggacaagacccccgugaccaccugggagaacgucccguaccugggcaagcgggaggaccaguggugcggcagccugaucgggcucacgucccgcgccaccugggcgcagaacaucagcaccgccauccagcagguccggucccugaucggcaacgaggaguuccuggacuacaugcccagcaugaagcgcuuccggaaggaggaggaguccgagggggccaucugguga

SEQ ID NO: 10338 - RNA, 9873 nt, Artificial Sequence
  derived and/or modified CDS sequence (opt1) from DENV-3__KJ622197__SS-prME
accagccugugccucaugaugaugcugcccgccacccuggccuuccaccucaccagccgggacggcgagccccggaugaucguggggaagaacgagcggggcaagagccugcuguucaagaccgcgagcgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggacgugcaaccaggccggcgagcaccggcgcgacaagcgguccguggcccuggcgccccacgugggcauggggcuggacacccgcacccagaccuggaugagcgccgagggcgccuggcgccagguggagaaggucgagacgugggcccuccgccaccccggguucaccauccuggcgcuguuccucgcccacuacaucggcaccucccugacccagaagguggugaucuucauccugcucaugcuggucacgcccagcauggccaugcggugcgugggggugggcaaccgcgacuucgucgagggccuguccggggccaccuggguggacgugguccucgagcacggcgggugcgugaccaccauggccaagaacaagcccacgcuggacaucgagcugcagaagaccgaggcgacccagcucgccacccugcggaagcugugcaucgagggcaagaucacgaacaucaccaccgacagccgcugccccacccagggcgaggccauccuccccgaggagcaggaccagaacuacgugugcaagcacacguacgucgaccggggguggggcaacgggugcggccuguucgggaagggcucccuggugaccugcgccaaguuccagugccucgagagcaucgagggcaaggugguccagcacgagaaccugaaguacaccgugaccaucacggugcacaccggggaccagcaccaggucggcaacgacacccagggggugaccgccgagaucacgccccaggcguccaccgucgaggccauccugcccgaguacggcacccucgggcuggagugcagcccccgcaccggccuggacuucaacgagaugauccuccugaccaugaagaacaaggccuggauggugcaccggcagugguucuucgaccugccgcuccccuggacguccggcgccaucaccgagacccccaccuggaaccgcaaggagcugcuggugacguucaagaacgcccacgcgaagaagcaggaggucguggugcucgggagccaggagggcgccaugcacaccgcccugaccggggccaccgagauccagaacuccggcgggacgagcaucuucgccggccaccugaagugccggcucaagauggacaagcuggagcugaagggcauguccuacgcgaugugccucaacaccuucguccugaagaaggaggugagcgagacccagcacgggaccauccugaucaagguggaguacaagggcgaggacgcccccugcaagaucccguucagcacggaggacgggcagggcaaggcccacaacggccgccugaucaccgccaaccccgucgugaccaagaaggaggagcccgugaacaucgaggcggagcccccguucggggaguccaacaucgucaucggcaucggggacaaggcccucaagaucaacugguacaagaagggcagcuccaucgggaagauguucgaggccaccgcccggggcgcccgccggauggcgauccugggcgacacggccugggacuucgggagcgugggcggggugcugaacucccucggcaagaugguccaccagaucuucgggagcgccuacaccgcccuguucggcggcguguccuggaucaugaagaucgggaucggcgugcugcucaccuggaucgggcugaacagcaagaacaccuccaugagcuucuccugcaucgucaucggcaucaucacgcuguaccucgggaccguggugcaggccgacaugggcugcgucaucaacuggaagggcaaggagcugaagugcgggagcggcaucuucgugaccaacgaggugcacaccuggacggagcaguacaaguuccaggcggacucccccaagcgccuggccaccgccaucgccggggccugggagaacggcgucugcgggauccgcagcaccacccggauggagaaccuccuguggaagcagaucgcgaacgagcugaacuacauccucugggagaacaacaucaagcugacggugguggucggcgacaucaucggcgugcuggagcaggggaagcgcacccucacgccccagcccauggagcugaaguacuccuggaagaccuggggcaaggccaagaucgugacggccgagauccagaacagcuccuucaucaucgacgggccgaacacccccgagugccccagcgccucccgggcguggaacgucugggagguggaggacuacggcuucggcguguucaccaccaacaucuggcugaagcuccgcgaggucuacacgcagaccugcgaccaccggcugaugagcgccgccaucaaggacgagcgcgccgugcacgccgacaugggguacuggaucgagagccagaagaacggcuccuggaagcuggagaaggcgagcuucaucgaggugaagaccugcaccuggcccaagucccacacccucuggagcaacgggguccuggaguccgacaugaucauccccaagagccuggccggccccaucucccagcacaaccaccggcccggguaccacacgcagaccgccggcccguggcaccucggcaagcuggagcuggacuucaacuacugcgaggggaccaccguggugaucacggagaacugcggcacccgcgggcccagccuccggaccaccacggucuccggcaagcugauccacgaguggugcugccgcagcugcacccugccgccccugcgguacaugggggaggacggcugcugguacggcauggagauccgcccgaucaacgagaaggaggagaacauggugaagucccuggugagcgccggguccggcaaggucgacaacuucaccaugggggugcugugccucgccauccuguucgaggaggugaugcggggcaaguucgggaagaagcacaugaucgcgggcguccugcucaccuucaugcugcugcucagcggccagaucacguggcgcgacauggcccacacccugaucaugaucggguccaacgccagcgaccggaugggcaugggggugaccuaccuggcccucaucgccaccuucaagauccagcccuuccuggcgcugggcuucuuccuccgcaagcugacgucccgggagaaccugcuccugggcguggggcuggccauggccaccacccuccagcugcccgaggacaucgagcagauggccaacggcaucgcgcuggggcucauggcccugaagcugaucacccaguucgagacguaccagcucuggaccgcccuggucagccugaccugcagcaacaccaucuucacgcucaccguggccuggcgcaccgccacccugauccuggcgggcgugucccuccugcccgucugccagagcuccagcaugcggaagacggacuggcugccgguggccgucgccgccaugggggugccgccccucccccuguucaucuucucccugaaggacacccucaagcgccgcagcuggccgcugaacgagggcgugauggccgucggccugguguccauccucgcgagcucccugcugcggaacgacgugcccauggccgggccccucgucgccggcgggcugcugaucgccugcuacgugaucaccggcaccagcgccgaccucacgguggagaaggcggccgacgucaccugggaggaggaggccgagcagaccggggugucccacaaccugaugaucaccguggacgacgacggcacgaugcgcaucaaggacgacgagaccgagaacauccugaccguccuccugaagaccgcccugcucaucgugagcggcaucuuccccuacuccaucccggccacccugcugguguggcacacguggcagaagcagacccagcggagcgggguccucugggacgugcccagcccgcccgagacccagaaggcggagcuggaggagggcguguaccgcaucaagcagcaggggaucuucggcaagacccaggucggggugggcgugcagaaggagggcgucuuccacacgauguggcacgugacccgcggggccgugcugacccacaacggcaagcgccucgagccgaacugggccagcgucaagaaggaccugaucuccuacgggggcggguggcggcugagcgcccaguggcagaagggcgaggagguccaggugaucgcggucgagcccggccgcaaccccaagaacuuccagaccaugcccgggaucuuccagacgaccaccggcgagaucggggccaucgcccuggacuucaagccgggcaccuccggcagccccaucaucaaccgggaggggaagguggugggccucuacgggaacggcgucgugacgaagaacgggggcuacgugagcggcaucgcccaggccaacgcggagcccgacgggccgacccccgagcuggaggaggagauguucaagaagcgcaaccugaccaucauggaccuccaccccggcuccgggaagacccggaaguaccugcccgccaucguccgcgaggccaucaagcggcgccugcggacgcucauccuggccccgacccgcgugguggccgcggagauggaggaggcccugaagggccuccccauccgguaccagaccaccgccaccaaguccgagcacaccgggcgcgagaucgucgaccugaugugccacgccaccuucaccaugcggcugcucucccccgugcgcgugcccaacuacaaccugaucaucauggacgaggcccacuucacggacccggcgagcaucgccgcccggggcuacaucuccacccgcgucggcaugggggaggccgcggccaucuucaugaccgccacgccgcccggcacggccgaggccuucccccagagcaacgcgccgauccaggacgaggagcgcgacauccccgagcgguccuggaacagcgggaacgaguggaucaccgacuucgugggcaagaccgugugguucguccccuccaucaaggccgggaacgacaucgccaacugccugcgcaagaacggcaagaaggugauccagcucagccggaagaccuucgacacggaguaccagaagaccaagcugaacgacugggacuucguggucaccaccgacaucuccgagaugggcgccaacuucaaggccgaccgcgugaucgacccccggcgcugccugaagccggugauccucacggacgggcccgagcgggucauccuggcgggccccaugcccgugaccgccgccagcgccgcccagcgccgggggcgcgugggccggaacccgcagaaggagaacgaccaguacaucuucaccgggcagccccugaacaacgacgaggaccacgcgcacuggaccgaggccaagaugcuccuggacaacaucaacacgcccgagggcaucauccccgcccuguucgagccggagcgcgagaaguccgccgcgaucgacggcgaguaccggcucaagggggagagccgcaagaccuucgucgagcugaugcggcgcggcgaccugcccguguggcucgcccacaaggucgccuccgaggggaucaaguacaccgaccggaaguggugcuucgacggcgagcgcaacaaccagauccuggaggagaacauggacguggagaucuggaccaaggagggcgagcggaagaagcugcgcccccgcuggcucgacgcccggaccuacagcaacccccuggcccugaaggaguucaaggacuucgcggccgggcgcaaguccaucgcccucgaccuggugacggagaucggccgggucccgagccaccuggcccaccgcacccggaacgcccucgacaaccuggugaugcugcacaccuccgagcacgggggccgcgcguaccggcacgccguggaggagcuccccgagaccauggagacgcugcugcuccuggggcugaugauccuccugaccggcggcgccaugcuguuccucaucagcgggaagggcaucgggaagaccagcaucggccugaucugcgucaucguguccagcgggaugcuguggauggccgacgugccccuccaguggaucgccuccgcgaucguccuggaguucuucaugauggugcugcucaucccggagcccgagaagcagcgcacgccccaggacaaccagcuggccuacguggucaucggcauccugacgcucgccgccaucguggccgcgaacgagaugggccugcuggagaccaccaagcgggaccucgggaugagcaaggagcccggcguggucuccccgaccagcuaccuggacguggaccugcaccccgccuccgccuggacgcucuacgccguggcgaccaccgucaucacccccaugcugcgccacacgaucgagaacagcaccgccaacgugucccuggccgccaucgccaaccaggcggugguccucauggggcuggacaagggcuggcccaucagcaagauggaccugggggugccgcuccuggcccugggcugcuacucccaggugaacccccucacccugaccgccgccguccugcuccuggugacgcacuacgccaucaucggccccgggcugcaggcgaaggccacccgggaggcccagaagcgcaccgccgccggcaucaugaagaaccccaccguggacgggaucaugacgaucgaccucgacccggucaucuacgacagcaaguucgagaagcagcugggccaggugaugcugcucgugcugugcgcgguccagcugcuccugaugcggaccuccugggcccugugcgaggcccucacccuggccaccggccccaucacgacccugugggaggggagccccggcaaguucuggaacaccaccaucgcgguguccauggccaacaucuuccgcgggagcuaccucgccggcgccgggcuggccuucuccaucaugaaguccgugggcacgggcaagcgggggaccggcucccagggggagacccugggcgagaaguggaagaagaagcucaaccagcugagccgccgggaguucgagcuguacaagaaguccgggaucaccgaggucgaccgcacggaggcgaaggagggccucaagcggggcgagaccacccaccacgccgugucccgcgggagcgccaagcugcagugguucguggagcggaacauggucauccccgagggccgcgugaucgaccuggggugcggccgcgggggcugguccuacuacugcgccggccucaagaaggugaccgagguccggggguacaccaagggcgggccgggccacgaggagcccgugcccaugagcacguacggguggaacaccgugaagcugauguccggcaaggacgucuucuaccugcccccggagaagugcgacacccugcucugcgacaucggcgagagcucccccagccccaccguggaggagucccgcacgauccgggugcugaagauggucgagcccuggcugaagaacaaccaguucugcaucaaggugcucaacccguacaugcccaccgugaucgagcaccuggagcgccugcagcggaagcacgggggcaugcucguccgcaacccccugagccggaacuccacccacgagauguacuggaucagcaacgggaccggcaacaucguguccagcgugaacauggucucccgccugcuccugaaccgguucacgaugacccaccgccggcccaccaucgagaaggacguggaccugggcgccgggacccgccacgucaacgcggagccggagacgcccaacauggacgugaucggcgagcggaucaagcgcaucaaggaggagcacagcuccaccuggcacuacgacgacgagaaccccuacaagaccugggccuaccacgggagcuacgaggugaaggccaccggcuccgccagcagcaugaucaacggggucgugaagcuccugacgaagccgugggacgugguccccauggugacccagauggccaugaccgacaccacgcccuucggccagcagcggguguucaaggagaaggucgacacccgcacgccccggccgaugcccggcacccgcaaggugauggagaucaccgcggaguggcuguggcggacccucgggcgcaacaagcgcccccggcugugcacccgcgaggaguucaccaagaaggugcggacgaacgccgccaugggcgccgucuucaccgaggagaaccagugggaguccgcgcgcgccgccguggaggacgaggaguucuggaagcugguggggcgggagcgcgagcuccacaagcugggcaagugcgggagcugcgucuacaacaugaugggcaagcgggagaagaagcugggcgaguucgggaaggccaagggcucccgcgccaucugguacauguggcucggggcgcgguaccuggaguucgaggcccugggcuuccucaacgaggaccacugguucagccgcgagaacuccuacagcgggguggagggcgagggccugcacaagcugggguacauccuccgggacaucuccaagauccccggcggggccauguacgccgacgacaccgccggcugggacacccgcaucacggaggacgaccugcacaacgaggagaagaucacccagcagauggacccggagcaccggcagcuggcgaacgccaucuucaagcucaccuaccagaacaagguggucaaggugcagcgccccacccccaagggcacggugauggacaucaucagccggaaggaccagcgcggguccggccaggucgggaccuacggccugaacaccuucaccaacauggaggcccagcugauccggcagauggagggggagggcgugcucagcaaggccgaccuggagaacccccaccuccucgagaagaagaucacccaguggcuggagacgaagggcguggagcgccugaagcggauggccaucuccggggacgacugcgucgugaagccgaucgacgaccgcuucgcgaacgcccuccuggcccugaacgacaugggcaaggugcggaaggacaucccccaguggcagcccagcaagggguggcacgacuggcagcagguccccuucugcucccaccacuuccacgagcucaucaugaaggacggccgcaagcugguggugccgugccgcccccaggacgagcugaucgggcgggcccgcaucagccagggcgccggcuggucccucaaggagaccgcgugccuggggaaggccuacgcccagauguggagccugauguacuuccaccggcgcgaccuccggcuggccuccaacgcgaucugcagcgccguccccgugcacugggugcccaccucccgcaccacguggagcauccacgcccaccaccaguggaugaccaccgaggacaugcugaccgucuggaaccggguguggaucgaggacaacccguggauggaggacaagacgcccgugaccaccugggaggacguccccuaccucggcaagcgcgaggaccaguggugcgggagccugaucggccugaccucccgggccacgugggcccagaacauccucaccgcgauccagcagguccgcagccugaucggggacgaggaguuccuggacuacaugcccuccaugaagcgguuccgcaaggaggaggagagcgagggcgccaucugguga

SEQ ID NO: 10339 - RNA, 9873 nt, Artificial Sequence
  derived and/or modified CDS sequence (opt1) from DENV-3__KJ622198__SS-prME
accagccugugccucaugaugaugcugcccgccacccuggccuuccaccucaccagccgggacggcgagccccggaugaucguggggaagaacgagcggggcaagagccugcuguucaagaccgcgagcgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggacgugcaaccaggccggcgagcaccggcgcgacaagcgguccguggcccuggcgccccacgugggcauggggcuggacacccgcacccagaccuggaugagcgccgagggcgccuggcgccagguggagaaggucgagacgugggcccuccgccaccccggguucaccauccuggcgcuguuccucgcccacuacaucggcaccucccugacccagaagguggugaucuucauccugcucaugcuggucacgcccagcauggccaugcggugcgugggggugggcaaccgcgacuucgucgagggccuguccggggccaccuggguggacgugguccucgagcacggcgggugcgugaccaccauggccaagaacaagcccacgcuggacaucgagcugcagaagaccgaggcgacccagcucgccacccugcggaagcugugcaucgagggcaagaucacgaacaucaccaccgacagccgcugccccacccagggcgaggccauccuccccgaggagcaggaccagaacuacgugugcaagcacacguacgucgaccggggguggggcaacgggugcggccuguucgggaagggcucccuggugaccugcgccaaguuccagugccucgagagcaucgagggcaaggugguccagcacgagaaccugaaguacaccgugaccaucacggugcacaccggggaccagcaccaggucggcaacgacacccagggggugaccgccgagaucacgccccaggcguccaccgucgaggccauccugcccgaguacggcacccucgggcuggagugcagcccccgcaccggccuggacuucaacgagaugauccuccugaccaugaagaacaaggccuggauggugcaccggcagugguucuucgaccugccgcuccccuggacguccggcgccaucaccgagacccccaccuggaaccgcaaggagcugcuggugacguucaagaacgcccacgcgaagaagcaggaggucguggugcucgggagccaggagggcgccaugcacaccgcccugaccggggccaccgagauccagaacuccggcgggacgagcaucuucgccggccaccugaagugccggcucaagauggacaagcuggagcugaagggcauguccuacgcgaugugccucaacaccuucguccugaagaaggaggugagcgagacccagcacgggaccauccugaucaagguggaguacaagggcgaggacgcccccugcaagaucccguucagcacggaggacgggcagggcaaggcccacaacggccgccugaucaccgccaaccccgucgugaccaagaaggaggagcccgugaacaucgaggcggagcccccguucggggaguccaacaucgucaucggcaucggggacaaggcccucaagaucaacugguacaagaagggcagcuccaucgggaagauguucgaggccaccgcccggggcgcccgccggauggcgauccugggcgacacggccugggacuucgggagcgugggcggggugcugaacucccucggcaagaugguccaccagaucuucgggagcgccuacaccgcccuguucggcggcguguccuggaucaugaagaucgggaucggcgugcugcucaccuggaucgggcugaacagcaagaacaccuccaugagcuucuccugcaucgucaucggcaucaucacgcuguaccucgggaccguggugcaggccgacaugggcugcgucaucaacuggaagggcaaggagcugaagugcgggagcggcaucuucgugaccaacgaggugcacaccuggacggagcaguacaaguuccaggcggacucccccaagcgccuggccaccgccaucgccggggccugggagaacggcgucugcgggauccgcagcaccacccggauggagaaccuccuguggaagcagaucgcgaacgagcugaacuacauccucugggagaacaacaucaagcugacggugguggucggcgacaucaucggcgugcuggagcaggggaagcgcacccucacgccccagcccauggagcugaaguacuccuggaagaccuggggcaaggccaagaucgugacggccgagauccagaacagcuccuucaucaucgacgggccgaacacccccgagugccccagcgccucccgggcguggaacgucugggagguggaggacuacggcuucggcguguucaccaccaacaucuggcugaagcuccgcgaggucuacacgcagaccugcgaccaccggcugaugagcgccgccaucaaggacgagcgcgccgugcacgccgacaugggguacuggaucgagagccagaagaacggcuccuggaagcuggagaaggcgagcuucaucgaggugaagaccugcaccuggcccaagucccacacccucuggagcaacgggguccuggaguccgacaugaucauccccaagagccuggccggccccaucucccagcacaaccaccggcccggguaccacacgcagaccgccggcccguggcaccucggcaagcuggagcuggacuucaacuacugcgaggggaccaccguggugaucacggagaacugcggcacccgcgggcccagccuccggaccaccacggucuccggcaagcugauccacgaguggugcugccgcagcugcacccugccgccccuccgguacaugggggaggacggcugcugguacggcauggagauccgcccgaucaacgagaaggaggagaacauggugaagucccuggugagcgccggguccggcaaggucgacaacuucaccaugggggugcugugccucgccauccuguucgaggaggugaugcggggcaaguucgggaagaagcacaugaucgcgggcguccugcucaccuucaugcugcugcucagcggccagaucacguggcgcgacauggcccacacccugaucaugaucggguccaacgccagcgaccggaugggcaugggggugaccuaccuggcccucaucgccaccuucaagauccagcccuuccuggcgcugggcuucuuccuccgcaagcugacgucccgggagaaccugcuccugggcguggggcuggccauggccaccacccuccagcugcccgaggacaucgagcagauggccaacggcaucgcgcuggggcucauggcccugaagcugaucacccaguucgagacguaccagcucuggaccgcccuggucagccugaccugcagcaacaccaucuucacgcucaccguggccuggcgcaccgccacccugauccuggcgggcgugucccuccugcccgucugccagagcuccagcaugcggaagacggacuggcugccgguggccgucgccgccaugggggugccgccccucccccuguucaucuucucccugaaggacacccucaagcgccgcagcuggccgcugaacgagggcgugauggccgucggccugguguccauccucgcgagcucccugcugcggaacgacgugcccauggccgggccccucgucgccggcgggcugcugaucgccugcuacgugaucaccggcaccagcgccgaccucacgguggagaaggcggccgacgucaccugggaggaggaggccgagcagaccggggugucccacaaccugaugaucaccguggacgacgacggcacgaugcgcaucaaggacgacgagaccgagaacauccugaccguccuccugaagaccgcccugcucaucgugagcggcaucuuccccuacuccaucccggccacccugcugguguggcacacguggcagaagcagacccagcggagcgggguccucugggacgugcccagcccgcccgagacccagaaggcggagcuggaggagggcguguaccgcaucaagcagcaggggaucuucggcaagacccaggucggggugggcgugcagaaggagggcgucuuccacacgauguggcacgugacccgcggggccgugcugacccacaacggcaagcgccucgagccgaacugggccagcgucaagaaggaccugaucuccuacgggggcggguggcggcugagcgcccaguggcagaagggcgaggagguccaggugaucgcggucgagcccggccgcaaccccaagaacuuccagaccaugcccgggaucuuccagacgaccaccggcgagaucggggccaucgcccuggacuucaagccgggcaccuccggcagccccaucaucaaccgggaggggaagguggugggccucuacgggaacggcgucgugacgaagaacgggggcuacgugagcggcaucgcccaggccaacgcggagcccgacgggccgacccccgagcuggaggaggagauguucaagaagcgcaaccugaccaucauggaccuccaccccggcuccgggaagacccggaaguaccugcccgccaucguccgcgaggccaucaagcggcgccugcggacgcucauccuggccccgacccgcgugguggccgcggagauggaggaggcccugaagggccuccccauccgguaccagaccaccgccaccaaguccgagcacaccgggcgcgagaucgucgaccugaugugccacgccaccuucaccaugcggcugcucucccccgugcgcgugcccaacuacaaccugaucaucauggacgaggcccacuucacggacccggcgagcaucgccgcccggggcuacaucuccacccgcgucggcaugggggaggccgcggccaucuucaugaccgccacgccgcccggcacggccgaggccuucccccagagcaacgcgccgauccaggacgaggagcgcgacauccccgagcgguccuggaacagcgggaacgaguggaucaccgacuucgugggcaagaccgugugguucguccccuccaucaaggccgggaacgacaucgccaacugccugcgcaagaacggcaagaaggugauccagcucagccggaagaccuucgacacggaguaccagaagaccaagcugaacgacugggacuucguggucaccaccgacaucuccgagaugggcgccaacuucaaggccgaccgcgugaucgacccccggcgcugccugaagccggugauccucacggacgggcccgagcgggucauccuggcgggccccaugcccgugaccgccgccagcgccgcccagcgccgggggcgcgugggccggaacccgcagaaggagaacgaccaguacaucuucaccgggcagccccugaacaacgacgaggaccacgcgcacuggaccgaggccaagaugcuccuggacaacaucaacacgcccgagggcaucauccccgcccuguucgagccggagcgcgagaaguccgccgcgaucgacggcgaguaccggcucaagggggagagccgcaagaccuucgucgagcugaugcggcgcggcgaccugcccguguggcucgcccacaaggucgccuccgaggggaucaaguacaccgaccggaaguggugcuucgacggcgagcgcaacaaccagauccuggaggagaacauggacguggagaucuggaccaaggagggcgagcggaagaagcugcgcccccgcuggcucgacgcccggaccuacagcaacccccuggcccugaaggaguucaaggacuucgcggccgggcgcaaguccaucgcccucgaccuggugacggagaucggccgggucccgagccaccuggcccaccgcacccggaacgcccucgacaaccuggugaugcugcacaccuccgagcacgggggccgcgcguaccggcacgccguggaggagcuccccgagaccauggagacgcugcugcuccuggggcugaugauccuccugaccggcggcgccaugcuguuccucaucagcgggaagggcaucgggaagaccagcaucggccugaucugcgucaucguguccagcgggaugcuguggauggccgacgugccccuccaguggaucgccuccgcgaucguccuggaguucuucaugauggugcugcucaucccggagcccgagaagcagcgcacgccccaggacaaccagcuggccuacguggucaucggcauccugacgcucgccgccaucguggccgcgaacgagaugggccugcuggagaccaccaagcgggaccucgggaugagcaaggagcccggcguggucuccccgaccagcuaccuggacguggaccugcaccccgccuccgccuggacgcucuacgccguggcgaccaccgucaucacccccaugcugcgccacacgaucgagaacagcaccgccaacgugucccuggccgccaucgccaaccaggcggugguccucauggggcuggacaagggcuggcccaucagcaagauggaccugggggugccgcuccuggcccugggcugcuacucccaggugaacccccucacccugaccgccgccguccugcuccuggugacgcacuacgccaucaucggccccgggcugcaggcgaaggccacccgggaggcccagaagcgcaccgccgccggcaucaugaagaaccccaccguggacgggaucaugacgaucgaccucgacccggucaucuacgacagcaaguucgagaagcagcugggccaggugaugcugcucgugcugugcgcgguccagcugcuccugaugcggaccuccugggcccugugcgaggcccucacccuggccaccggccccaucacgacccugugggaggggagccccggcaaguucuggaacaccaccaucgcgguguccauggccaacaucuuccgcgggagcuaccucgccggcgccgggcuggccuucuccaucaugaaguccgugggcacgggcaagcgggggaccggcucccagggggagacccugggcgagaaguggaagaagaagcucaaccagcugagccgccgggaguucgagcuguacaagaaguccgggaucaccgaggucgaccgcacggaggcgaaggagggccucaagcggggcgagaccacccaccacgccgugucccgcgggagcgccaagcugcagugguucguggagcggaacauggucauccccgagggccgcgugaucgaccuggggugcggccgcgggggcugguccuacuacugcgccggccucaagaaggugaccgagguccggggguacaccaagggcgggccgggccacgaggagcccgugcccaugagcacguacggguggaacaccgugaagcugauguccggcaaggacgucuucuaccugcccccggagaagugcgacacccugcucugcgacaucggcgagagccugcccucccccaccguggaggagagccgcacgauccgggugcugaagauggucgagcccuggcucaagaacaaccaguucugcaucaaggugcugaacccguacaugcccaccgugaucgagcaccuggagcgccuccagcggaagcacgggggcaugcugguccgcaacccccugucccggaacagcacccacgagauguacuggaucuccaacgggaccggcaacaucgugagcuccgugaacauggucagccgccuccugcugaaccgguucacgaugacccaccgccggcccaccaucgagaaggacguggaccucggcgccgggacccgccacgucaacgcggagccggagacgcccaacauggacgugaucggcgagcggaucaagcgcaucaaggaggagcacuccagcaccuggcacuacgacgacgagaaccccuacaagaccugggccuaccacggguccuacgaggugaaggccaccggcagcgccuccagcaugaucaacggggucgugaagcugcugacgaagccgugggacgugguccccauggugacccagauggccaugaccgacaccacgcccuucggccagcagcggguguucaaggagaaggucgacacccgcacgccccggccgaugcccggcacccgcaaggugauggagaucaccgcggaguggcucuggcggacccuggggcgcaacaagcgcccccggcugugcacccgcgaggaguucaccaagaaggugcggacgaacgccgccaugggcgccgucuucaccgaggagaaccagugggagagcgcgcgcgccgccguggaggacgaggaguucuggaagcucguggggcgggagcgcgagcugcacaagcugggcaagugcggguccugcgucuacaacaugaugggcaagcgggagaagaagcucggcgaguucgggaaggccaagggcagccgcgccaucugguacauguggcugggggcgcgguaccuggaguucgaggcccucggcuuccugaacgaggaccacugguucucccgcgagaacagcuacuccgggguggagggcgagggccugcacaagcucggguacauccugcgggacaucagcaagauccccggcggggccauguacgccgacgacaccgccggcugggacacccgcaucacggaggacgaccugcacaacgaggagaagaucacccagcagauggacccggagcaccggcagcucgcgaacgccaucuucaagcugaccuaccagaacaagguggucaaggugcagcgccccacccccaagggcacggugauggacaucaucucccggaaggaccagcgcgggagcggccaggucgggaccuacggccugaacaccuucaccaacauggaggcccagcucauccggcagauggagggggagggcgugcuguccaaggccgaccuggagaacccccaccuccuggagaagaagaucacccaguggcuggagacgaagggcguggagcgccucaagcggauggccaucagcggggacgacugcgucgugaagccgaucgacgaccgcuucgcgaacgcccugcuggcccucaacgacaugggcaaggugcggaaggacaucccccaguggcagcccuccaagggguggcacgacuggcagcagguccccuucugcagccaccacuuccacgagcugaucaugaaggacggccgcaagcugguggugccgugccgcccccaggacgagcucaucgggcgggcccgcaucucccagggcgccggcuggagccugaaggagaccgcgugccuggggaaggccuacgcccagauguggucccucauguacuuccaccggcgcgaccugcggcuggccagcaacgcgaucugcuccgccguccccgugcacugggugcccaccagccgcaccacgugguccauccacgcccaccaccaguggaugaccaccgaggacaugcucaccgucuggaaccggguguggaucgaggacaacccguggauggaggacaagacgcccgugaccaccugggaggacguccccuaccugggcaagcgcgaggaccaguggugcgggagccugaucggccucaccagccgggccacgugggcccagaacauccugaccgcgauccagcagguccgcucccugaucggggacgaggaguuccucgacuacaugcccagcaugaagcgguuccgcaaggaggaggaguccgagggcgccaucugguga

SEQ ID NO: 10340 - RNA, 9873 nt, Artificial Sequence
  derived and/or modified CDS sequence (opt1) from DENV-3__KJ622191__SS-prME
accagccugugccucaugaugaugcugcccgccacccuggccuuccaccucaccagccgggacggcgagccccggaugaucguggggaagaacgagcggggcaagagccugcuguucaagaccgcguccgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgccgagggcgccuggcgccagguggagaaggucgagacgugggcccuccgccaccccggguucaccauccuggcgcuguuccucgcccacuacaucggcaccucccugacccagaagguggugaucuucauccugcucaugcuggucacgcccagcauggccaugcggugcgugggggugggcaaccgcgacuucgucgagggccuguccggggccaccuggguggacgugguccucgagcacggcgggugcgugaccaccauggccaagaacaagcccacgcuggacaucgagcugcagaagaccgaggcgacccagcucgccacccugcggaagcugugcaucgagggcaagaucacgaacaucaccaccgacagccgcugccccacccagggcgaggccauccuccccgaggagcaggaccagaacuacgugugcaagcacacguacgucgaccggggguggggcaacgggugcggccuguucgggaagggcucccuggugaccugcgccaaguuccagugccucgagagcaucgagggcaaggugguccagcacgagaaccugaaguacaccgugaccaucacggugcacaccggggaccagcaccaggucggcaacgacacccagggggugaccgccgagaucacgccccaggcguccaccgucgaggccauccugcccgaguacggcacccucgggcuggagugcagcccccgcaccggccuggacuucaacgaggugauccuccugaccaugaagaacaaggccuggauggugcaccggcagugguucuucgaccugccgcuccccuggacguccggcgccaucaccgagacccccaccuggaaccgcaaggagcugcuggucacguucaagaacgcccacgcgaagaagcaggagguggugguccucgggagccaggagggcgccaugcacaccgcccugaccggggccaccgagauccagaacuccggcgggacgagcaucuucgccggccaccugaagugccggcucaagauggacaagcuggagcugaagggcauguccuacgcgaugugccucaacaccuucgugcugaagaaggaggugagcgagacccagcacgggaccauccugaucaaggucgaguacaagggcgaggacgcccccugcaagaucccguucagcacggaggacgggcagggcaaggcccacaacggccgccugaucaccgccaaccccguggugaccaagaaggaggagcccgucaacaucgaggcggagcccccguucggggaguccaacaucgugaucggcaucggggacaaggcccucaagaucaacugguacaagaagggcagcuccaucgggaagauguucgaggccaccgcccggggcgcccgccggauggcgauccugggcgacacggccugggacuucgggagcgugggcgggguccugaacucccucggcaagauggugcaccagaucuucgggagcgccuacaccgcccuguucggcggcguguccuggaucaugaagaucgggaucggcguccugcucaccuggaucgggcugaacagcaagaacaccuccaugagcuucuccugcaucgugaucggcaucaucacgcuguaccucgggaccgugguccaggccgacaugggcugcgugaucaacuggaagggcaaggagcugaagugcgggagcggcaucuucgugaccaacgagguccacaccuggacggagcaguacaaguuccaggcggacucccccaagcgccuggccaccgccaucgccggggccugggagaacggcgugugcgggauccgcagcaccacccggauggagaaccuccuguggaagcagaucgcgaacgagcugaacuacauccucugggagaacaacaucaagcugacgguggucgugggcgacaucaucggcgugcuggagcaggggaagcgcacccucacgccccagcccauggagcugaaguacuccuggaagaccuggggcaaggccaagaucgucacggccgagauccagaacagcuccuucaucaucgacgggccgaacacccccgagugccccagcgccucccgggcguggaacgugugggagguggaggacuacggcuucggcgucuucaccaccaacaucuggcugaagcuccgcgagguguacacgcagaccugcgaccaccggcugaugagcgccgccaucaaggacgagcgcgccgugcacgccgacaugggguacuggaucgagagccagaagaacggcuccuggaagcuggagaaggcgagcuucaucgaggucaagaccugcaccuggcccaagucccacacccucuggagcaacggggugcuggaguccgacaugaucauccccaagagccuggccggccccaucucccagcacaaccaccggcccggguaccacacgcagaccgccggcccguggcaccucggcaagcuggagcuggacuucaacuacugcgaggggaccaccguggucaucacggagaacugcggcacccgcgggcccagccuccggaccaccacgguguccggcaagcugauccacgaguggugcugccgcagcugcacccugccgccccugcgguacaugggggaggacggcugcugguacggcauggagauccgcccgaucaacgagaaggaggagaacauggugaagucccuggucagcgccggguccggcaagguggacaacuucaccaugggggugcugugccucgccauccuguucgaggaggucaugcggggcaaguucgggaagaagcacaugaucgcgggcgugcugcucaccuucaugcugcugcucagcggccagaucacguggcgcgacauggcccacacccugaucaugaucggguccaacgccagcgaccggaugggcaugggggugaccuaccuggcccucaucgccaccuucaagauccagcccuuccuggcgcugggcuucuuccuccgcaagcugacgucccgggagaaccugcuccugggcgucgggcuggccauggccaccacccuccagcugcccgaggacaucgagcagauggccaacggcaucgcgcuggggcucauggcccugaagcugaucacccaguucgagacguaccagcucuggaccgcccuggugagccugaccugcagcaacaccaucuucacgcucaccguggccuggcgcaccgccacccugauccuggcgggcgucucccuccugcccgugugccagagcuccagcaugcggaagacggacuggcugccggucgccguggccgccaugggggugccgccccucccccuguucaucuucucccugaaggacacccucaagcgccgcagcuggccgcugaacgagggcgucauggccgugggccugguguccauccucgcgagcucccugcugcggaacgacguccccauggccgggccccucguggccggcgggcugcugaucgccugcuacgugaucaccggcaccagcgccgaccucacggucgagaaggcggccgacgugaccugggaggaggaggccgagcagaccggggugucccacaaccugaugaucaccgucgacgacgacggcacgaugcgcaucaaggacgacgagaccgagaacauccugaccgugcuccugaagaccgcccugcucaucgugagcggcaucuuccccuacuccaucccggccacccugcuggucuggcacacguggcagaagcagacccagcggagcggggugcucugggacgugcccagcccgcccgagacccagaaggcggagcuggaggagggcgucuaccgcaucaagcagcaggggaucuucggcaagacccaggugggggugggcguccagaaggagggcguguuccacacgauguggcacgugacccgcggggccguccugacccacaacggcaagcgccucgagccgaacugggccagcgugaagaaggaccugaucuccuacgggggcggguggcggcugagcgcccaguggcagaagggcgaggaggugcaggucaucgcgguggagcccggccgcaaccccaagaacuuccagaccaugcccgggaucuuccagacgaccaugggcgagaucggggccaucgcccuggacuucaagccgggcaccuccggcagccccaucaucaaccgggaggggaagguggucggccucuacgggaacggcguggugaccaagaacgggggcuacgucagcggcaucgcccaggccaacgcggagcccgacgggccgacgcccgagcuggaggaggagauguucaagaagcgcaaccugaccaucauggaccuccaccccggcuccgggaagacccggaaguaccugcccgccaucgugcgcgaggccaucaagcggcgccugcggacccucauccuggccccgacgcgcguggucgccgcggagauggaggaggcccugaagggccuccccauccgguaccagaccaccgccaccaagagcgagcacacggggcgcgagaucguggaccugaugugccacgccaccuucaccaugcggcugcucucccccgugcgcguccccaacuacaaccugaucaucauggacgaggcccacuucaccgacccggcgagcaucgccgcccggggcuacaucuccacgcgcgugggcaugggggaggccgcggccaucuucaugaccgccacgccgcccggcaccgccgaggccuucccccagagcaacgcgccgauccaggacgaggagcgcgacauccccgagcgguccuggaacagcgggaacgaguggaucacggacuucgugggcaagaccgucugguucgugcccuccaucaaggccgggaacgacaucgccaacugccugcgcaagaacggcaagaaggugauccagcucagccggaagaccuucgacaccgaguaccagaagacgaagcugaacgacugggacuucgucgugaccaccgacaucuccgagaugggcgccaacuucaaggccgaccgcgugaucgacccccggcgcugccugaagccggucauccucaccgacgggcccgagcgggugauccuggcgggccccaugcccgugacggccgccagcgccgcccagcgccgggggcgcgucggccggaacccgcagaaggagaacgaccaguacaucuucaccgggcagccccugaacaacgacgaggaccacgcgcacuggaccgaggccaagaugcuccuggacaacaucaacacccccgagggcaucauccccgcccuguucgagccggagcgcgagaaguccgccgcgaucgacggcgaguaccggcucaagggggagagccgcaagacguucguggagcugaugcggcgcggcgaccugcccgucuggcucgcccacaagguggccuccgaggggaucaaguacaccgaccggaaguggugcuucgacggcgagcgcaacaaccagauccuggaggagaacauggacguggagaucuggaccaaggagggcgagcggaagaagcugcgcccccgcuggcucgacgcccggaccuacagcgacccccuggcccugaaggaguucaaggacuucgcggccgggcgcaaguccaucgcccucgaccuggucaccgagaucggccgggugccgagccaccuggcccaccgcacgcggaacgcccucgacaaccuggugaugcugcacaccuccgagcacgggggccgcgcguaccggcacgccgucgaggagcuccccgagaccauggagacccugcugcuccuggggcugaugauccuccugacgggcggcgccaugcuguuccucaucagcgggaagggcaucgggaagaccagcaucggccugaucugcgugaucguguccagcgggaugcuguggauggccgacgucccccuccaguggaucgccuccgcgaucgugcuggaguucuucaugauggugcugcucaucccggagcccgagaagcagcgcacgccccaggacaaccagcuggccuacgucgugaucggcauccugacccucgccgccaucguggccgcgaacgagaugggccugcuggagacgaccaagcgggaccucgggaugagcaaggagcccggcgucguguccccgaccagcuaccuggacguggaccugcaccccgccuccgccuggacccucuacgccgucgcgacgaccgugaucacccccaugcugcgccacaccaucgagaacagcacggccaacgugucccuggccgccaucgccaaccaggcggucgugcucauggggcuggacaagggcuggcccaucagcaagauggaccugggggugccgcuccuggcccugggcugcuacucccaggucaacccccucacccugaccgccgccgugcugcuccuggugacccacuacgccaucaucggccccgggcugcaggcgaaggccacgcgggaggcccagaagcgcaccgccgccggcaucaugaagaaccccaccgucgacgggaucaugaccaucgaccucgacccggugaucuacgacagcaaguucgagaagcagcugggccaggugaugcugcucguccugugcgcggugcagcugcuccugaugcggacguccugggcccugugcgaggcccucacccuggccaccggccccaucaccacgcugugggaggggagccccggcaaguucuggaacaccaccaucgcgguguccauggccaacaucuuccgcgggagcuaccucgccggcgccgggcuggccuucuccaucaugaaguccgucggcaccggcaagcgggggacgggcucccagggggagacccugggcgagaaguggaagaagaagcucaaccagcugagccgccgggaguucgagcuguacaagaaguccgggaucaccgagguggaccgcaccgaggcgaaggagggccucaagcggggcgagacgacccaccacgccgugucccgcgggagcgccaagcugcagugguucgucgagcggaacauggugauccccgagggccgcgugaucgaccuggggugcggccgcgggggcugguccuacuacugcgccggccucaagaaggucaccgaggugcggggguacaccaagggcgggccgggccacgaggagcccgugcccaugagcaccuacggguggaacacggucaagcugauguccggcaaggacguguucuaccugcccccggagaagugcgacacccugcucugcgacaucggcgagagcucccccagccccaccguggaggagucccgcaccauccggguccugaagaugguggagcccuggcugaagaacaaccaguucugcaucaaggugcucaacccguacaugcccacggucaucgagcaccuggagcgccugcagcggaagcacgggggcaugcucgugcgcaacccccugagccggaacuccacccacgagauguacuggaucagcaacgggaccggcaacaucguguccagcgucaacauggugucccgccugcuccugaaccgguucaccaugacgcaccgccggcccaccaucgagaaggacgucgaccugggcgccgggacccgccacgugaacgcggagccggagacccccaacauggacgugaucggcgagcggaucaagcgcaucaaggaggagcacagcuccacguggcacuacgacgacgagaaccccuacaagaccugggccuaccacgggagcuacgaggucaaggccaccggcuccgccagcagcaugaucaacgggguggugaagcuccugaccaagccgugggacgucgugcccauggugacgcagauggccaugaccgacaccacccccuucggccagcagcgggucuucaaggagaagguggacacgcgcacgccccggccgaugcccggcacccgcaaggugauggagaucaccgcggaguggcuguggcggacccucgggcgcaacaagcgcccccggcugugcacccgcgaggaguucaccaagaagguccggaccaacgccgccaugggcgccguguucacggaggagaaccagugggaguccgcgcgcgccgccguggaggacgaggaguucuggaagcuggucgggcgggagcgcgagcuccacaagcugggcaagugcgggagcugcguguacaacaugaugggcaagcgggagaagaagcugggcgaguucgggaaggccaagggcucccgcgccaucugguacauguggcucggggcgcgguaccuggaguucgaggcccugggcuuccucaacgaggaccacugguucagccgcgagaacuccuacagcgggguggagggcgagggccugcacaagcugggguacauccuccgggacaucuccaagauccccggcggggccauguacgccgacgacaccgccggcugggacacccgcaucaccgaggacgaccugcacaacgaggagaagaucacgcagcagauggacccggagcaccggcagcuggcgaacgccaucuucaagcucaccuaccagaacaaggucgugaaggugcagcgccccacccccaagggcaccgucauggacaucaucagccggaaggaccagcgcggguccggccagguggggacguacggccugaacaccuucaccaacauggaggcccagcugauccggcagauggagggggagggcgugcucagcaaggccgaccuggagaacccccaccuccucgagaagaagaucacccaguggcuggagaccaagggcgucgagcgccugaagcggauggccaucuccggggacgacugcguggugaagccgaucgacgaccgcuucgcgaacgcccuccuggcccugaacgacaugggcaagguccggaaggacaucccccaguggcagcccagcaagggguggcacgacuggcagcagguccccuucugcucccaccacuuccacgagcucaucaugaaggacggccgcaagcugguggucccgugccgcccccaggacgagcugaucgggcgggcccgcaucagccagggcgccggcuggucccucaaggagacggcgugccuggggaaggccuacgcccagauguggagccugauguacuuccaccggcgcgaccuccggcuggccuccaacgcgaucugcagcgccgugcccgugcacuggguccccaccucccgcaccaccuggagcauccacgcccaccaccaguggaugacgaccgaggacaugcugaccguguggaaccggguguggaucgaggacaacccguggauggaggacaagacccccgucacgaccugggaggacgugcccuaccucggcaagcgcgaggaccaguggugcgggagccugaucggccugaccucccgggccaccugggcccagaacauccucacggcgauccagcagguccgcagccugaucggggacgaggaguuccuggacuacaugcccuccaugaagcgguuccgcaaggaggaggagagcgagggcgccaucugguga

SEQ ID NO: 10341 - RNA, 9873 nt, Artificial Sequence
  derived and/or modified CDS sequence (opt1) from DENV-3__KJ622192__SS-prME
accagccugugccucaugaugaugcugcccgccacccuggccuuccaccucaccagccgggacggcgagccccggaugaucguggggaagaacgagcggggcaagagccugcuguucaagaccgcgagcgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggacgugcaaccaggccggcgagcaccggcgcgacaagcgguccguggcccuggcgccccacgugggcauggggcuggacacccgcacccagaccuggaugagcgccgagggcgccuggcgccagguggagaaggucgagacgugggcccuccgccaccccggguucaccauccuggcgcuguuccucgcccacuacaucggcaccucccugacccagaagguggugaucuucauccugcucaugcuggucacgcccagcauggccaugcggugcgugggggugggcaaccgcgacuucgucgagggccuguccggggccaccuggguggacgugguccucgagcacggcgggugcgugaccaccauggccaagaacaagcccacgcuggacaucgagcugcagaagaccgaggcgacccagcucgccacccugcggaagcugugcaucgagggcaagaucacgaacaucaccaccgacagccgcugccccacccagggcgaggccauccuccccgaggagcaggaccagaacuacgugugcaagcacacguacgucgaccggggguggggcaacgggugcggccuguucgggaagggcucccuggugaccugcgccaaguuccagugccucgagagcaucgagggcaaggugguccagcacgagaaccugaaguacaccgugaccaucacggugcacaccggggaccagcaccaggucggcaacgacacccagggggugaccgccgagaucacgccccaggcguccaccgucgaggccauccugcccgaguacggcacccucgggcuggagugcagcccccgcaccggccuggacuucaacgagaugauccuccugaccaugaagaacaaggccuggauggugcaccggcagugguucuucgaccugccgcuccccuggacguccggcgccaucaccgagacccccaccuggaaccgcaaggagcugcuggugacguucaagaacgcccacgcgaagaagcaggaggucguggugcucgggagccaggagggcgccaugcacaccgcccugaccggggccaccgagauccagaacuccggcgggacgagcaucuucgccggccaccugaagugccggcucaagauggacaagcuggagcugaagggcauguccuacgcgaugugccucaacaccuucguccugaagaaggaggugagcgagacccagcacgggaccauccugaucaagguggaguacaagggcgaggacgcccccugcaagaucccguucagcacggaggacgggcagggcaaggcccacaacggccgccugaucaccgccaaccccgucgugaccaagaaggaggagcccgugaacaucgaggcggagcccccguucggggaguccaacaucgucaucggcaucggggacaaggcccucaagaucaacugguacaagaagggcagcuccaucgggaagauguucgaggccaccgcccggggcgcccgccggauggcgauccugggcgacacggccugggacuucgggagcgugggcggggugcugaacucccucggcaagaugguccaccagaucuucgggagcgccuacaccgcccuguucggcggcguguccuggaucaugaagaucgggaucggcgugcugcucaccuggaucgggcugaacagcaagaacaccuccaugagcuucuccugcaucgucaucggcaucaucacgcuguaccucgggaccguggugcaggccgacaugggcugcgucaucaacuggaagggcaaggagcugaagugcgggagcggcaucuucgugaccaacgaggugcacaccuggacggagcaguacaaguuccaggcggacucccccaagcgccuggccaccgccaucgccggggccugggagaacggcgucugcgggauccgcagcaccacccggauggagaaccuccuguggaagcagaucgcgaacgagcugaacuacauccucugggagaacaacaucaagcugacggugguggucggcgacaucaucggcgugcuggagcaggggaagcgcacccucacgccccagcccauggagcugaaguacuccuggaagaccuggggcaaggccaagaucgugacggccgagauccagaacagcuccuucaucaucgacgggccgaacacccccgagugccccagcgccucccgggcguggaacgucugggagguggaggacuacggcuucggcguguucaccaccaacaucuggcugaagcuccgcgaggucuacacgcagaccugcgaccaccggcugaugagcgccgccaucaaggacgagcgcgccgugcacgccgacaugggguacuggaucgagagccagaagaacggcuccuggaagcuggagaaggcgagcuucaucgaggugaagaccugcaccuggcccaagucccacacccucuggagcaacgggguccuggaguccgacaugaucauccccaagagccuggccggccccaucucccagcacaaccaccggcccggguaccacacgcagaccgccggcccguggcaccucggcaagcuggagcuggacuucaacuacugcgaggggaccaccguggugaucacggagaacugcggcacccgcgggcccagccuccggaccaccacggucuccggcaagcugauccacgaguggugcugccgcagcugcacccugccgccccugcgguacaugggggaggacggcugcugguacggcauggagauccgcccgaucaacgagaaggaggagaacauggugaagucccuggugagcgccggguccggcaaggucgacaacuucaccaugggggugcugugccucgccauccuguucgaggaggugaugcggggcaaguucgggaagaagcacaugaucgcgggcguccugcucaccuucaugcugcugcucagcggccagaucacguggcgcgacauggcccacacccugaucaugaucggguccaacgccagcgaccggaugggcaugggggugaccuaccuggcccucaucgccaccuucaagauccagcccuuccuggcgcugggcuucuuccuccgcaagcugacgucccgggagaaccugcuccugggcguggggcuggccauggccaccacccuccagcugcccgaggacaucgagcagauggccaacggcaucgcgcuggggcucauggcccugaagcugaucacccaguucgagacguaccagcucuggaccgcccuggucagccugaccugcagcaacaccaucuucacgcucaccguggccuggcgcaccgccacccugauccuggcgggcgugucccuccugcccgucugccagagcuccagcaugcggaagacggacuggcugccgguggccgucgccgccaugggggugccgccccucccccuguucaucuucucccugaaggacacccucaagcgccgcagcuggccgcugaacgagggcgugauggccgucggccugguguccauccucgcgagcucccugcugcggaacgacgugcccauggccgggccccucgucgccggcgggcugcugaucgccugcuacgugaucaccggcaccagcgccgaccucacgguggagaaggcggccgacgucaccugggaggaggaggccgagcagaccggggugucccacaaccugaugaucaccguggacgacgacggcacgaugcgcaucaaggacgacgagaccgagaacauccugaccguccuccugaagaccgcccugcucaucgugagcggcaucuuccccuacuccaucccggccacccugcugguguggcacacguggcagaagcagacccagcggagcgggguccucugggacgugcccagcccgcccgagacccagaaggcggagcuggaggagggcguguaccgcaucaagcagcaggggaucuucggcaagacccaggucggggugggcgugcagaaggagggcgucuuccacacgauguggcacgugacccgcggggccgugcugacccacaacggcaagcgccucgagccgaacugggccagcgucaagaaggaccugaucuccuacgggggcggguggcggcugagcgcccaguggcagaagggcgaggagguccaggugaucgcggucgagcccggccgcaaccccaagaacuuccagaccaugcccgggaucuuccagacgaccaccggcgagaucggggccaucgcccuggacuucaagccgggcaccuccggcagccccaucaucaaccgggaggggaagguggugggccucuacgggaacggcgucgugacgaagaacgggggcuacgugagcggcaucgcccaggccaacgcggagcccgacgggccgacccccgagcuggaggaggagauguucaagaagcgcaaccugaccaucauggaccuccaccccggcuccgggaagacccggaaguaccugcccgccaucguccgcgaggccaucaagcggcgccugcggacgcucauccuggccccgacccgcgugguggccgcggagauggaggaggcccugaagggccuccccauccgguaccagaccaccgccaccaaguccgagcacaccgggcgcgagaucgucgaccugaugugccacgccaccuucaccaugcggcugcucucccccgugcgcgugcccaacuacaaccugaucaucauggacgaggcccacuucacggacccggcgagcaucgccgcccggggcuacaucuccacccgcgucggcaugggggaggccgcggccaucuucaugaccgccacgccgcccggcacggccgaggccuucccccagagcaacgcgccgauccaggacgaggagcgcgacauccccgagcgguccuggaacagcgggaacgaguggaucaccgacuucgugggcaagaccgugugguucguccccuccaucaaggccgggaacgacaucgccaacugccugcgcaagaacggcaagaaggugauccagcucagccggaagaccuucgacacggaguaccagaagaccaagcugaacgacugggacuucguggucaccaccgacaucuccgagaugggcgccaacuucaaggccgaccgcgugaucgacccccggcgcugccugaagccggugauccucacggacgggcccgagcgggucauccuggcgggccccaugcccgugaccgccgccagcgccgcccagcgccgggggcgcgugggccggaacccgcagaaggagaacgaccaguacaucuucaccgggcagccccugaacaacgacgaggaccacgcgcacuggaccgaggccaagaugcuccuggacaacaucaacacgcccgagggcaucauccccgcccuguucgagccggagcgcgagaaguccgccgcgaucgacggcgaguaccggcucaagggggagagccgcaagaccuucgucgagcugaugcggcgcggcgaccugcccguguggcucgcccacaaggucgccuccgaggggaucaaguacaccgaccggaaguggugcuucgacggcgagcgcaacaaccagauccuggaggagaacauggacguggagaucuggaccaaggagggcgagcggaagaagcugcgcccccgcuggcucgacgcccggaccuacagcgacccccuggcccugaaggaguucaaggacuucgcggccgggcgcaaguccaucgcccucgaccuggugacggagaucggccgggucccgagccaccuggcccaccgcacccggaacgcccucgacaaccuggugaugcugcacaccuccgagcacgggggccgcgcguaccggcacgccguggaggagcuccccgagaccauggagacgcugcugcuccuggggcugaugauccuccugaccggcggcgccaugcuguuccucaucagcgggaagggcaucgggaagaccagcaucggccugaucugcgucaucguguccagcgggaugcuguggauggccgacgugccccuccaguggaucgccuccgcgaucguccuggaguucuucaugauggugcugcucaucccggagcccgagaagcagcgcacgccccaggacaaccagcuggccuacguggucaucggcauccugacgcucgccgccaucguggccgcgaacgagaugggccugcuggagaccaccaagcgggaccucgggaugagcaaggagcccggcguggucuccccgaccagcuaccuggacguggaccugcaccccgccuccgccuggacgcucuacgccguggcgaccaccgucaucacccccaugcugcgccacacgaucgagaacagcaccgccaacgugucccuggccgccaucgccaaccaggcggugguccucauggggcuggacaagggcuggcccaucagcaagauggaccugggggugccgcuccuggcccugggcugcuacucccaggugaacccccucacccugaccgccgccguccugcuccuggugacgcacuacgccaucaucggccccgggcugcaggcgaaggccacccgggaggcccagaagcgcaccgccgccggcaucaugaagaaccccaccguggacgggaucaugacgaucgaccucgacccggucaucuacgacagcaaguucgagaagcagcugggccaggugaugcugcucgugcugugcgcgguccagcugcuccugaugcggaccuccugggcccugugcgaggcccucacccuggccaccggccccaucacgacccugugggaggggagccccggcaaguucuggaacaccaccaucgcgguguccauggccaacaucuuccgcgggagcuaccucgccggcgccgggcuggccuucuccaucaugaaguccgugggcacgggcaagcgggggaccggcucccagggggagacccugggcgagaaguggaagaagaagcucaaccagcugagccgccgggaguucgagcuguacaagaaguccgggaucaccgaggucgaccgcacggaggcgaaggagggccucaagcggggcgagaccacccaccacgccgugucccgcgggagcgccaagcugcagugguucguggagcggaacauggucauccccgagggccgcgugaucgaccuggggugcggccgcgggggcugguccuacuacugcgccggccucaagaaggugaccgagguccggggguacaccaagggcgggccgggccacgaggagcccgugcccaugagcacguacggguggaacaccgugaagcugauguccggcaaggacgucuucuaccugcccccggagaagugcgacacccugcucugcgacaucggcgagagcucccccagccccaccguggaggagucccgcacgauccgggugcugaagauggucgagcccuggcugaagaacaaccaguucugcaucaaggugcucaacccguacaugcccaccgugaucgagcaccuggagcgccugcagcggaagcacgggggcaugcucguccgcaacccccugagccggaacuccacccacgagauguacuggaucagcaacgggaccggcaacaucguguccagcgugaacauggucucccgccugcuccugaaccgguucacgaugacccaccgccggcccaccaucgagaaggacguggaccugggcgccgggacccgccacgucaacgcggagccggagacgcccaacauggacgugaucggcgagcggaucaagcgcaucaaggaggagcacagcuccaccuggcacuacgacgacgagaaccccuacaagaccugggccuaccacgggagcuacgaggugaaggccaccggcuccgccagcagcaugaucaacggggucgugaagcuccugacgaagccgugggacgugguccccauggugacccagauggccaugaccgacaccacgcccuucggccagcagcggguguucaaggagaaggucgacacccgcacgccccggccgaugcccggcacccgcaaggugauggagaucaccgcggaguggcuguggcggacccucgggcgcaacaagcgcccccggcugugcacccgcgaggaguucaccaagaaggugcggacgaacgccgccaugggcgccgucuucaccgaggagaaccagugggaguccgcgcgcgccgccguggaggacgaggaguucuggaagcugguggggcgggagcgcgagcuccacaagcugggcaagugcgggagcugcgucuacaacaugaugggcaagcgggagaagaagcugggcgaguucgggaaggccaagggcucccgcgccaucugguacauguggcucggggcgcgguaccuggaguucgaggcccugggcuuccucaacgaggaccacugguucagccgcgagaacuccuacagcgggguggagggcgagggccugcacaagcugggguacauccuccgggacaucuccaagauccccggcggggccauguacgccgacgacaccgccggcugggacacccgcaucacggaggacgaccugcacaacgaggagaagaucacccagcagauggacccggagcaccggcagcuggcgaacgccaucuucaagcucaccuaccagaacaagguggucaaggugcagcgccccacccccaagggcacggugauggacaucaucagccggaaggaccagcgcggguccggccaggucgggaccuacggccugaacaccuucaccaacauggaggcccagcugauccggcagauggagggggagggcgugcucagcaaggccgaccuggagaacccccaccuccucgagaagaagaucacccaguggcuggagacgaagggcguggagcgccugaagcggauggccaucuccggggacgacugcgucgugaagccgaucgacgaccgcuucgcgaacgcccuccuggcccugaacgacaugggcaaggugcggaaggacaucccccaguggcagcccagcaagggguggcacgacuggcagcagguccccuucugcucccaccacuuccacgagcucaucaugaaggacggccgcaagcugguggugccgugccgcccccaggacgagcugaucgggcgggcccgcaucagccagggcgccggcuggucccucaaggagaccgcgugccuggggaaggccuacgcccagauguggagccugauguacuuccaccggcgcgaccuccggcuggccuccaacgcgaucugcagcgccguccccgugcacugggugcccaccucccgcaccacguggagcauccacgcccaccaccaguggaugaccaccgaggacaugcugaccgucuggaaccggguguggaucgaggacaacccguggauggaggacaagacgcccgugaccaccugggaggacguccccuaccucggcaagcgcgaggaccaguggugcgggagccugaucggccugaccucccgggccacgugggcccagaacauccucaccgcgauccagcagguccgcagccugaucggggacgaggaguuccuggacuacaugcccuccaugaagcgguuccgcaaggaggaggagagcgagggcgccaucugguga

SEQ ID NO: 10342 - RNA, 9873 nt, Artificial Sequence
  derived and/or modified CDS sequence (opt1) from DENV-3__KJ622193__SS-prME
accagccugugccucaugaugaugcugcccgccacccuggccuuccaccucaccagccgggacggcgagccccggaugaucguggggaagaacgagcggggcaagagccugcuguucaagaccgcgagcgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggacgugcaaccaggccggcgagcaccggcgcgacaagcgguccguggcccuggcgccccacgugggcauggggcuggacacccgcacccagaccuggaugagcgccgagggcgccuggcgccagguggagaagguggagacgugggcccuccgccaccccggguucaccauccuggcgcuguuccucgcccacuacaucggcaccucccugacccagaagguggugaucuucauccugcucaugcuggucacgcccagcauggccaugcggugcgugggggugggcaaccgcgacuucgucgagggccuguccggggccaccuggguggacgugguccucgagcacggcgggugcgugaccaccauggccaagaacaagcccacgcuggacaucgagcugcagaagaccgaggcgacccagcucgccacccugcggaagcugugcaucgagggcaagaucacgaacaucaccaccgacagccgcugccccacccagggcgaggccauccuccccgaggagcaggaccagaacuacgugugcaagcacacguacgucgaccggggguggggcaacgggugcggccuguucgggaagggcucccuggugaccugcgccaaguuccagugccucgagagcaucgagggcaaggugguccagcacgagaaccugaaguacaccgugaccaucacggugcacaccggggaccagcaccaggucggcaacgacacccagggggugaccgccgagaucacgccccaggcguccaccgucgaggccauccugcccgaguacggcacccucgggcuggagugcagcccccgcaccggccuggacuucaacgagaugauccuccugaccaugaagaacaaggccuggauggugcaccggcagugguucuucgaccugccgcuccccuggacguccggcgccaucaccgagacccccaccuggaaccgcaaggagcugcuggugacguucaagaacgcccacgcgaagaagcagggggucguggugcucggcagccaggagggggccaugcacaccgcccugaccggcgccaccgagauccagaacuccgggggcacgagcaucuucgccggccaccugaagugccggcucaagauggacaagcuggagcugaaggggauguccuacgcgaugugccucaacaccuucguccugaagaaggaggugagcgagacccagcacggcaccauccugaucaagguggaguacaagggggaggacgcccccugcaagaucccguucagcacggaggacggccagggcaaggcccacaacgggcgccugaucaccgccaaccccgucgugaccaagaaggaggagcccgugaacaucgaggcggagcccccguucggcgaguccaacaucgucaucgggaucggcgacaaggcccucaagaucaacugguacaagaaggggagcuccaucggcaagauguucgaggccaccgcccggggcgcccgccggauggcgauccugggggacacggccugggacuucggcagcgucggcggggugcugaacucccucgggaagaugguccaccagaucuucgggagcgccuacaccgcccuguucggcgggguguccuggaucaugaagaucggcaucggggugcugcucaccuggaucggccugaacagcaagaacaccuccaugagcuucuccugcaucgucaucgggaucaucacgcuguaccucggcaccguggugcaggccgacaugggcugcgucaucaacuggaaggggaaggagcugaagugcggcagcgggaucuucgugaccaacgaggugcacaccuggacggagcaguacaaguuccaggcggacucccccaagcgccuggccaccgccaucgccggcgccugggagaacggggucugcggcauccgcagcaccacccggauggagaaccuccuguggaagcagaucgcgaacgagcugaacuacauccucugggagaacaacaucaagcugacggugguggucggcgacaucaucggggugcuggagcagggcaagcgcacccucacgccccagcccauggagcugaaguacuccuggaagaccugggggaaggccaagaucgugacggccgagauccagaacagcuccuucaucaucgacggcccgaacacccccgagugccccagcgccucccgggcguggaacgucugggagguggaggacuacggcuucgggguguucaccaccaacaucuggcugaagcuccgcgaggucuacacgcagaccugcgaccaccggcugaugagcgccgccaucaaggacgagcgcgccgugcacgccgacaugggcuacuggaucgagagccagaagaacggguccuggaagcuggagaaggcgagcuucaucgaggugaagaccugcaccuggcccaagucccacacccucuggagcaacggcguccuggaguccgacaugaucauccccaagagccuggccgggcccaucucccagcacaaccaccggcccggcuaccacacgcagaccgccggcccguggcaccucgggaagcuggagcuggacuucaacuacugcgagggcaccaccguggugaucacggagaacugcgggacccgcggccccagccuccggaccaccacggucuccgggaagcugauccacgaguggugcugccgcagcugcacccugccgccccugcgguacaugggcgaggacggcugcugguacgggauggagauccgcccgaucaacgagaaggaggagaacauggugaagucccuggugagcgccggcuccgggaaggucgacaacuucaccaugggcgugcugugccucgccauccuguucgaggaggugaugcgggggaaguucggcaagaagcacaugaucgcgggcguccugcucaccuucaugcugcugcucagcgggcagaucacguggcgcgacauggcccacacccugaucaugaucggcuccaacgccagcgaccggauggggaugggcgugaccuaccuggcccucaucgccaccuucaagauccagcccuuccuggcgcugggcuucuuccuccgcaagcugacgucccgggagaaccugcuccugggggugggccuggccauggccaccacccuccagcugcccgaggacaucgagcagauggccaacgggaucgcgcugggccucauggcccugaagcugaucacccaguucgagacguaccagcucuggaccgcccuggucagccugaccugcagcaacaccaucuucacgcucaccguggccuggcgcaccgccacccugauccuggcgggggugucccuccugcccgucugccagagcuccagcaugcggaagacggacuggcugccgguggccgucgccgccaugggcgugccgccccucccccuguucaucuucucccugaaggacacccucaagcgccgcagcuggccgcugaacgagggcgugauggccgucgggcugguguccauccucgcgagcucccugcugcggaacgacgugcccauggccggcccccucgucgccgggggccugcugaucgccugcuacgugaucaccgggaccagcgccgaccucacgguggagaaggcggccgacgucaccugggaggaggaggccgagcagaccggcgugucccacaaccugaugaucaccguggacgacgacggcacgaugcgcaucaaggacgacgagaccgagaacauccugaccguccuccugaagaccgcccugcucaucgugagcgggaucuuccccuacuccaucccggccacccugcugguguggcacacguggcagaagcagacccagcggagcggcguccucugggacgugcccagcccgcccgagacccagaaggcggagcuggaggaggggguguaccgcaucaagcagcagggcaucuucgggaagacccaggucggcgugggcgugcagaaggagggggucuuccacacgauguggcacgugacccggggcgccgugcugacccacaacgggaagcgccucgagccgaacugggccagcgucaagaaggaccugaucuccuacggcgggggcuggcggcugagcgcccaguggcagaagggcgaggagguccaggugaucgcggucgagcccgggcgcaaccccaagaacuuccagaccaugcccggcaucuuccagacgaccaccggggagaucggcgccaucgcccuggacuucaagccgggcaccuccgggagccccaucaucaaccgggagggcaaggugguggggcucuacggcaacggggucgugacgaagaacggcggcuacgugagcgggaucgcccaggccaacgcggagcccgacggcccgacccccgagcuggaggaggagauguucaagaagcgcaaccugaccaucauggaccuccaccccggguccggcaagacccggaaguaccugcccgccaucguccgcgaggccaucaagcggcgccugcggacgcucauccuggccccgacccgcgugguggccgcggagauggaggaggcccugaaggggcuccccauccgguaccagaccaccgccaccaaguccgagcacaccggccgcgagaucgucgaccugaugugccacgccaccuucaccaugcggcugcucucccccgugcgcgugcccaacuacaaccugaucaucauggacgaggcccacuucacggacccggcgagcaucgccgcccggggcuacaucuccacccgcgucgggaugggcgaggccgcggccaucuucaugaccgccacgccgcccgggacggccgaggccuucccccagagcaacgcgccgauccaggacgaggagcgcgacauccccgagcgguccuggaacagcggcaacgaguggaucaccgacuucguggggaagaccgugugguucguccccuccaucaaggccggcaacgacaucgccaacugccugcgcaagaacggcaagaaggugauccagcucagccggaagaccuucgacacggaguaccagaagaccaagcugaacgacugggacuucguggucaccaccgacaucuccgagaugggggccaacuucaaggccgaccgcgugaucgacccccggcgcugccugaagccggugauccucacggacggccccgagcgggucauccuggcggggcccaugcccgugaccgccgccagcgccgcccagcgccggggccgcguggggcggaacccgcagaaggagaacgaccaguacaucuucaccggccagccccugaacaacgacgaggaccacgcgcacuggaccgaggccaagaugcuccuggacaacaucaacacgcccgagggcaucauccccgcccuguucgagccggagcgcgagaaguccgccgcgaucgacggggaguaccggcucaagggcgagagccgcaagaccuucgucgagcugaugcggcgcggggaccugcccguguggcucgcccacaaggucgccuccgagggcaucaaguacaccgaccggaaguggugcuucgacggcgagcgcaacaaccagauccuggaggagaacauggacguggagaucuggaccaaggagggggagcggaagaagcugcgcccccgcuggcucgacgcccggaccuacagcgacccccuggcccugaaggaguucaaggacuucgcggccggccgcaaguccaucgcccucgaccuggugacggagaucgggcgggucccgagccaccuggcccaccgcacccggaacgcccucgacaaccuggugaugcugcacaccuccgagcacggcgggcgcgcguaccggcacgccguggaggagcuccccgagaccauggagacgcugcugcuccugggccugaugauccuccugaccggcggggccaugcuguuccucaucagcggcaaggggaucggcaagaccagcaucgggcugaucugcgucaucguguccagcggcaugcuguggauggccgacgugccccuccaguggaucgccuccgcgaucguccuggaguucuucaugauggugcugcucaucccggagcccgagaagcagcgcacgccccaggacaaccagcuggccuacguggucaucggcauccugacgcucgccgccaucguggccgcgaacgagauggggcugcuggagaccaccaagcgggaccucggcaugagcaaggagcccgggguggucuccccgaccagcuaccuggacguggaccugcaccccgccuccgccuggacgcucuacgccguggcgaccaccgucaucacccccaugcugcgccacacgaucgagaacagcaccgccaacgugucccuggccgccaucgccaaccaggcggugguccucaugggccuggacaagggguggcccaucagcaagauggaccugggcgugccgcuccuggcccugggcugcuacucccaggugaacccccucacccugaccgccgccguccugcuccuggugacgcacuacgccaucaucgggcccggccugcaggcgaaggccacccgggaggcccagaagcgcaccgccgccgggaucaugaagaaccccaccguggacggcaucaugacgaucgaccucgacccggucaucuacgacagcaaguucgagaagcagcugggccaggugaugcugcucgugcugugcgcgguccagcugcuccugaugcggaccuccugggcccugugcgaggcccucacccuggccaccgggcccaucacgacccugugggagggcagccccgggaaguucuggaacaccaccaucgcgguguccauggccaacaucuuccgcggcagcuaccucgccggggccggccuggccuucuccaucaugaaguccgugggcacggggaagcggggcaccgggucccagggcgagacccugggggagaaguggaagaagaagcucaaccagcugagccgccgggaguucgagcuguacaagaaguccggcaucaccgaggucgaccgcacggaggcgaaggagggccucaagcgcggggagaccacccaccacgccgugucccgcggcagcgccaagcugcagugguucguggagcggaacauggucauccccgaggggcgcgugaucgaccugggcugcgggcgcggcggcugguccuacuacugcgccgggcucaagaaggugaccgagguccggggcuacaccaagggcggcccggggcacgaggagcccgugcccaugagcacguacggcuggaacaccgugaagcugauguccggcaaggacgucuucuaccugcccccggagaagugcgacacccugcucugcgacaucggggagagcucccccagccccaccguggaggagucccgcacgauccgggugcugaagauggucgagcccuggcugaagaacaaccaguucugcaucaaggugcucaacccguacaugcccaccgugaucgagcaccuggagcgccugcagcggaagcacggcgggaugcucguccgcaacccccugagccggaacuccacccacgagauguacuggaucagcaacggcaccggcaacaucguguccagcgugaacauggucucccgccugcuccugaaccgguucacgaugacccaccgccggcccaccaucgagaaggacguggaccugggggccggcacccgccacgucaacgcggagccggagacgcccaacauggacgugaucggggagcggaucaagcgcaucaaggaggagcacagcuccaccuggcacuacgacgacgagaaccccuacaagaccugggccuaccacggcagcuacgaggugaaggccaccggguccgccagcagcaugaucaacggcgucgugaagcuccugacgaagccgugggacgugguccccauggugacccagauggccaugaccgacaccacgcccuucggccagcagcggguguucaaggagaaggucgacacccgcacgccccggccgaugcccgggacccgcaaggugauggagaucaccgcggaguggcuguggcggacccucggccgcaacaagcgcccccggcugugcacccgcgaggaguucaccaagaaggugcggacgaacgccgccaugggggccgucuucaccgaggagaaccagugggaguccgcgcgcgccgccguggaggacgaggaguucuggaagcuggugggccgggagcgcgagcuccacaagcuggggaagugcggcagcugcgucuacaacaugaugggcaagcgggagaagaagcugggggaguucggcaaggccaaggggucccgcgccaucugguacauguggcucggcgcgcgguaccuggaguucgaggcccugggguuccucaacgaggaccacugguucagccgcgagaacuccuacagcggcguggagggcgaggggcugcacaagcugggcuacauccuccgggacaucuccaagauccccgggggcgccauguacgccgacgacaccgccggcugggacacccgcaucacggaggacgaccugcacaacgaggagaagaucacccagcagauggacccggagcaccggcagcuggcgaacgccaucuucaagcucaccuaccagaacaagguggucaaggugcagcgccccacccccaaggggacggugauggacaucaucagccggaaggaccagcgcggcuccgggcaggucggcaccuacgggcugaacaccuucaccaacauggaggcccagcugauccggcagauggagggcgagggcgugcucagcaaggccgaccuggagaacccccaccuccucgagaagaagaucacccaguggcuggagacgaaggggguggagcgccugaagcggauggccaucuccggcgacgacugcgucgugaagccgaucgacgaccgcuucgcgaacgcccuccuggcccugaacgacauggggaaggugcggaaggacaucccccaguggcagcccagcaagggcuggcacgacuggcagcagguccccuucugcucccaccacuuccacgagcucaucaugaaggacgggcgcaagcugguggugccgugccgcccccaggacgagcugaucggccgggcccgcaucagccagggcgccggguggucccucaaggagaccgcgugccugggcaaggccuacgcccagauguggagccugauguacuuccaccggcgcgaccuccggcuggccuccaacgcgaucugcagcgccguccccgugcacugggugcccaccucccgcaccacguggagcauccacgcccaccaccaguggaugaccaccgaggacaugcugaccgucuggaaccggguguggaucgaggacaacccguggauggaggacaagacgcccgugaccaccugggaggacguccccuaccucgggaagcgcgaggaccaguggugcggcagccugaucgggcugaccucccgggccacgugggcccagaacauccucaccgcgauccagcagguccgcagccugaucggcgacgaggaguuccuggacuacaugcccuccaugaagcgguuccgcaaggaggaggagagcgagggcgccaucugguga

SEQ ID NO: 10343 - RNA, 9873 nt, Artificial Sequence
  derived and/or modified CDS sequence (opt1) from DENV-3__KJ622194__SS-prME
accagccugugccucaugaugaugcugcccgccacccuggccuuccaccucaccucccgggacggcgagccccggaugaucguggggaagaacgagcggggcaagagccugcuguucaagaccgcguccgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgccgagggcgccuggcgccagguggagaaggucgagacgugggcccuccgccaccccggguucaccauccuggcgcuguuccucgcccacuacaucggcaccucccugacccagaagguggugaucuucauccugcucaugcuggucacgcccagcauggccaugcggugcgugggggugggcaaccgcgacuucgucgagggccuguccggggccaccuggguggacgugguccucgagcacggcgggugcgugaccaccauggccaagaacaagcccacgcuggacaucgagcugcagaagaccgaggcgacccagcucgccacccugcggaagcugugcaucgagggcaagaucacgaacaucaccaccgacagccgcugccccacccagggcgaggccauccuccccgaggagcaggaccagaacuacgugugcaagcacacguacgucgaccggggguggggcaacgggugcggccuguucgggaagggcucccuggugaccugcgccaaguuccagugccucgagagcaucgagggcaaggugguccagcacgagaaccugaaguacaccgugaccaucacggugcacaccggggaccagcaccaggucggcaacgacacccagggggugaccgccgagaucacgccccaggcguccaccgucgaggccauccugcccgaguacggcacccucgggcuggagugcagcccccgcaccggccuggacuucaacgagaugauccuccugaccaugaagaacaaggccuggauggugcaccggcagugguucuucgaccugccgcuccccuggacguccggcgccaucaccgagacccccaccuggaaccgcaaggagcugcuggugacguucaagaacgcccacgcgaagaagcaggaggucguggugcucgggagccaggagggcgccaugcacaccgcccugaccggggccaccgagauccagaacuccggcgggacgagcaucuucgccggccaccugaagugccggcucaagauggacaagcuggagcugaagggcauguccuacgcgaugugccucaacaccuucguccugaagaaggaggugagcgagacccagcacgggaccauccugaucaagguggaguacaagggcgaggacgcccccugcaagaucccguucagcacggaggacgggcagggcaaggcccacaacggccgccugaucaccgccaaccccgucgugaccaagaaggaggagcccgugaacaucgaggcggagcccccguucggggaguccaacaucgucaucggcaucggggacaaggcccucaagaucaacugguacaagaagggcagcuccaucgggaagauguucgaggccaccgcccggggcgcccgccggauggcgauccugggcgacacggccugggacuucgggagcgugggcggggugcugaacucccucggcaagaugguccaccagaucuucgggagcgccuacaccgcccuguucggcggcguguccuggaucaugaagaucgggaucggcgugcugcucaccuggaucgggcugaacagcaagaacaccuccaugagcuucuccugcaucgucaucggcaucaucacgcuguaccucgggaccguggugcaggccgacaugggcugcgucaucaacuggaagggcaaggagcugaagugcgggagcggcaucuucgugaccaacgaggugcacaccuggacggagcaguacaaguuccaggcggacucccccaagcgccuggccaccgccaucgccggggccugggagaacggcgucugcgggauccgcagcaccacccggauggagaaccuccuguggaagcagaucgcgaacgagcugaacuacauccucugggagaacaacaucaagcugacggugguggucggcgacaucaucggcgugcuggagcaggggaagcgcacccucacgccccagcccauggagcugaaguacuccuggaagaccuggggcaaggccaagaucgugacggccgagauccagaacagcuccuucaucaucgacgggccgaacacccccgagugccccagcgccucccgggcguggaacgucugggagguggaggacuacggcuucggcguguucaccaccaacaucuggcugaagcuccgcgaggucuacacgcagaccugcgaccaccggcugaugagcgccgccaucaaggacgagcgcgccgugcacgccgacaugggguacuggaucgagagccagaagaacggcuccuggaagcuggagaaggcgagcuucaucgaggugaagaccugcaccuggcccaagucccacacccucuggagcaacgggguccuggaguccgacaugaucauccccaagagccuggccggccccaucucccagcacaaccaccggcccggguaccacacgcagaccgccggcccguggcaccucggcaagcuggagcuggacuucaacuacugcgaggggaccaccguggugaucacggagaacugcggcacccgcgggcccagccuccggaccaccacggucuccggcaagcugauccacgaguggugcugccgcagcugcacccugccgccccugcgguacaugggggaggacggcugcugguacggcauggagauccgcccgaucaacgagaaggaggagaacauggugaagucccuggugagcgccggguccggcaaggucgacaacuucaccaugggggugcugugccucgccauccuguucgaggaggugaugcggggcaaguucgggaagaagcacaugaucgcgggcguccugcucaccuucaugcugcugcucagcggccagaucacguggcgcgacauggcccacacccugaucaugaucggguccaacgccagcgaccggaugggcaugggggugaccuaccuggcccucaucgccaccuucaagauccagcccuuccuggcgcugggcuucuuccuccgcaagcugacgucccgggagaaccugcuccugggcguggggcuggccauggccaccacccuccagcugcccgaggacaucgagcagauggccaacggcaucgcgcuggggcucauggcccugaagcugaucacccaguucgagacguaccagcucuggaccgcccuggucagccugaccugcagcaacaccaucuucacgcucaccguggccuggcgcaccgccacccugauccuggcgggcgugucccuccugcccgucugccagagcuccagcaugcggaagacggacuggcugccgguggccgucgccgccaugggggugccgccccucccccuguucaucuucucccugaaggacacccucaagcgccgcagcuggccgcugaacgagggcgugauggccgucggccugguguccauccucgcgagcucccugcugcggaacgacgugcccauggccgggccccucgucgccggcgggcugcugaucgccugcuacgugaucaccggcaccagcgccgaccucacgguggagaaggcggccgacgucaccugggaggaggaggccgagcagaccggggugucccacaaccugaugaucaccguggacgacgacggcacgaugcgcaucaaggacgacgagaccgagaacauccugaccguccuccugaagaccgcccugcucaucgugagcggcaucuuccccuacuccaucccggccacccugcugguguggcacacguggcagaagcagacccagcggagcgggguccucugggacgugcccagcccgcccgagacccagaaggcggagcuggaggagggcguguaccgcaucaagcagcaggggaucuucggcaagacccaggucggggugggcgugcagaaggagggcgucuuccacacgauguggcacgugacccgcggggccgugcugacccacagcggcaagcgccucgagccgaacugggccuccgucaagaaggaccugaucagcuacgggggcggguggcggcuguccgcccaguggcagaagggcgaggagguccaggugaucgcggucgagcccggccgcaaccccaagaacuuccagaccaugcccgggaucuuccagacgaccaccggcgagaucggggccaucgcccuggacuucaagccgggcaccagcggcagccccaucaucaaccgggaggggaagguggugggccucuacgggaacggcgucgugacgaagaacgggggcuacguguccggcaucgcccaggccaacgcggagcccgacgggccgacccccgagcuggaggaggagauguucaagaagcgcaaccugaccaucauggaccuccaccccggcagcgggaagacccggaaguaccugcccgccaucguccgcgaggccaucaagcggcgccugcggacgcucauccuggccccgacccgcgugguggccgcggagauggaggaggcccugaagggccuccccauccgguaccagaccaccgccacgaaguccgagcacaccgggcgcgagaucgucgaccugaugugccacgccaccuucaccaugcggcugcucagccccgugcgcgugcccaacuacaaccugaucaucauggacgaggcccacuucacggacccggcguccaucgccgcccggggcuacaucagcacccgcgucggcaugggggaggccgcggccaucuucaugaccgccacgccgcccggcacggccgaggccuucccccaguccaacgcgccgauccaggacgaggagcgcgacauccccgagcggagcuggaacuccgggaacgaguggaucaccgacuucgugggcaagaccgugugguucguccccagcaucaaggccgggaacgacaucgccaacugccugcgcaagaacggcaagaaggugauccagcucucccggaagaccuucgacacggaguaccagaagaccaagcugaacgacugggacuucguggucaccaccgacaucagcgagaugggcgccaacuucaaggccgaccgcgugaucgacccccggcgcugccugaagccggugauccucacggacgggcccgagcgggucauccuggcgggccccaugcccgugaccgccgccuccgccgcccagcgccgggggcgcgugggccggaacccgcagaaggagaacgaccaguacaucuucaccgggcagccccugaacaacgacgaggaccacgcgcacuggaccgaggccaagaugcuccuggacaacaucaacacgcccgagggcaucauccccgcccuguucgagccggagcgcgagaaguccgccgcgaucgacggcgaguaccggcucaagggggagucccgcaagaccuucgucgagcugaugcggcgcggcgaccugcccguguggcucgcccacaaggucgccagcgaggggaucaaguacaccgaccggaaguggugcuucgacggcgagcgcaacaaccagauccuggaggagaacauggacguggagaucuggaccaaggagggcgagcggaagaagcugcgcccccgcuggcucgacgcccggaccuacuccgacccccuggcccugaaggaguucaaggacuucgcggccgggcgcaagagcaucgcccucgaccuggugacggagaucggccgggucccgucccaccuggcccaccgcacccggaacgcccucgacaaccuggugaugcugcacaccagcgagcacgggggccgcgcguaccggcacgccguggaggagcuccccgagaccauggagacgcugcugcuccuggggcugaugauccuccugaccggcggcgccaugcuguuccucaucagcgggaagggcaucgggaagaccuccaucggccugaucugcgucaucgugagcuccgggaugcuguggauggccgacgugccccuccaguggaucgccagcgcgaucguccuggaguucuucaugauggugcugcucaucccggagcccgagaagcagcgcacgccccaggacaaccagcuggccuacguggucaucggcauccugacgcucgccgccaucguggccgcgaacgagaugggccugcuggagaccaccaagcgggaccucgggauguccaaggagcccggcguggucagcccgaccuccuaccuggacguggaccugcaccccgccagcgccuggacgcucuacgccguggcgaccaccgucaucacccccaugcugcgccacacgaucgagaacuccaccgccaacgugagccuggccgccaucgccaaccaggcggugguccucauggggcuggacaagggcuggcccaucuccaagauggaccugggggugccgcuccuggcccugggcugcuacagccaggugaacccccucacccugaccgccgccguccugcuccuggugacgcacuacgccaucaucggccccgggcugcaggcgaaggccacccgggaggcccagaagcgcaccgccgccggcaucaugaagaaccccaccguggacgggaucaugacgaucgaccucgacccggucaucuacgacuccaaguucgagaagcagcugggccaggugaugcugcucgugcugugcgcgguccagcugcuccugaugcggaccagcugggcccugugcgaggcccucacccuggccaccggccccaucacgacccugugggaggggucccccggcaaguucuggaacgcgaccaucgccgugagcauggccaacaucuuccgcggguccuaccucgccggcgccgggcuggcguucagcaucaugaaguccgugggcaccggcaagcgggggacgggcagccagggggagacccugggcgagaaguggaagaagaagcucaaccagcugagccgccgggaguucgagcuguacaagaaguccgggaucaccgaggucgaccgcaccgaggccaaggagggccucaagcggggcgagacgacccaccacgccgugagccgcggguccgccaagcugcagugguucguggagcggaacauggucauccccgagggccgcgugaucgaccuggggugcggccgcgggggcuggagcuacuacugcgccggccucaagaaggugaccgagguccggggguacaccaagggcgggccgggccacgaggagcccgugcccauguccaccuacggguggaacacggugaagcugaugagcggcaaggacgucuucuaccugcccccggagaagugcgacacccugcucugcgacaucggcgaguccagccccucccccaccguggaggagagccgcaccauccgggugcugaagauggucgagcccuggcugaagaacaaccaguucugcaucaaggugcucaacccguacaugcccacggugaucgagcaccuggagcgccugcagcggaagcacgggggcaugcucguccgcaacccccugucccggaacagcacccacgagauguacuggaucuccaacgggaccggcaacaucgugagcuccgugaacauggucagccgccugcuccugaaccgguucaccaugacgcaccgccggcccaccaucgagaaggacguggaccugggcgcggggacccgccacgucaacgccgagccggagacccccaacauggacgugaucggcgagcggaucaagcgcaucaaggaggagcacuccagcacguggcacuacgacgacgagaaccccuacaagaccugggccuaccacggguccuacgaggugaaggccaccggcagcgccagcuccaugaucaacggggucgugaagcuccugaccaagccgugggacgugguccccauggugacgcagauggcgaugaccgacaccacccccuucggccagcagcggguguucaaggagaaggucgacacgcgcacgccccggccgaugcccggcacccgcaaggugauggagaucaccgccgaguggcuguggcggacccucgggcgcaacaagcgcccccggcugugcacccgcgaggaguucaccaagaaggugcggaccaacgccgccaugggcgcggucuucacggaggagaaccagugggagagcgcccgcgccgccguggaggacgaggaguucuggaagcugguggggcgggagcgcgagcuccacaagcugggcaagugcggguccugcgucuacaacaugaugggcaagcgggagaagaagcugggcgaguucgggaaggccaagggcagccgcgcgaucugguacauguggcucggggcccgguaccuggaguucgaggcccugggcuuccucaacgaggaccacugguucucccgcgagaacagcuacuccgggguggagggcgagggccugcacaagcugggguacauccuccgggacaucagcaagauccccggcggggccauguacgccgacgacaccgcgggcugggacacccgcaucaccgaggacgaccugcacaacgaggagaagaucacgcagcagauggacccggagcaccggcagcuggccaacgccaucuucaagcucaccuaccagaacaagguggucaaggugcagcgccccacccccaagggcaccgugauggacaucaucucccggaaggaccagcgcgggagcggccaggucgggacguacggccugaacaccuucaccaacauggaggcccagcugauccggcagauggagggggagggcgugcucuccaaggccgaccuggagaacccccaccuccucgagaagaagaucacccaguggcuggagaccaagggcguggagcgccugaagcggauggcgaucagcggggacgacugcgucgugaagccgaucgacgaccgcuucgccaacgcccuccuggcccugaacgacaugggcaaggugcggaaggacaucccccaguggcagcccuccaagggguggcacgacuggcagcagguccccuucugcagccaccacuuccacgagcucaucaugaaggacggccgcaagcugguggugccgugccgcccccaggacgagcugaucgggcgggcccgcaucucccagggcgcgggcuggagccucaaggagacggccugccuggggaaggccuacgcccagauguggucccugauguacuuccaccggcgcgaccuccggcuggcgagcaacgccaucugcuccgccguccccgugcacugggugcccaccagccgcaccaccuggagcauccacgcccaccaccaguggaugacgaccgaggacaugcugaccgucuggaaccggguguggaucgaggacaacccguggauggaggacaagacccccgugacgaccugggaggacguccccuaccucggcaagcgcgaggaccaguggugcgggucccugaucggccugaccagccgggccaccugggcgcagaacauccucacggccauccagcagguccgcucccugaucggggacgaggaguuccuggacuacaugcccagcaugaagcgguuccgcaaggaggaggaguccgagggcgccaucugguga

SEQ ID NO: 10344 - RNA, 9873 nt, Artificial Sequence
  derived and/or modified CDS sequence (opt1) from DENV-3__KJ622195__SS-prME
accagccugugccucaugaugaugcugcccgccacccuggccuuccaccucaccagccgggacggcgagccccggaugaucguggggaagaacgagcggggcaagagccugcuguucaagaccgcgagcgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggacgugcaaccaggccggcgagcaccggcgcgacaagcgguccguggcccuggcgccccacgugggcauggggcuggacacccgcacccagaccuggaugagcgccgagggcgccuggcgccagguggagaaggucgagacgugggcccuccgccaccccggguucaccauccuggcgcuguuccucgcccacuacaucggcaccucccugacccagaagguggugaucuucauccugcucaugcuggucacgcccagcauggccaugcggugcgugggggugggcaaccgcgacuucgucgagggccuguccggggccaccuggguggacgugguccucgagcacggcgggugcgugaccaccauggccaagaacaagcccacgcuggacaucgagcugcagaagaccgaggcgacccagcucgccacccugcggaagcugugcaucgagggcaagaucacgaacaucaccaccgacagccgcugccccacccagggcgaggccauccuccccgaggagcaggaccagaacuacgugugcaagcacacguacgucgaccggggguggggcaacgggugcggccuguucgggaagggcucccuggugaccugcgccaaguuccagugccucgagagcaucgagggcaaggugguccagcacgagaaccugaaguacaccgugaccaucacggugcacaccggggaccagcaccaggucggcaacgacacccagggggugaccgccgagaucacgccccaggcguccaccgucgaggccauccugcccgaguacggcacccucgggcuggagugcagcccccgcaccggccuggacuucaacgagaugauccuccugaccaugaagaacaaggccuggauggugcaccggcagugguucuucgaccugccgcuccccuggacguccggcgccaucaccgagacccccaccuggaaccgcaaggagcugcuggugacguucaagaacgcccacgcgaagaagcaggaggucguggugcucgggagccaggagggcgccaugcacaccgcccugaccggggccaccgagauccagaacuccggcgggacgagcaucuucgccggccaccugaagugccggcucaagauggacaagcuggagcugaagggcauguccuacgcgaugugccucaacaccuucguccugaagaaggaggugagcgagacccagcacgggaccauccugaucaagguggaguacaagggcgaggacgcccccugcaagaucccguucagcacggaggacgggcagggcaaggcccacaacggccgccugaucaccgccaaccccgucgugaccaagaaggaggagcccgugaacaucgaggcggagcccccguucggggaguccaacaucgucaucggcaucggggacaaggcccucaagaucaacugguacaagaagggcagcuccaucgggaagauguucgaggccaccgcccggggcgcccgccggauggcgauccugggcgacacggccugggacuucgggagcgugggcggggugcugaacucccucggcaagaugguccaccagaucuucgggagcgccuacaccgcccuguucggcggcguguccuggaucaugaagaucgggaucggcgugcugcucaccuggaucgggcugaacagcaagaacaccuccaugagcuucuccugcaucgucaucggcaucaucacgcuguaccucgggaccguggugcaggccgacaugggcugcgucaucaacuggaagggcaaggagcugaagugcgggagcggcaucuucgugaccaacgaggugcacaccuggacggagcaguacaaguuccaggcggacucccccaagcgccuggccaccgccaucgccggggccugggagaacggcgucugcgggauccgcagcaccacccggauggagaaccuccuguggaagcagaucgcgaacgagcugaacuacauccucugggagaacaacaucaagcugacggugguggucggcgacaucaucggcgugcuggagcaggggaagcgcacccucacgccccagcccauggagcugaaguacuccuggaagaccuggggcaaggccaagaucgugacggccgagauccagaacagcuccuucaucaucgacgggccgaacacccccgagugccccagcgccucccgggcguggaacgucugggagguggaggacuacggcuucggcguguucaccaccaacaucuggcugaagcuccgcgaggucuacacgcagaccugcgaccaccggcugaugagcgccgccaucaaggacgagcgcgccgugcacgccgacaugggguacuggaucgagagccagaagaacggcuccuggaagcuggagaaggcgagcuucaucgaggugaagaccugcaccuggcccaagucccacacccucuggagcaacgggguccuggaguccgacaugaucauccccaagagccuggccggccccaucucccagcacaaccaccggcccggguaccacacgcagaccgccggcccguggcaccucggcaagcuggagcuggacuucaacuacugcgaggggaccaccguggugaucacggagaacugcggcacccgcgggcccagccuccggaccaccacggucuccggcaagcugauccacgaguggugcugccgcagcugcacccugccgccccugcgguacaugggggaggacggcugcugguacggcauggagauccgcccgaucaacgagaaggaggagaacauggugaagucccuggugagcgccggguccggcaaggucgacaacuucaccaugggggugcugugccucgccauccuguucgaggaggugaugcggggcaaguucgggaagaagcacaugaucgcgggcguccugcucaccuucaugcugcugcucagcggccagaucacguggcgcgacauggcccacacccugaucaugaucggguccaacgccagcgaccggaugggcaugggggugaccuaccuggcccucaucgccaccuucaagauccagcccuuccuggcgcugggcuucuuccuccgcaagcugacgucccgggagaaccugcuccugggcguggggcuggccauggccaccacccuccagcugcccgaggacaucgagcagauggccaacggcaucgcgcuggggcucauggcccugaagcugaucacccaguucgagacguaccagcucuggaccgcccuggucagccugaccugcagcaacaccaucuucacgcucaccguggccuggcgcaccgccacccugauccuggcgggcgugucccuccugcccgucugccagagcuccagcaugcggaagacggacuggcugccgguggccgucgccgccaugggggugccgccccucccccuguucaucuucucccugaaggacacccucaagcgccgcagcuggccgcugaacgagggcgugauggccgucggccugguguccauccucgcgagcucccugcugcggaacgacgugcccauggccgggccccucgucgccggcgggcugcugaucgccugcuacgugaucaccggcaccagcgccgaccucacgguggagaaggcggccgacgucaccugggaggaggaggccgagcagaccggggugucccacaaccugaugaucaccguggacgacgacggcacgaugcgcaucaaggacgacgagaccgagaacauccugaccguccuccugaagaccgcccugcucaucgugagcggcaucuuccccuacuccaucccggccacccugcugguguggcacacguggcagaagcagacccagcggagcgggguccucugggacgugcccagcccgcccgagacccagaaggcggagcuggaggagggcguguaccgcaucaagcagcaggggaucuucggcaagacccaggucggggugggcgugcagaaggagggcgucuuccacacgauguggcacgugacccgcggggccgugcugacccacaacggcaagcgccucgagccgaacugggccagcgucaagaaggaccugaucuccuacgggggcggguggcggcugagcgcccaguggcagaagggcgaggagguccaggugaucgcggucgagcccggccgcaaccccaagaacuuccagaccaugcccgggaucuuccagacgaccaccggcgagaucggggccaucgcccuggacuucaagccgggcaccuccggcagccccaucaucgaccgggaggggaagguggugggccucuacgggaacggcgucgugacgaagaacgggggcuacgugagcggcaucgcccaggccaacgcggagcccgacgggccgacccccgagcuggaggaggagauguucaagaagcgcaaccugaccaucauggaccuccaccccggcuccgggaagacccggaaguaccugcccgccaucguccgcgaggccaucaagcggcgccugcggacgcucauccuggccccgacccgcgugguggccgcggagauggaggaggcccugaagggccuccccauccgguaccagaccaccgccaccaaguccgagcacaccgggcgcgagaucgucgaccugaugugccacgccaccuucaccaugcggcugcucucccccgugcgcgugcccaacuacaaccugaucaucauggacgaggcccacuucacggacccggcgagcaucgccgcccggggcuacaucuccacccgcgucggcaugggggaggccgcggccaucuucaugaccgccacgccgcccggcacggccgaggccuucccccagagcaacgcgccgauccaggacgaggagcgcgacauccccgagcgguccuggaacagcgggaacgaguggaucaccgacuucgugggcaagaccgugugguucguccccuccaucaaggccgggaacgacaucgccaacugccugcgcaagaacggcaagaaggugauccagcucagccggaagaccuucgacacggaguaccagaagaccaagcugaacgacugggacuucguggucaccaccgacaucuccgagaugggcgccaacuucaaggccgaccgcgugaucgacccccggcgcugccugaagccggugauccucacggacgggcccgagcgggucauccuggcgggccccaugcccgugaccgccgccagcgccgcccagcgccgggggcgcgugggccggaacccgcagaaggagaacgaccaguacaucuucaccgggcagccccugaacaacgacgaggaccacgcgcacuggaccgaggccaagaugcuccuggacaacaucaacacgcccgagggcaucauccccgcccuguucgagccggagcgcgagaaguccgccgcgaucgacggcgaguaccggcucaagggggagagccgcaagaccuucgucgagcugaugcggcgcggcgaccugcccguguggcucgcccacaaggucgccuccgaggggaucaaguacaccgaccggaaguggugcuucgacggcgagcgcaacaaccagauccuggaggagaacauggacguggagaucuggaccaaggagggcgagcggaagaagcugcgcccccgcuggcucgacgcccggaccuacagcaacccccuggcccugaaggaguucaaggacuucgcggccgggcgcaaguccaucgcccucgaccuggugacggagaucggccgggucccgagccaccuggcccaccgcacccggaacgcccucgacaaccuggugaugcugcacaccuccgagcacgggggccgcgcguaccggcacgccguggaggagcuccccgagaccauggagacgcugcugcuccuggggcugaugauccuccugaccggcggcgccaugcuguuccucaucagcgggaagggcaucgggaagaccagcaucggccugaucugcgucaucguguccagcgggaugcuguggauggccgacgugccccuccaguggaucgccuccgcgaucguccuggaguucuucaugauggugcugcucaucccggagcccgagaagcagcgcacgccccaggacaaccagcuggccuacguggucaucggcauccugacgcucgccgccaucguggccgcgaacgagaugggccugcuggagaccaccaagcgggaccucgggaugagcaaggagcccggcguggucuccccgaccagcuaccuggacguggaccugcaccccgccuccgccuggacgcucuacgccguggcgaccaccgucaucacccccaugcugcgccacacgaucgagaacagcaccgccaacgugucccuggccgccaucgccaaccaggcggugguccucauggggcuggacaagggcuggcccaucagcaagauggaccugggggugccgcuccuggcccugggcugcuacucccaggugaacccccucacccugaccgccgccguccugcuccuggugacgcacuacgccaucaucggccccgggcugcaggcgaaggccacccgggaggcccagaagcgcaccgccgccggcaucaugaagaaccccaccguggacgggaucaugacgaucgaccucgacccggucaucuacgacagcaaguucgagaagcagcugggccaggugaugcugcucgugcugugcgcgguccagcugcuccugaugcggaccuccugggcccugugcgaggcccucacccuggccaccggccccaucacgacccugugggaggggagccccggcaaguucuggaacaccaccaucgcgguguccauggccaacaucuuccgcgggagcuaccucgccggcgccgggcuggccuucuccaucaugaaguccgugggcacgggcaagcgggggaccggcucccagggggagacccugggcgagaaguggaagaagaagcucaaccagcugagccgccgggaguucgagcuguacaagaaguccgggaucaccgaggucgaccgcacggaggcgaaggagggccucaagcggggcgagaccacccaccacgccgugucccgcgggagcgccaagcugcagugguucguggagcggaacauggucauccccgagggccgcgugaucgaccuggggugcggccgcgggggcugguccuacuacugcgccggccucaagaaggugaccgagguccggggguacaccaagggcgggccgggccacgaggagcccgugcccaugagcacguacggguggaacaccgugaagcugauguccggcaaggacgucuucuaccugcccccggagaagugcgacacccugcucugcgacaucggcgagagcucccccagccccaccguggaggagucccgcacgauccgggugcugaagauggucgagcccuggcugaagaacaaccaguucugcaucaaggugcucaacccguacaugcccaccgugaucgagcaccuggagcgccugcagcggaagcacgggggcaugcucguccgcaacccccugagccggaacuccacccacgagauguacuggaucagcaacgggaccggcaacaucguguccagcgugaacauggucucccgccugcuccugaaccgguucacgaugacccaccgccggcccaccaucgagaaggacguggaccugggcgccgggacccgccacgucaacgcggagccggagacgcccaacauggacgugaucggcgagcggaucaagcgcaucaaggaggagcacagcuccaccuggcacuacgacgacgagaaccccuacaagaccugggccuaccacgggagcuacgaggugaaggccaccggcuccgccagcagcaugaucaacggggucgugaagcuccugacgaagccgugggacgugguccccauggugacccagauggccaugaccgacaccacgcccuucggccagcagcggguguucaaggagaaggucgacacccgcacgccccggccgaugcccggcacccgcaaggugauggagaucaccgcggaguggcuguggcggacccucgggcgcaacaagcgcccccggcugugcacccgcgaggaguucaccaagaaggugcggacgaacgccgccaugggcgccgucuucaccgaggagaaccagugggaguccgcgcgcgccgccguggaggacgaggaguucuggaagcugguggggcgggagcgcgagcuccacaagcugggcaagugcgggagcugcgucuacaacaugaugggcaagcgggagaagaagcugggcgaguucgggaaggccaagggcucccgcgccaucugguacauguggcucggggcgcgguaccuggaguucgaggcccugggcuuccucaacgaggaccacugguucagccgcgagaacuccuacagcgggguggagggcgagggccugcacaagcugggguacauccuccgggacaucuccaagauccccggcggggccauguacgccgacgacaccgccggcugggacacccgcaucacggaggacgaccugcacaacgaggagaagaucacccagcagauggacccggagcaccggcagcuggcgaacgccaucuucaagcucaccuaccagaacaagguggucaaggugcagcgccccacccccaagggcacggugauggacaucaucagccggaaggaccagcgcggguccggccaggucgggaccuacggccugaacaccuucaccaacauggaggcccagcugauccggcagauggagggggagggcgugcucagcaaggccgaccuggagaacccccaccuccucgagaagaagaucacccaguggcuggagacgaagggcguggagcgccugaagcggauggccaucuccggggacgacugcgucgugaagccgaucgacgaccgcuucgcgaacgcccuccuggcccugaacgacaugggcaaggugcggaaggacaucccccaguggcagcccagcaagggguggcacgacuggcagcagguccccuucugcucccaccacuuccacgagcucaucaugaaggacggccgcaagcugguggugccgugccgcccccaggacgagcugaucgggcgggcccgcaucagccagggcgccggcuggucccucaaggagaccgcgugccuggggaaggccuacgcccagauguggagccugauguacuuccaccggcgcgaccuccggcuggccuccaacgcgaucugcagcgccguccccgugcacugggugcccaccucccgcaccacguggagcauccacgcccaccaccaguggaugaccaccgaggacaugcugaccgucuggaaccggguguggaucgaggacaacccguggauggaggacaagacgcccgugaccaccugggaggacguccccuaccucggcaagcgcgaggaccaguggugcgggagccugaucggccugaccucccgggccacgugggcccagaacauccucaccgcgauccagcagguccgcagccugaucggggacgaggaguuccuggacuacaugcccuccaugaagcgguuccgcaaggaggaggagagcgagggcgccaucugguga

SEQ ID NO: 10345 - RNA, 9873 nt, Artificial Sequence
  derived and/or modified CDS sequence (opt1) from DENV-3__KJ622196__SS-prME
accagccugugccucaugaugaugcugcccgccacccuggccuuccaccucaccagccgggacggcgagccccggaugaucguggggaagaacgagcggggcaagagccugcuguucaagaccgcgagcgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggacgugcaaccaggccggcgagcaccggcgcgacaagcgguccguggcccuggcgccccacgugggcauggggcuggacacccgcacccagaccuggaugagcgccgagggcgccuggcgccagguggagaaggucgagacgugggcccuccgccaccccggguucaccauccuggcgcuguuccucgcccacuacaucggcaccucccugacccagaagguggugaucuucauccugcucaugcuggucacgcccagcauggccaugcggugcgugggggugggcaaccgcgacuucgucgagggccuguccggggccaccuggguggacgugguccucgagcacggcgggugcgugaccaccauggccaagaacaagcccacgcuggacaucgagcugcagaagaccgaggcgacccagcucgccacccugcggaagcugugcaucgagggcaagaucacgaacaucaccaccgacagccgcugccccacccagggcgaggccauccuccccgaggagcaggaccagaacuacgugugcaagcacacguacgucgaccggggguggggcaacgggugcggccuguucgggaagggcucccuggugaccugcgccaaguuccagugccucgagagcaucgagggcaaggugguccagcacgagaaccugaaguacaccgugaccaucacggugcacaccggggaccagcaccaggucggcaacgacacccagggggugaccgccgagaucacgccccaggcguccaccgucgaggccauccugcccgaguacggcacccucgggcuggagugcagcccccgcaccggccuggacuucaacgagaugauccuccugaccaugaagaacaaggccuggauggugcaccggcagugguucuucgaccugccgcuccccuggacguccggcgccaucaccgagacccccaccuggaaccgcaaggagcugcuggugacguucaagaacgcccacgcgaagaagcaggaggucguggugcucgggagccaggagggcgccaugcacaccgcccugaccggggccaccgagauccagaacuccggcgggacgagcaucuucgccggccaccugaagugccggcucaagauggacaagcuggagcugaagggcauguccuacgcgaugugccucaacaccuucguccugaagaaggaggugagcgagacccagcacgggaccauccugaucaagguggaguacaagggcgaggacgcccccugcaagaucccguucagcacggaggacgggcagggcaaggcccacaacggccgccugaucaccgccaaccccgucgugaccaagaaggaggagcccgugaacaucgaggcggagcccccguucggggaguccaacaucgucaucggcaucggggacaaggcccucaagaucaacugguacaagaagggcagcuccaucgggaagauguucgaggccaccgcccggggcgcccgccggauggcgauccugggcgacacggccugggacuucgggagcgugggcggggugcugaacucccucggcaagaugguccaccagaucuucgggagcgccuacaccgcccuguucggcggcguguccuggaucaugaagaucgggaucggcgugcugcucaccuggaucgggcugaacagcaagaacaccuccaugagcuucuccugcaucgucaucggcaucaucacgcuguaccucgggaccguggugcaggccgacaugggcugcgucaucaacuggaagggcaaggagcugaagugcgggagcggcaucuucgugaccaacgaggugcacaccuggacggagcaguacaaguuccaggcggacucccccaagcgccuggccaccgccaucgccggggccugggagaacggcgucugcgggauccgcagcaccacccggauggagaaccuccuguggaagcagaucgcgaacgagcugaacuacauccucugggagaacaacaucaagcugacggugguggucggcgacaucaucggcgugcuggagcaggggaagcgcacccucacgccccagcccauggagcugaaguacuccuggaagaccuggggcaaggccaagaucgugacggccgagauccagaacagcuccuucaucaucgacgggccgaacacccccgagugccccagcgccucccgggcguggaacgucugggagguggaggacuacggcuucggcguguucaccaccaacaucuggcugaagcuccgcgaggucuacacgcagaccugcgaccaccggcugaugagcgccgccaucaaggacgagcgcgccgugcacgccgacaugggguacuggaucgagagccagaagaacggcuccuggaagcuggagaaggcgagcuucaucgaggugaagaccugcaccuggcccaagucccacacccucuggagcaacgggguccuggaguccgacaugaucauccccaagagccuggccggccccaucucccagcacaaccaccggcccggguaccacacgcagaccgccggcccguggcaccucggcaagcuggagcuggacuucaacuacugcgaggggaccaccguggugaucacggagaacugcggcacccgcgggcccagccuccggaccaccacggucuccggcaagcugauccacgaguggugcugccgcagcugcacccugccgccccugcgguacaugggggaggacggcugcugguacggcauggagauccgcccgaucaacgagaaggaggagaacauggugaagucccuggugagcgccggguccggcaaggucgacaacuucaccaugggggugcugugccucgccauccuguucgaggaggugaugcggggcaaguucgggaagaagcacaugaucgcgggcguccugcucaccuucaugcugcugcucagcggccagaucacguggcgcgacauggcccacacccugaucaugaucggguccaacgccagcgaccggaugggcaugggggugaccuaccuggcccucaucgccaccuucaagauccagcccuuccuggcgcugggcuucuuccuccgcaagcugacgucccgggagaaccugcuccugggcguggggcuggccauggccaccacccuccagcugcccgaggacaucgagcagauggccaacggcaucgcgcuggggcucauggcccugaagcugaucacccaguucgagacguaccagcucuggaccgcccuggucagccugaccugcagcaacaccaucuucacgcucaccguggccuggcgcaccgccacccugauccuggcgggcgugucccuccugcccgucugccagagcuccagcaugcggaagacggacuggcugccgguggccgucgccgccaugggggugccgccccucccccuguucaucuucucccugaaggacacccucaagcgccgcagcuggccgcugaacgagggcgugauggccgucggccugguguccauccucgcgagcucccugcugcggaacgacgugcccauggccgggccccucgucgccggcgggcugcugaucgccugcuacgugaucaccggcaccagcgccgaccucacgguggagaaggcggccgacgucaccugggaggaggaggccgagcagaccggggugucccacaaccugaugaucaccguggacgacgacggcacgaugcgcaucaaggacgacgagaccgagaacauccugaccguccuccugaagaccgcccugcucaucgugagcggcaucuuccccuacuccaucccggccacccugcugguguggcacacguggcagaagcagacccagcggagcgggguccucugggacgugcccagcccgcccgagacccagaaggcggagcuggaggagggcguguaccgcaucaagcagcaggggaucuucggcaagacccaggucggggugggcgugcagaaggagggcgucuuccacacgauguggcacgugacccgcggggccgugcugacccacaacggcaagcgccucgagccgaacugggccagcgucaagaaggaccugaucuccuacgggggcggguggcggcugagcgcccaguggcagaagggcgaggagguccaggugaucgcggucgagcccggccgcaaccccaagaacuuccagaccaugcccgggaucuuccagacgaccaccggcgagaucggggccaucgcccuggacuucaagccgggcaccuccggcagccccaucaucaaccgggaggggaagguggugggccucuacgggaacggcgucgugacgaagaacgggggcuacgugagcggcaucgcccaggccaacgcggagcccgacgggccgacccccgagcuggaggaggagauguucaagaagcgcaaccugaccaucauggaccuccaccccggcuccgggaagacccggaaguaccugcccgccaucguccgcgaggccaucaagcggcgccugcggacgcucauccuggccccgacccgcgugguggccgcggagauggaggaggcccugaagggccuccccauccgguaccagaccaccgccaccaaguccgagcacaccgggcgcgagaucgucgaccugaugugccacgccaccuucaccaugcggcugcucucccccgugcgcgugcccaacuacaaccugaucaucauggacgaggcccacuucacggacccggcgagcaucgccgcccggggcuacaucuccacccgcgucggcaugggggaggccgcggccaucuucaugaccgccacgccgcccggcacggccgaggccuucccccagagcaacgcgccgauccaggacgaggagcgcgacauccccgagcgguccuggaacagcgggaacgaguggaucaccgacuucgugggcaagaccgugugguucguccccuccaucaaggccgggaacgacaucgccaacugccugcgcaagaacggcaagaaggugauccagcucagccggaagaccuucgacacggaguaccagaagaccaagcugaacgacugggacuucguggucaccaccgacaucuccgagaugggcgccaacuucaaggccgaccgcgugaucgacccccggcgcugccugaagccggugauccucacggacgggcccgagcgggucauccuggcgggccccaugcccgugaccgccgccagcgccgcccagcgccgggggcgcgugggccggaacccgcagaaggagaacgaccaguacaucuucaccgggcagccccugaacaacgacgaggaccacgcgcacuggaccgaggccaagaugcuccuggacaacaucaacacgcccgagggcaucauccccgcccuguucgagccggagcgcgagaaguccgccgcgaucgacggcgaguaccggcucaagggggagagccgcaagaccuucgucgagcugaugcggcgcggcgaccugcccguguggcucgcccacaaggucgccuccgaggggaucaaguacaccgaccggaaguggugcuucgacggcgagcgcaacaaccagauccuggaggagaacauggacguggagaucuggaccaaggagggcgagcggaagaagcugcgcccccgcuggcucgacgcccggaccuacagcaacccccuggcccugaaggaguucaaggacuucgcggccgggcgcaaguccaucgcccucgaccuggugacggagaucggccgggucccgagccaccuggcccaccgcacccggaacgcccucgacaaccuggugaugcugcacaccuccgagcacgggggccgcgcguaccggcacgccguggaggagcuccccgagaccauggagacgcugcugcuccuggggcugaugauccuccugaccggcggcgccaugcuguuccucaucagcgggaagggcaucgggaagaccagcaucggccugaucugcgucaucguguccagcgggaugcuguggauggccgacgugccccuccaguggaucgccuccgcgaucguccuggaguucuucaugauggugcugcucaucccggagcccgagaagcagcgcacgccccaggacaaccagcuggccuacguggucaucggcauccugacgcucgccgccaucguggccgcgaacgagaugggccugcuggagaccaccaagcgggaccucgggaugagcaaggagcccggcguggucuccccgaccagcuaccuggacguggaccugcaccccgccuccgccuggacgcucuacgccguggcgaccaccgucaucacccccaugcugcgccacacgaucgagaacagcaccgccaacgugucccuggccgccaucgccaaccaggcggugguccucauggggcuggacaagggcuggcccaucagcaagauggaccugggggugccgcuccuggcccugggcugcuacucccaggugaacccccucacccugaccgccgccguccugcuccuggugacgcacuacgccaucaucggccccgggcugcaggcgaaggccacccgggaggcccagaagcgcaccgccgccggcaucaugaagaaccccaccguggacgggaucaugacgaucgaccucgacccggucaucuacgacagcaaguucgagaagcagcugggccaggugaugcugcucgugcugugcgcgguccagcugcuccugaugcggaccuccugggcccugugcgaggcccucacccuggccaccggccccaucacgacccugugggaggggagccccggcaaguucuggaacaccaccaucgcgguguccauggccaacaucuuccgcgggagcuaccucgccggcgccgggcuggccuucuccaucaugaaguccgugggcacgggcaagcgggggaccggcucccagggggagacccugggcgagaaguggaagaagaagcucaaccagcugagccgccgggaguucgagcuguacaagaaguccgggaucaccgaggucgaccgcacggaggcgaaggagggccucaagcggggcgagaccacccaccacgccgugucccgcgggagcgccaagcugcagugguucguggagcggaacauggucauccccgagggccgcgugaucgaccuggggugcggccgcgggggcugguccuacuacugcgccggccucaagaaggugaccgagguccggggguacaccaagggcgggccgggccacgaggagcccgugcccaugagcacguacggguggaacaccgugaagcugauguccggcaaggacgucuucuaccugcccccggagaagugcgacacccugcucugcgacaucggcgagagcucccccagccccaccguggaggagucccgcacgauccgggugcugaagauggucgagcccuggcugaagaacaaccaguucugcaucaaggugcucaacccguacaugcccaccgugaucgagcaccuggagcgccugcagcggaagcacgggggcaugcucguccgcaacccccugagccggaacuccacccacgagauguacuggaucagcaacgggaccggcaacaucguguccagcgugaacauggucucccgccugcuccugaaccgguucacgaugacccaccgccggcccaccaucgagaaggacguggaccugggcgccgggacccgccacgucaacgcggagccggagacgcccaacauggacgugaucggcgagcggaucaagcgcaucaaggaggagcacagcuccaccuggcacuacgacgacgagaaccccuacaagaccugggccuaccacgggagcuacgaggugaaggccaccggcuccgccagcagcaugaucaacggggucgugaagcuccugacgaagccgugggacgugguccccauggugacccacauggccaugaccgacaccacgcccuucggccagcagcggguguucaaggagaaggucgacacccgcacgccccggccgaugcccggcacccgcaaggugauggagaucaccgcggaguggcuguggcggacccucgggcgcaacaagcgcccccggcugugcacccgcgaggaguucaccaagaaggugcggacgaacgccgccaugggcgccgucuucaccgaggagaaccagugggaguccgcgcgcgccgccguggaggacgaggaguucuggaagcugguggggcgggagcgcgagcuccacaagcugggcaagugcgggagcugcgucuacaacaugaugggcaagcgggagaagaagcugggcgaguucgggaaggccaagggcucccgcgccaucugguacauguggcucggggcgcgguaccuggaguucgaggcccugggcuuccucaacgaggaccacugguucagccgcgagaacuccuacagcgggguggagggcgagggccugcacaagcugggguacauccuccgggacaucuccaagauccccggcggggccauguacgccgacgacaccgccggcugggacacccgcaucacggaggacgaccugcacaacgaggagaagaucacccagcagauggacccggagcaccggcagcuggcgaacgccaucuucaagcucaccuaccagaacaagguggucaaggugcagcgccccacccccaagggcacggugauggacaucaucagccggaaggaccagcgcggguccggccaggucgggaccuacggccugaacaccuucaccaacauggaggcccagcugauccggcagauggagggggagggcgugcucagcaaggccgaccuggagaacccccaccuccucgagaagaagaucacccaguggcuggagacgaagggcguggagcgccugaagcggauggccaucuccggggacgacugcgucgugaagccgaucgacgaccgcuucgcgaacgcccuccuggcccugaacgacaugggcaaggugcggaaggacaucccccaguggcagcccagcaagggguggcacgacuggcagcagguccccuucugcucccaccacuuccacgagcucaucaugaaggacggccgcaagcugguggugccgugccgcccccaggacgagcugaucgggcgggcccgcaucagccagggcgccggcuggucccucaaggagaccgcgugccuggggaaggccuacgcccagauguggagccugauguacuuccaccggcgcgaccuccggcuggccuccaacgcgaucugcagcgccguccccgugcacugggugcccaccucccgcaccacguggagcauccacgcccaccaccaguggaugaccaccgaggacaugcugaccgucuggaaccggguguggaucgaggacaacccguggauggaggacaagacgcccgugaccaccugggaggacguccccuaccucggcaagcgcgaggaccaguggugcgggagccugaucggccugaccucccgggccacgugggcccagaacauccucaccgcgauccagcagguccgcagccugaucggggacgaggaguuccuggacuacaugcccuccaugaagcgguuccgcaaggaggaggagagcgagggcgccaucugguga

SEQ ID NO: 10346 - RNA, 9873 nt, Artificial Sequence
  derived and/or modified CDS sequence (opt1) from DENV-3__KJ830751__SS-prME
accagccugugccucaugaugauccugcccgccgcccuggcguuccaccucaccagccgggacggcgagccgcggaugaucguggggaagaacgagcggggcaagagccugcuguucaagacggccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccugggccagcggcgccaccaccgagacccccacguggaaccgcaaggagcuccuggugaccuucaagaacgcccacgcgaagaagcaggaggucguggugcuggggucccaggagggcgccaugcacaccgcccucaccggggccacggagauccagaacagcggcgggaccuccaucuucgccggccaccugaagugccggcugaagauggacaagcucgagcugaagggcaugagcuacgcgaugugcaccaacaccuucguccugaagaaggagguguccgagacgcagcacgggaccauccucaucaagguggaguacaagggcgaggacgccccgugcaagauccccuucagcaccgaggacgggcagggcaaggcccacaacggccgccugaucaccgccaaccccgucgugacgaagaaggaggagcccgugaacaucgaggcggagccgcccuucggggagagcaacaucgucaucggcaucggggacaacgcccugaagaucaacugguacaagaagggcuccagcaucgggaagauguucgaggccaccgcccggggcgcccgccggauggcgauccugggcgacaccgccugggacuucggguccgugggcggggugcucaacagccugggcaagaugguccaccagaucuucggguccgccuacaccgcccuguucagcggcguguccugggugaugaagaucggcaucgggguccuccugacguggaucggccugaacagcaagaacaccuccaugagcuucuccugcaucgccaucgggaucaucacccucuaccugggcgcgguggugcaggccgacauggggugcgucaucaacuggaagggcaaggagcugaagugcggcagcgggaucuucgugaccaacgaggugcacacguggaccgagcaguacaaguuccaggccgacucccccaagcgccucgccaccgccaucgcgggcgccugggagaacggggucugcggcauccgcagcaccacgcggauggagaaccugcuguggaagcagaucgccaacgagcucaacuacauccugugggagaacaacaucaagcugaccgugguggucggggacaccaucggcgugcucgagcagggcaagcgcacccugacgccccagccgauggagcugaaguacuccuggaagaccugggggaaggccaagaucgugaccgcggagacccagaacagcuccuucaucaucgacggccccaacacgcccgagugccccagcgccucccgggccuggaacgucugggagguggaggacuacggguucggcguguucaccaccaacaucuggcucaagcugcgcgaggucuacacccagcugugcgaccaccggcucaugagcgccgccgugaaggacgagcgcgcggugcacgccgacaugggcuacuggaucgagagccagaagaacggguccuggaagcuggagaaggccagccugaucgaggucaagaccugcacguggccgaagucccacacccucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcacgaccguggucaucaccgagagcugcgggacccgcggccccucccuccggacgaccaccgugagcgggaagcugauccacgaguggugcugccgcuccugcacccugcccccgcuccgguacaugggcgaggacgggugcugguacggcauggagauccgccccaucagcgagaaggaggagaacauggugaagucccuggucagcgcgggcuccgggaagguggacaacuucacgaugggcgugcugugccucgccauccuguacgaggaggucaugcgggggaaguucggcaagaagcacaugaucgccgggguguucuucaccuucgugcugcuccugagcggccagaucaccuggcgcaacauggcccacacccugaucaugaucggcuccaacgccagcgaccggauggggaugggcgucacguaccucgcgcugaucgccaccuucaagauccagcccuuccuggcccucggguucuuccugcgcaagcugaccagccgggagaaccuccugcugggcgugggccucgccauggcgaccacgcugcagcugcccgacgacaucgagcagauggccaacgggaucgcccucggccugauggcccugaagcucaucacccaguucgagaccuaccagcuguggaccgcccuggugucccucacgugcagcaacaccauguucacccugaccgucgcguggcgcacggccacccugauccucgccggggugucccugcugccggucugccagagcuccagcaugcggaagaccgacuggcuccccauggccguggccgcgaugggcgugccgccccugccgcuguucaucuucaaccucaaggacacccugaagcgccgcuccuggccccugaacgagggggucauggccgugggccucgugagcauccuggccuccagccugcuccggaacgacguccccauggccggcccccugguggccgggggccugcucaucgcgugcuacgugaucacggggaccuccgccgaccugaccgucgagaaggccgccgacgugaccugggaggaggaggccgagcagacgggcgugagccacaaccugaugaucaccgucgacgacgacgggaccaugcgcaucaaggacgacgagaucgagaacauccucaccgugcugcugaagaccgcgcuccugaucguguccggcaucuucccguacagcauccccgccacgcugcucgucuggcacaccuggcagaagcagacccagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacccggggcgccguccucacccacaacgggaagcgccuggagcccaacugggcguccgugaagaaggaccugaucagcuacggcgggggcuggcggcucuccgcccaguggcagaagggggaggaggugcaggucaucgccguggagcccggcaagaaccccaagaacuuccagacgaugcccggcaccuuccagaccaccacgggggagaucggcgccaucgcccuggacuucaagcccgggaccagcggcagccccaucaucaaccgcgagggcaagguggucgggcuguacggcaacgggguggugaccaagaacggcggguacgucuccggcaucgcgcagaccaacgccgagccggacggccccacgcccgagcuggaggaggagauguucaagaagcggaaccucaccaucauggaccugcaccccgggagcggcaagacccgcaaguaccugccggccaucgugcgggaggccaucaagcgccggcuccgcacccugauccuggcccccacgcggguggucgcggccgagauggaggaggcccucaaggggcugcccauccgcuaccagaccaccgccaccaaguccgagcacacgggccgggagaucguggaccugaugugccacgccaccuucaccaugcgccuccugagccccgugcgggucccgaacuacaaccugaucaucauggacgaggcgcacuucaccgaccccgccuccaucgccgcccgcggguacaucagcacgcgggugggcaugggcgaggcggccgccaucuucaugaccgccacgccgcccgggaccgccgacgcguucccgcaguccaacgcccccauccaggacgaggagcgcgacauccccgagcgcagcuggaacuccggcaacgaguggaucacggacuucgccgggaagaccgugugguucguccccagcaucaaggccggcaacgacaucgccaacugccuccggaagaacgggaagaaggugauccagcugucccgcaagaccuucgacaccgaguaccagaagacgaagcugaacgacugggacuucguggucaccaccgacaucagcgagaugggcgcgaacuucaaggccgaccgggugaucgacccgcgccggugccucaagcccgugauccugaccgacggccccgagcgcgucauccuggccgggcccaugccggugacggccgccuccgcggcccagcggcgcggccggguggggcgcaacccccagaaggagaacgaccaguacaucuucaccggccagccccucaacaacgacgaggaccacgcccacuggaccgaggccaagaugcugcuggacaacaucaacacccccgaggggauccucccggcgcuguucgagcccgagcgggagaaguccgccgccaucgacggcgaguaccgccugaagggcgagucccggaagaccuucgucgagcucaugcgccgcggggaccugcccguguggcuggcccacaaggucgccagcgagggcaucaaguacacggaccgcaaguggugcuucgacgggcagcggaacaaccagauccucgaggagaacauggacguggagaucuggaccaaggagggcgagaagaagaagcugcgcccccgguggcuggacgcgcgcaccuacuccgacccgcucgcccugaaggaguucaaggacuucgccgccggccgcaagagcaucgcccuggaccucgugaccgagaucgggcggguccccucccaccuggcgcaccgcacgcggaacgcccuggacaaccucgugaugcugcacaccagcgagcacggcgggcgcgccuaccggcacgccguggaggagcugcccgagaccauggagacccuccugcugcucggccugaugauccugcucaccggcggggccaugcuguuccugaucagcgggaaggggaucggcaagaccuccaucgggcucaucugcgucaucgcgagcuccggcaugcuguggauggccgaggugccgcugcaguggaucgccagcgccaucgugcucgaguucuucaugaugguccugcugauccccgagcccgagaagcagcgcacgccccaggacaaccagcucgccuacguggugaucgggauccugacccuggcggccaucaucgccgccaacgagaugggccuccuggagacgaccaagcgggaccugggcauguccaaggagccgggggucgugagccccaccuccuaccucgacguggaccugcaccccgcgagcgccuggacccuguacgccgucgccacgaccgugaucacccccaugcuccgccacaccaucgagaacuccacggccaacgugagccuggcggccaucgccaaccaggccgucgugcugaugggccucgacaagggguggccgaucuccaagauggaccugggcgugccccugcucgcccuggggugcuacagccaggucaacccccugacccucaccgcggccgugcugcugcucaucacccacuacgccaucaucggccccggccugcaggccaaggccacgcgggaggcgcagaagcgcaccgccgccgggaucaugaagaacccgaccguggacggcaucaugaccaucgaccuggaccccgucaucuacgacuccaaguucgagaagcagcucggccaggugaugcugcuggugcucugcgccguccagcugcugcucaugcggacgagcugggcgcugugcgaggcccugacccucgccaccggccccaucaccacgcugugggagggcucccccgggaaguucuggaacaccaccaucgccgugagcauggccaacaucuuccgcggcuccuaccuggcgggggccggccucgccuucagcaucaugaaguccguggggaccggcaagcggggcacggggagccagggcgagacccugggggagaaguggaagaagaagcugaaccagcucagccgcaaggaguucgaccuguacaagaaguccggcaucaccgaggucgaccggaccgaggccaaggaggggcugaagcgcggcgagaccacgcaccacgccgugagccggggcuccgcgaagcuccagugguucguggagcgcaacauggucgugccggaggggcgggugaucgaccugggcugcgggcgcggcggguggagcuacuacugcgccggccugaagaaggucaccgaggugcggggcuacaccaagggcgggcccgggcacgaggagcccgugcccauguccaccuacggcuggaacaucgucaagcucaugagcgggaaggacguguucuaccugccgcccgagaagugcgacacgcugcugugcgacaucggcgaguccagccccucccccaccguggaggagagccgcaccauccgcguccucaagaugguggagccguggcugaagaacaaccaguucugcaucaaggugcugaaccccuacaugcccaccgucaucgagcaccucgagcggcugcagcgcaagcacggcgggaugcuggugcggaacccccucucccgcaacagcacgcacgagauguacuggaucuccaacggcaccgggaacaucgugagcuccgucaacauggugagccggcugcugcucaaccgcuucaccaugacccaccggcgcccgacgaucgagaaggacguggaccugggcgccggcacccggcacgucaacgccgagcccgagacccccaacauggacgugaucggggagcgcaucaagcggaucaaggaggagcacaacuccaccuggcacuacgacgacgagaacccguacaagacgugggccuaccacggcagcuacgaggucaaggcgaccggguccgccagcagcaugaucaacggcguggugaagcugcucaccaagcccugggacgucgugcccauggugacccagauggccaugacggacaccacccccuucgggcagcagcgcgucuucaaggagaagguggacacccggacgccgcgccccaugcccggcacccggaaggugauggagaucaccgccgaguggcuguggcgcacccugggccggaacaagcgcccccggcucugcacgcgcgaggaguucaccaagaagguccgcaccaacgcggccaugggggccguguucaccgaggagaaccagugggacuccgccaaggccgcgguggaggacgaggaguucuggaagcuggucgaccgggagcgcgagcugcacaagcucggcaagugcgggagcugcguguacaacaugaugggcaagcgggagaagaagcugggggaguucggcaaggccaagggcucccgcgccaucugguacauguggcugggggcccgguaccucgaguucgaggcccugggcuuccugaacgaggaccacugguucagccgcgagaacuccuacagcgggguggagggcgaggggcuccacaagcugggcuacauccugcgggacaucuccaagaucccgggcggggcgauguacgccgacgacacggccggcugggacacccgcaucaccgaggacgaccuccacaacgaggagaagaucauccagcagauggaccccgagcaccggcagcuggccaacgccaucuucaagcugaccuaccagaacaaggucgugaaggugcagcgccccacgcccaccgggaccgucauggacaucaucagccggaaggaccagcgcggcuccggccagguggggaccuacggccucaacaccuucacgaacauggaggcgcagcuggugcggcagauggagggggagggcguccugaccaaggccgaccucgagaacagccaccuccccgagaagaagaucacccaguggcuggagaccaaggggguggagcgccugaagcggauggccaucuccggcgacgacugcguggucaagcccaucgacgaccgcuucgccaacgcccugguggcgcugaacgacaugggcaaggugcggaaggacaucccccaguggcagcccagccgcggguggcacgacuggcagcaggucccguucugcucccaccacuuccacgagcucaucaugaaggacggccggaagcugguggugcccugccgcccccaggacgagcugaucgggcgggcccgcaucagccagggcgccggguggucccuccgcgagacggccugccugggcaaggcguacgcccagauguggagccugauguacuuccaccggcgcgaccuccggcuggccuccaacgccaucugcagcgccguccccgugcacugggugccgaccucccgcaccaccuggagcauccacgcgcaccaccaguggaugacgaccgaggacaugcugaccgucuggaaccggguguggaucgaggagaaccccuggauggaggacaagacccccgugacgaccugggagaacguccccuaccucggcaagcgcgaggaccaguggugcgggagccugaucggccugaccucccgggccaccugggcccagaacaucccgacggccauccagcagguccgcagccucaucgggaacgaggaguuccuggacuacaugcccuccaugaagcgguuccgcaaggaggaggagagcgagggcgccaucugguga

SEQ ID NO: 10347 - RNA, 9873 nt, Artificial Sequence
  derived and/or modified CDS sequence (opt1) from DENV-3__KC762681__SS-prME
accagccugugccucaugaugaugcugcccgccacccuggccuuccaccucaccucccgcgacggcgagccccggaugaucguggggaagaacgagcgcggcaagagccugcuguucaagaccgccuccgggaucaacaugugcacccucaucgccauggaccugggcgagaugugcgacgacaccgugaccuacaagugcccccugaucaccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagacguggaugagcgcggagggcgccuggcggcaggucgagaaggucgagaccugggccuuccgccaccccggguucaccauccucgcccuguuccuggcgcacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacgugaccacggacagccgcugccccacccagggcgaggcgauccugcccgaggagcaggaccagaacuacgucugcaagcacaccuacguggaccggggguggggcaacgggugcggccucuucgggaagggcucccuggugaccugcgccaaguuccagugccuggaguucaucgagggcaaggucgugcagcacgagaaccucaaguacacggugaucaucaccguccacaccggggaccagcaccaggugggcaacgagacccagggggucacggccgagaucacgccccaggccagcaccguggaggccauccugcccgaguacggcacccuggggcucgagugcagcccccgcaccggccuggacuucaacgagaugauccugcucacgaugaagaacaaggcguggauggugcaccggcagugguucuucgaccugccgcugcccuggaccagcggcgccaccaccgagacgcccaccuggaacaagaaggagcuccuggucaccuucaagaacgcccacgccaagaagcaggagguggugguccuggggucccaggagggcgccaugcacaccgcgcucacgggggccaccgagauccagaccagcggcgggaccuccaucuucgccggccaccugaagugccgccugaagauggacaagcucgagcugaagggcaugagcuacgccaugugccugaacgccuucgugcucaagaaggagguguccgagacgcagcacgggaccauccugaucaaggucgaguacaagggcgaggacgcgcccugcaagaucccguucagcaccgaggacgggcagggcaaggcccacaacggccggcugaucaccgccaaccccguggugacgaagaaggaggagcccgucaacaucgaggccgagcccccguucggggagagcaacaucgugaucggcaucggggacaaggcgcugaagaucaacugguacaagaagggcuccagcaucgggaagauguucgaggccaccgcccgcggcgcccggcgcauggccauccucggcgacaccgcgugggacuucggguccgugggcgggguccugaacagccugggcaagauggugcaccagaucuucggguccgccuacaccgcccucuucagcggcguguccuggaucaugaagaucggcaucgggguccugcugacguggaucggccucaacagcaagaacaccuccaugagcuucuccugcaucgugaucgggaucaucacccuguaccugggcgccgugguccaggccgacauggggugcgugaucaacuggaagggcaaggagcucaagugcggcagcgggaucuucgugaccaacgagguccacacguggaccgagcaguacaaguuccaggcggacucccccaagcggcuggccaccgccaucgccggcgccugggagaacggggugugcggcauccgcagcaccacgcgcauggagaaccugcucuggaagcagaucgcgaacgagcugaacuacauccugugggagaacaacaucaagcucaccguggucgugggggacaucaucggcgugcuggagcagggcaagcggacccugacgccccagcccauggaccucaaguacuccuggaagacgugggggaaggccaagaucgucaccgccgagacccagaacagcuccuucaucaucgacggcccgaacacccccgagugccccagcgccucccgcgcguggaacgugugggagguggaggacuacggguucggcgucuucacgaccaacaucuggcugaagcugcgggagauguacacccagcucugcgaccaccgccugaugagcgccgccgugaaggacgagcgggccgugcacgccgacaugggcuacuggaucgagagccagaagaacggguccuggaagcuggagaaggcgagccucaucgaggucaagaccugcaccuggcccaagucccacacgcuguggagcaacggcgugcuggaguccgacaugaucauccccaagucccucgccgggcccgugucccagcacaacuaccgccccggcuaccacacccagaccgccgggccguggcaccugggcaagcuggagcucgacuucaacuacugcgagggcaccacggucgugaucaccgagaacugcgggacccggggccccagccugcgcaccacgaccguguccgggaagcugauccacgaguggugcugccggagcugcacccugccgccccuccgcuacaugggcgaggacgggugcugguacggcauggagauccggccgaucaacgagaaggaggagaacauggucaagucccuggugagcgccggcuccgggaagguggacaacuucaccaugggcguccucugccuggccauccuguucgaggaggugaugcgcgggaaguucggcaagaagcacaugaucgcggggguccuguucacguucguccugcugcucagcggccagaucaccuggcgggacauggcccgcacccugaucaugaucggcuccaacgccagcgaccggauggggaugggcgugaccuaccuggcccucaucgccacguucaagauccagcccuuccuggcgcugggguucuuccuccgcaagcugaccucccgggagaaccugcuccugggcgugggccuggccauggccaccacccuccagcugcccgaggacaucgagcagauggccaacgggaucgcgcugggccucauggcccugaagcugaucacgcaguucgagaccuaccagcucuggaccgcccuggucagccugaugugcagcaacaccauguucacgcucaccguggccuggcgcaccgccacccugauccuggcggggaucucccuccugcccgucugccagagcuccagcaugcggaagacggacuggcugccggugaccguggccgccaugggcgugccgccccucccccuguucaucuucucccugaaggacacccucaagcgccgcagcuggccgcugaacgagggggugauggccgugggccuggucuccauccucgccagcucccugcugcggaacgacgugcccauggcgggcccccucguggccgggggccugcugaucgccugcuacgucaucaccgggacgagcgccgaccucaccguggagaaggccgcggacgugaucugggaggaggaggccgagcagaccggcgucucccacaaccugaugaucaccguggacgacgacgggacgaugcgcaucaaggacgacgagaccgagaacauccugaccgugcuccugaagaccgcccugcucaucgucagcggcaucuuccccuacuccaucccggccacccugcugguguggcacacguggcagaagcagacccagcggagcggcgugcucugggacguccccagcccgcccgagacccagaaggccgagcuggaggaggggguguaccgcaucaagcagcagggcaucuucgggaagacccaggugggcgucggggugcagaaggagggcguguuccacacgauguggcacgucacccggggcgcggugcugacccacaacgggaagcgccucgagccgaacugggccagcgugaagaaggaccugaucuccuacggcgggggcuggcggcugagcgcccaguggcagaagggggaggagguccaggugaucgccguggagcccggcaagaaccccaagaacuuccagaccaugcccggcaucuuccagacgaccaccggggagaucggcgcgaucgcccuggacuucaagccggggaccuccggcagccccaucaucaaccgcgagggcaaggucguggggcucuacggcaacgggguggucacgaagaacggcggguacgugagcggcaucgcccagaccaacgccgagcccgacggcccgacccccgagcuggaggaggagauguucaagaagcggaaccugaccaucauggaccuccaccccggguccggcaagacgcgcaaguaccugcccgccaucgugcgggaggcgaucaagcgccggcugcgcacccucauccuggccccgacccgggucguggccgccgagauggaggaggcccugaaggggcuccccauccgcuaccagaccacggcgaccaagagcgcccacaccggcaaggagaucguggaccugaugugccacgccaccuucacgaugcggcugcucucccccguccgcgugcccaacuacaaccugaucaucauggacgaggcccacuucaccgacccggccagcaucgcggcccggggguacaucuccacccgcgugggcaugggcgaggccgccgcgaucuucaugaccgccacgccgcccgggaccgccgacgccuucccccagagcaacgccccgauccaggacgaggagcgggacauccccgagcgcuccuggaacagcggcaacgaguggaucaccgacuucgcggggaagaccgucugguucgugcccuccaucaaggccggcaacgacaucgccaacugccugcgcaagaacgggaagaaggugauccagcucagccggaagacguucgacaccgaguaccagaagaccaagcugaacgacugggacuucgucgugaccacggacaucuccgagaugggcgccaacuucaagaccgaccgcgugaucgacccccggcgcugccugaagccggucauccucaccgacggccccgagcgggugauccuggccgggcccaugcccgugaccgucgcgagcgccgcccagcgccggggccgcguggggcggaacccgcagaaggagaacgaccaguacaucuucacgggccagccccugaacaacgacgaggaccacgcccacuggaccgaggccaagaugcuccuggacaacaucaacacccccgaggggaucauccccgcgcuguucgagccggagcgcgagaaguccgccgccaucgacggcgaguaccggcucaagggcgagagccgcaagaccuucgucgagcugaugcggcgcggggaccugcccguguggcucgcccacaagguggcguccgagggcaucaaguacaccgaccggaaguggugcuucgacggggagcgcaacaaccagauccuggaggagaacauggacgucgagaucuggacgaaggagggcgagaagaagaagcugcggccccgcuggcucgacgcccggaccuacagcgacccccuggcccugaaggaguucaaggacuucgccgccggccgcaaguccaucgcgcucgaccuggugaccgagaucgggcgcgugccgagccaccuggcccaccggacccgcaacgcccucgacaaccuggucaugcugcacacguccgagcacggcgggcgggccuaccgccacgccguggaggagcuccccgagaccauggagacccugcugcuccugggccugaugauccuccugaccgggggcgcgaugcuguuccucaucagcggcaaggggaucggcaagacgagcaucgggcugaucugcguggucgccuccagcggcaugcuguggauggccgacgugccccuccaguggaucgccuccgccaucgugcuggaguucuucaugaugguccugcucaucccggagcccgagaagcagcggacgccccaggacaaccagcuggcguacguggugaucgggauccugacccucgccgccaucgucgccgccaacgagaugggccugcuggagaccacgaagcgcgaccucggcaugagcaaggagcccggggugguguccccgaccagcuaccuggacgucgaccugcaccccgcguccgccuggacccucuacgccguggccaccacggugaucacccccaugcugcggcacaccaucgagaacagcaccgcgaacgucucccuggccgccaucgccaaccaggccguggugcucaugggccuggacaagggguggcccaucagcaagauggaccugggcgucccgcuccuggcgcuggggugcuacucccaggugaacccccucacgcugaccgccgccgugcugcuccuggucacccacuacgccaucaucggccccggccugcaggccaaggcgacccgcgaggcccagaagcggacggccgccgggaucaugaagaaccccaccguggacggcaucaugaccaucgaccucgacccggugaucuacgacagcaaguucgagaagcagcuggggcaggucaugcugcucgugcugugcgccgugcagcugcuccugaugcgcaccuccugggcguucugcgaggcccugacgcucgccaccggccccaucaccacccugugggagggcagccccgggaaguucuggaacacgaccaucgccgucuccauggcgaacaucuuccggggcagcuaccuggccggggccggccucgccuucuccaucaugaaguccguggggaccggcaagcgcggcaccgggagccagggcgagacgcugggggagaaguggaagaagaagcugaaccagcucagccggaaggaguucgaccuguacaagaaguccggcaucaccgagguggaccgcaccgaggccaaggaggggcugaagcggggcgagaucacccaccacgcggucucccgcggcagcgccaagcuccagugguucguggagcggaacauggugauccccgaggggcgcgucaucgaccugggcugcgggcggggcgggugguccuacuacugcgccggccugaagaaggugaccgaggugcgcggcuacacgaagggcgggccggggcacgaggagcccguccccaugagcaccuacggcuggaacaucgugaagcucauguccgggaaggacguguucuaccugcccccggagaagugcgacacccugcugugcgacaucggcgagagcucccccagccccaccgucgaggagucccggacgauccgcgugcucaagaugguggagcccuggcugaagaacaaccaguucugcaucaagguccugaacccguacaugcccaccgugaucgagcaccucgagcgccugcagcggaagcacggcgggaugcuggugcgcaacccccucagccggaacuccacccacgagauguacuggaucagcaacggcaccgggaacaucgucuccagcgugaacauggucucccgccugcugcucaaccgguucacgaugacccaccgccggcccaccaucgagaaggacguggaccugggcgccggcacccgccacgugaacgccgagccggagacgcccaacauggacgucaucggggagcggauccgccggaucaaggaggagcacagcuccaccuggcacuacgacgaggagaaccccuacaagaccugggcguaccacggcagcuacgaggugaaggccaccggguccgccagcagcaugaucaacggcguggucaagcugcucacgaagccgugggacguggugcccaccgucacccagauggccaugaccgacacgacccccuucgggcagcagcgcguguucaaggagaagguggacacccggacgccccgcccgaugcccggcacccggaaggccauggagaucaccgcggaguggcuguggcgcacccugggccggaacaagcgcccccggcucugcacccgcgaggaguucacgaagaagguccgcaccaacgccgccaugggggccguguucaccgaggagaaccagugggacuccgcgcgggccgccguggaggacgaggaguucuggaagcuggucgaccgcgagcgggagcugcacaagcucggcaagugcgggagcugcguguacaacaugaugggcaagcgcgagaagaagcugggggaguucggcaaggccaagggcucccgggccaucugguacauguggcugggggcgcgcuaccucgaguucgaggcccugggcuuccugaacgaggaccacugguucagccgggagaacuccuucagcgggguggagggcgaggggcuccacaagcugggcuacauccugcgcgacaucuccaagauccccggcggggccauguacgccgacgacaccgccggcugggacacgcggaucaccgaggacgaccuccacaacgaggagaagaucacccagcagauggacccggagcaccgccagcuggcgaacgccaucuucaagcugaccuaccagaacaaggucgugaaggugcagcggcccacgcccaaggggaccgucauggacaucaucagccgcaaggaccagcggggcuccggccagguggggaccuacggccucaacaccuucaccaacauggaggugcagcugauccgccagauggagggggagggcguccugagcaaggccgaccucgagaacccccaccuccuggagaaggagaucacgcaguggcucgagaccaaggggguggagcggcugaagcgcauggccaucuccggcgacgacugcguggucaagccgaucgacgaccgguucgccgacgcgcugcucgcccugaacgacaugggcaaggugcgcaaggacaucccccaguggcagcccagcaagggguggcacgacuggcagcagguccccuucugcucccaccacuuccacgagcugaucaugaaggacggccggaagcucgucgugccgugccgcccccaggacgagcugaucgggcgggcccgcaucagccagggcgccggguggucccugaaggagaccgccugccucggcaaggcguacgcccagaugugggcccugauguacuuccaccgccgggaccugcgccucgccagcaacgcgaucugcuccgccgugcccguccacugggugcccaccagccggacgaccugguccauccacgcccaccaccaguggaugaccaccgaggacaugcugacgguguggaaccgcgucuggaucgaggacaacccguggauggaggacaagacccccgugaccaccugggaggacgugcccuaccugggcaagcgggaggaccaguggugcgggagccucaucggccuggccagccgcgccacgugggcgcagaacauccugaccgccauccagcagguccggucccucaucgggaacgaggaguuccuggacuacaugcccagcaugaagcgcuuccggaaggaggaggaguccgagggcgccaucugguga

SEQ ID NO: 10348 - RNA, 9873 nt, Artificial Sequence
  derived and/or modified CDS sequence (opt1) from DENV-3__KC762684__SS-prME
accagccugugccucaugaugaugcugcccgccacccuggccuuccaccucaccagccgcgacggggagccccggaugaucguggggaagaacgagcgcggcaagagccugcuguucaagaccgccagcgggaucaacaugugcacccucaucgccauggaccugggcgagaugugcgacgacaccgugaccuacaagugcccccugaucaccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcgcgcagaccuggaugagcgccgagggcgccuggcggcaggucgagaagguggagacgugggccuuccgccaccccggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacgugaccaccgacagccgcugccccacgcagggcgaggccauccugcccgaggagcaggaccagaacuacgucugcaagcacaccuacguggaccggggguggggcaacgggugcggccucuucgggaagggcucccuggugaccugcgccaaguuccagugccuggagcucaucgagggcaaggucgugcagcacgagaaccugaaguacaccgugagcaucacgguccacaccggggaccagcaccaggugggcaacgagacccagggggucaccgccgagaucacgccccaggccuccaccguggaggcgauccugcccgaguacggcacccucgggcuggagugcagcccccgcaccggccuggacuucaacgagaugauccuccugaccaugaagaacaaggccuggauggugcaccggcagugguucuucgaccugccgcuccccuggacguccggcgccaccaccgagacccccacguggaacaagaaggagcugcuggucaccuucaagaacgcccacgccaagaagcaggagguggugguccucgggagccaggagggcgcgaugcacaccgcccugaccggggccacggagauccagaccuccggcgggaccagcaucuucgccggccaccugaagugccgccucaagauggacaagcuggagcugaagggcauguccuacgccaugugcagcaacgcguucgugcucaagaaggaggugagcgagacccagcacgggacgauccugaucaaggucgaguacaagggcgaggacgcccccugcaagauccccuucuccaccgaggacgggcagggcaaggcccacaacggccggcugaucaccgccaaccccguggugaccaagaaggaggagcccgucaacaucgaggcggagcccccguucggggagagcaacaucaucaucggcaucggggacaaggcccugaagaucaacugguacaagaagggcuccagcaucgggaagauguucgaggccacggcccgcggcgcccggcgcauggcgauccucggcgacaccgccugggacuucggguccgugggcggggugcugaacagccugggcaagaugguccaccagaucuucggguccgccuacaccgcccucuucagcggcguguccuggaucaugaagaucggcaucggggugcugcugaccuggaucggccucaacagcaagaacacguccaugagcuucuccugcaucgucaucgggaucaucacccuguaccugggcgccguggugcaggcggacauggggugcgucaucaacuggaagggcaaggagcucaagugcggcagcgggaucuucgugaccaacgaggugcacaccuggacggagcaguacaaguuccaggccgacucccccaagcggcuggccaccgccaucgccggcgcgugggagaacggggucugcggcauccgcagcaccacccgcauggagaaccugcucuggaagcagaucgccaacgagcugaacuacauccugugggagaacaacaucaagcucacggugguggucggggacaucaucggcauccuggagcagggcaagcggacccugacgccccagcccauggagcucaaguacuccuggaagaccugggggaaggccaagaucgugacggccgagaugcagaacagcuccuucaucaucgacggcccgaacacccccgagugccccaacgcgagccgcgccuggaacgugugggaggucgaggacuacggguucggcguguucaccaccaacaucuggcugaagcugcgggagauguacacgcagcucugcgaccaccgccugaugagcgccgccaucaaggacgagcgggccgugcacgcggacaugggcuacuggaucgagucccagaagaacgggagcuggaagcuggagaaggccucccucaucgaggucaagaccugcaccuggcccaagagccacacccugugguccaacggcgugcuggagagcgacaugaucaucccgaagucccucgccgggcccaucagccagcacaacuaccgccccggcuaccacacccagacggccgggccguggcaccugggcaagcuggagcucgacuucaacuacugcgagggcaccaccguggucaucaccgagaacugcgggacgcggggccccucccugcgcaccaccaccgugagcgggaagcugauccacgaguggugcugccgguccugcacgcugccgccccuccgcuacaugggcgaggacgggugcugguacggcauggagauccggccgaucaacgagcgcgaggagaacauggucaagagccugguguccgccggcagcgggaagguggacaacuucaccaugggcgugcucugccuggcgauccuguucgaggaggucaugcgggggaaguucggcaagaagcacaugaucgccgggguguucuucaccuucgugcuccugcuguccggccagaucaccuggcgcgacauggcccggacgcucaucaugaucggcagcaacgccuccgaccgcauggggaugggcgucaccuaccuggcccugaucgcgaccuucaagauccagcccuuccucgcccugggguucuuccugcggaagcucaccagccgcgagaaccugcugcucggcgugggccuggccauggccacgacccugcagcuccccgaggacaucgagcagauggcgaacgggaucgcccugggccugauggcccucaagcuggugacccaguucgagaccuaccagcuguggacggcccucgucagccugaugugcuccaacaccaucuucacccugaccguggccuggcggacggcgacccucauccuggccgggaucagccugcucccccugugccaguccagcggcaugcgcaagaccgacuggcugccgaugaccguggccgccaugggggugccgccccugccccuguucaucuucucccugaaggacacgcucaagcgccggagcuggccgcugaacgagggcgugauggccgucggccugguguccauccucgcgagcucccugcugcgcaacgacgugcccauggccgggccccucgucgccggcgggcugcugaucgccugcuacgugaucaccggcaccagcgccgaccucaccguggagaaggcggccgacgucacgugggaggaggaggccgagcagaccggggugucccacaaccugaugaucaccguggacgacgacggcaccaugcggaucaaggacgacgagacggagaacauccugaccguccuccugaagaccgcccugcucaucgugagcggcaucuuccccuacuccaucccggccacccugcugguguggcacaccuggcagaagcagacgcagcgcagcgggguccucugggacgugcccagcccgcccgagacccagaaggcggagcuggaggagggcguguaccggaucaagcagcaggggaucuucggcaagacccaggucggggugggcgugcagaaggagggcgucuuccacaccauguggcacgugacgcgcggggccgugcugaccuacaacggcaagcggcucgagccgaacugggccagcgucaagaaggaccugaucuccuacgggggcggguggcgccugagcgcccaguggcagaagggcgaggagguccaggugaucgcggucgagcccggcaagaaccccaagaacuuccagaccaugcccgggaucuuccagaccacgaccggcgagaucggggccaucgcccuggacuucaagccgggcaccuccggcagccccaucaucaaccgggaggggaagguggugggccucuacgggaacggcgucgugaccaagaacgggggcuacgugagcggcaucgcccagacguccgccgagcccgacgggccgacccccgagcuggaggaggagauguucaagaagcgcaaccugaccaucauggaccuccaccccggcagcgggaagacccggaaguaccugcccgcgaucguccgcgaggccaucaagcggcgccugcggacgcucauccuggccccgacccgcgugguggccgccgagauggaggaggcgcugaagggccuccccauccgguaccagaccaccgccacgaaguccgagcacaccgggaaggagaucgucgaccugaugugccacgccaccuucaccaugcgccugcucagccccgugcgggugcccaacuacaaccugaucaucauggacgaggcccacuucacggacccggccuccaucgcggcccgcggcuacaucagcacccgggucggcaugggggaggccgccgcgaucuucaugaccgccacgccgcccggcacggccgacgccuucccccaguccaacgccccgauccaggacgaggagcgcgacauccccgagcgcagcuggaacuccgggaacgacuggaucaccgacuucgcgggcaagaccgugugguucgugcccagcaucaaggccgggaacgacaucgccaacugccugcggaagaacggcaagaaggucauccagcucucccgcaagaccuucgacacggaguaccagaagaccaagcugaacgacugggacuucguggugaccaccgacaucagcgagaugggcgccaacuucaaggccgaccgggucaucgacccccgccggugccugaagccggugauccucacggacgggcccgagcgcgugauccuggcgggccccaugcccgucaccguggccuccgccgcccagcggcgcgggcgggugggccgcaacccgcagaaggagaacgaccaguacaucuucaccgggcagccccugaacaacgacgaggaccacgcccacuggaccgaggcgaagaugcuccuggacaacaucaacacgcccgagggcaucauccccgcccuguucgagccggagcgggagaaguccgccgccaucgacggcgaguaccgccucaagggggagucccggaagaccuucgucgagcugaugcgccggggcgaccugcccguguggcucgcgcacaagguggccagcgaggggaucaaguacaccgaccgcaaguggugcuucgacggcgagcggaacaaccagauccuggaggagaacauggacgucgagaucuggaccaaggagggcgagaagaagaagcugcgcccccgguggcucgacgcccgcaccuacuccgacccccuggcccugaaggaguucaaggacuucgccgcggggcgcaagagcaucgcccucgaccuggugacggagaucggccgggucccgucccaccuggcccaccgcacccggaacgcccucgacaaccuggugaugcugcacaccagcgagcacgggggccgcgccuaccggcacgcgguggaggagcuccccgagaccauggagacgcugcugcuccuggggcugaugauccuccugaccggcggcgucaugcuguuccucaucagcgggaagggcguggggaagaccuccaucggccugaucugcguggucgccagcuccagcaugcuguggauggccgacaucccccuccaguggaucgccuccgccaucgugcuggaguucuucaugauggugcugcucaucccggagcccgagaagcagcgcacgccccaggacaaccagcuggcguacgucgugaucgggauccugacgcucgccgccaucguggccgccaacgagaugggccugcuggagaccaccaagcgggaccucggcaugagcaaggagcccggggucguguccccgaccagcuaccuggacguggaccugcaccccgcguccgccuggacgcucuacgccgucgccaccaccgugaucacccccaugcugcgccacacgaucgagaacagcaccgcgaacgugucccuggccgccaucgccaaccaggccgucgugcucaugggccuggacaagggguggcccaucagcaagauggaccugggcgugccgcuccuggcgcuggggugcuacucccaggucaacccccucacccugaccgccgccgugcugcuccuggugacgcacuacgccaucaucggccccggccugcaggccaaggcgacccgggaggcccagaagcgcaccgccgccgggaucaugaagaaccccaccgucgacggcaucaugacgaucgaccucgacccggugaucuacgacagcaaguucgagaagcagcugggccaggugaugcugcucguccugugcgccgugcagcugcuccugaugcggaccuccugggcguucugcgaggcccugacccucgccaccggccccaucacgacccugugggagggcagccccgggaaguucuggaacaccaccaucgccguguccauggcgaacaucuuccgcggcagcuaccuggccggggccggccucgccuucuccaucaugaaguccgucgggacgggcaagcggggcaccgggagccagggcgagacccugggggagaaguggaagaagaagcugaaccagcucucccgcaaggaguucgaccuguacaagaaguccggcaucaccgagguggaccggacggaggccaaggaggggcugaagcgcggcgagaucacccaccacgcggugucccggggcagcgccaagcuccagugguucgucgagcgcaacauggugauccccgaggggcgggugaucgaccugggcugcgggcgcggcgggugguccuacuacugcgccggccugaagaaggucaccgaggugcggggcuacaccaagggcgggccggggcacgaggagcccgugcccaugagcaccuacggcuggaacaucgucaagcucauguccgggaaggacguguucuaccugcccccggagaagugcgacacgcugcugugcgacaucggcgagagcucccccagccccaccguggaggagucccgcaccauccgcguccucaagaugguggagcccuggcugaagaacaaccaguucugcaucaaggugcugaacccguacaugcccgccgucaucgagcaccucgagcggcugcagcgcaagcacggcgggaugcuggugcggaacccccucagccgcaacuccacccacgagauguacuggaucagcaacggcacggggaacaucguguccagcgucaacauggugucccggcugcugcucaaccgcuucaccaugaccuaccggcgccccaccaucgagaaggacguggaccugggcgccggcacgcggcacgucaacgcggagccggagacccccaacauggacgugaucggggagcgcauccggcgcaucaaggaggagcacagcuccaccuggcacuacgacgacgagaaccccuacaagaccugggccuaccacggcagcuacgaggucaaggccacggggagcgccuccagcaugaucaacggcguggugaagcugcucaccaagccgugggacgucgugcccaccgugacccagauggccaugacggacaccacccccuucgggcagcagcgggucuucaaggagaagguggacacccgcacgcccaagccgaugcccggcacccggaaggugauggagaucaccgcggaguggcuguggcgcacccugggccggaacaagcgcccccggcucugcacgcgcgaggaguucaccaagaagguccgcaccaacgccgccaugggggccguguucaccgaggagaaccagugggacuccgcgcgggccgccguggaggacgaggaguucuggaagcuggucgaccgcgagcgggagcugcacaagcucggcaagugcgggagcugcguguacaacaugaugggcaagcgcgagaagaagcugggggaguucggcaaggccaagggcucccgggccaucugguacauguggcugggggcgcgcuaccucgaguucgaggcccugggcuuccugaacgaggaccacugguucagccgggagaacuccuacagcgggguggagggcgaggggcuccacaagcugggcuacauccugcgcgacaucuccaagauccccggcggggccauguacgccgacgacacggccggcugggacacccggaucaccgaggacgaccuccacaacgaggagaagaucacccagcagauggacccggagcaccgccagcuggcgaacgccaucuucaagcugacguaccagaacaaggucgugaaggugcagcggcccacccccaaggggaccgucauggacaucaucagccgcaaggaccagcggggcuccggccagguggggaccuacggccucaacacguucaccaacauggaggcccagcugauccgccagauggagggggagggcgugcugagcaagaccgaccucgagaacccccaccuccuggagaagaagaucacccaguggcucgagaccaagggggucgagcggcugaagcgcauggccaucuccggcgacgacugcguggugaagccgaucgacgaccgguucgccaacgcgcugcucgcccugaacgacaugggcaagguccgcaaggacaucccccaguggcagcccagcaagggguggcacgacuggcagcagguccccuucugcucccaccacuuccacgagcugaucaugaaggacggccggaagcucguggucccgugccgcccccaggacgagcugaucgggcgggcccgcaucagccagggcgccggguggucccugaaggagacggccugccucggcaaggcguacgcccagaugugggcccugauguacuuccaccgccgggaccugcgccucgccagcaacgcgaucugcuccgccgugcccgugcacuggguccccaccagccggaccaccuggagcauccacgcccaccaccaguggaugacgaccgaggacaugcugaccguguggaaccgcguguggaucgaggacaacccguggauggaggacaagacccccgucacgaccugggaggacgugcccuaccugggcaagcgggaggaccaguggugcgggucccucaucggccugaccagccgcgccaccugggcccagaacauccugacggcgauccagcagguccggucccucaucgggaacgaggaguuccuggacuacaugcccagcaugaagcgcuuccggaaggaggaggaguccgagggcgccaucugguga

SEQ ID NO: 10349 - RNA, 9873 nt, Artificial Sequence
  derived and/or modified CDS sequence (opt1) from DENV-3__KC762686__SS-prME
accagccugugccucaugaugaugcugcccgccacccuggccuuccaccucaccucccgcgacggggagccccggaugaucguggggaagaacgagcgcggcaagagccugcuguucaagaccgccuccgggaucaacaugugcacccucaucgccauggaccugggcgagaugugcgacgacaccgugacguacaagugcccccugaucaccgagguggagcccgaggacaucgacugcuggugcaaccucaccagcaccugggugacguacgggaccugcaaccaggccggcgagcaccggcgcgacaagcgguccguggcccuggcgccccacgugggcauggggcuggacacccgcgcgcagaccuggaugagcgccgagggcgccuggcgccagguggagaagguggagacgugggccuuccgccaccccggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacgugaccaccgacagccgcugccccacgcagggcgaggccauccugcccgaggagcaggaccagaacuacgucugcaagcacaccuacguggaccggggguggggcaacgggugcggccucuucgggaagggcucccuggugaccugcgccaaguuccagugccuggaguucaucgagggcaaggucgugcagcacgagaaccucaaguacaccgugaucaucacgguccacaccggggaccagcaccaggugggcaacgagacccagggggucaccgccgagaucacgccccaggccagcaccguggaggcgauccugcccgaguacggcacccuggggcucgagugcagcccccggaccggccuggacuucaacgagaugauccugcucaccaugaagaacaaggccuggauggugcaccggcagugguucuucgaccugccgcugcccuggacgagcggcgccaccaccgagacccccacguggaacaagaaggagcuccuggucaccuucaagaacgcccacgccaagaagcaggagguggugguccuggggucccaggagggcgcgaugcacaccgcccucaccggggccacggagauccagaccagcggcgggaccuccaucuucgccggccaccugaagugccgccugaagauggacaagcucgagcugaagggcaugagcuacgccaugugccugaacgcguucgugcucaagaaggagguguccgagacccagcacgggacgauccugaucaaggucgaguacaagggcgaggacgcccccugcaagaucccguucagcaccgaggacgggcagggcaaggcccacaacggccggcugaucaccgccaaccccguggugaccaagaaggaggagcccaucaacaucgaggcggagcccccguucggggagagcaacaucgucaucggcaucggggacaaggcccugaagaucaacugguacaagaagggcuccagcaucgggaagauguucgaggccacggcccgcggcgcccggcgcauggcgauccucggcgacaccgccugggacuucggguccgugggcggggugcugaacagccugggcaagaugguccaccagaucuucggguccgccuacaccgcccucuucagcggcguguccuggaucaugaagaucggcaucggggugcugcugaccuggaucggccucaacagcaagaacacguccaugagcuucuccugcaucgucaucgggaucaucacccuguaccugggcgccguggugcaggcggacauggggugcgucaucaacuggaagggcaaggagcucaagugcggcagcgggaucuucgugaccaacgaggugcacaccuggacggagcaguacaaguuccaggccgacucccccaagcggcuggccaccaccaucgccggcgccugggagaacggggucugcggcauccgcagcaccacgcgcauggagaaccugcucuggaagcagaucgcgaacgagcugaacuacauccugugggagaacaacaucaagcucaccgugguggucggggacaucaucggcgugcuggagcagggcaagcggacccugacgccccagcccauggagcucaaguacuccuggaagacgugggggaaggccaagaucgugaccgccgagacccagaacagcuccuucaucaucgacggcccgaacacccccgagugccccagcgccucccgcgcguggaacgucugggagguggaggacuacggguucggcguguucacgaccaacaucuggcugaagcugcgggagauguacacccagcucugcgaccaccgccugaugagcgccgccgucaaggacgagcgggccgugcacgccgacaugggcuacuggaucgagagccagaagaacggguccuggaagcuggagaaggcgagccucaucgaggugaagaccugcaccuggcccaagucccacacgcuguggagcaacggcguccuggaguccgacaugaucauccccaagucccucgccgggcccgugucccagcacaaccaccgccccggcuaccacacccagaccgccgggccguggcaccugggcaagcuggagcucgacuucaacuacugcgagggcaccacgguggucaucaccgagaacugcgggacccggggccccagccugcgcaccacgaccguguccgggaagcugauccacgaguggugcugccggagcugcacccugccgccccuccgcuacaugggcgaggacgggugcugguacggcauggagauccggccgaucaacgagaaggaggagaacauggugaagucccuggucagcgccggcuccgggaagguggacaacuucaccaugggcgugcucugccuggccauccuguucgaggaggucaugcgcgggaaguucggcaagaagcacaugaucgcggggguccuguucacguucgugcugcugcucagcggccagaucaccuggcgggacauggcccgcacccugaucaugaucggcuccaacgccagcgaccggauggggaugggcgucaccuaccuggcccucaucgccacguucaagauccagcccuuccuggcgcugggguucuuccuccgcaagcugaccucccgggagaaccugcuccugggcgugggccuggccauggccaccacccuccagcugcccgaggacaucgagcagauggccaacgggaucgcgcugggccucauggcccugaagcugaucacgcaguucgagaccuaccagcucuggaccgcccuggugagccugaugugcagcaacaccaucuucacgcucaccgucgccuggcgcaccgccacccugauccuggcggggaucucccuccugcccgugugccagagcuccagcaugcggaagacggacuggcugccggucaccguggccgccaugggcgugccgccccucccccuguucaucuucucccugaaggacacccucaagcgccgcagcuggccgcugaacgagggggucauggccgugggccugguguccauccucgccagcucccugcugcggaacgacguccccauggcgggcccccucguggccgggggccugcugaucgccugcuacgugaucaccgggacgagcgccgaccucaccgucgagaaggccgcggacgugaucugggaggaggaggccgagcagaccggcgugucccacaaccugaugaucaccgucgacgacgacgggacgaugcgcaucaaggacgacgagaccgagaacauccugaccgugcuccugaagaccgcccugcucaucgugagcggcaucuuccccuacuccaucccggccacccugcuggucuggcacacguggcagaagcagacccagcggagcggcgugcucugggacgugcccagcccgcccgagacccagaaggccgagcuggaggagggggucuaccgcaucaagcagcagggcaucuucgggaagacccaggugggcguggggguccagaaggagggcguguuccacacgauguggcacgugacccggggcgcgguccugacccacaacgggaagcgccucgagccgaacugggccagcgugaagaaggaccugaucuccuacggcgggggcuggcggcugagcgcccaguggcagaagggggaggaggugcaggucaucgccguggagcccggcaagaaccccaagaacuuccagaccaugcccggcaucuuccagacgaccaccggggagaucggcgcgaucgcccuggacuucaagccggggaccuccggcagccccaucaucaaccgcgagggcaagguggucgggcucuacggcaacgggguggugacgaagaacggcggguacgucagcggcaucgcccagaccaacgccgagcccgacggcccgacccccgagcuggaggaggagauguucaagaagcggaaccugaccaucauggaccuccaccccggguccggcaagacgcgcaaguaccugcccgccaucgugcgggaggcgaucaagcgccggcugcgcacccucauccuggccccgacccggguggucgccgccgagauggaggaggcccugaaggggcuccccauccgcuaccagaccacggcgaccaagagcgcccacaccggcaaggagaucguggaccugaugugccacgccaccuucacgaugcggcugcucucccccgugcgcguccccaacuacaaccugaucaucauggacgaggcccacuucaccgacccggccagcaucgcggcccggggguacaucuccacccgcgugggcaugggcgaggccgccgcgaucuucaugaccgccacgccgcccgggaccgccgacgccuucccccagagcaacgccccgauccaggacgaggagcgggacauccccgagcgcuccuggaacagcggcaacgaguggaucaccgacuucgcggggaagaccgugugguucguccccuccaucaaggccggcaacgacaucgccaacugccugcgcaagaacgggaagaaggugauccagcucagccggaagacguucgacaccgaguaccagaagaccaagcugaacgacugggacuucguggucaccacggacaucuccgagaugggcgccaacuucaaggccgaccgcgugaucgacccccggcgcugccugaagccggugauccucaccgacggccccgagcgggucauccuggcggggcccaugcccgugaccguggccagcgccgcccagcgccggggccgcgucgggcggaacccgcagaaggagaacgaccaguacaucuucaccggccagccccugaacaacgacgaggaccacgcccacuggacggaggcgaagaugcuccuggacaacaucaacacccccgaggggaucauccccgcccuguucgagccggagcgcgagaaguccgccgccaucgacggcgaguaccggcucaagggcgagagccgcaagaccuucguggagcugaugcggcgcggggaccugcccgucuggcucgcgcacaagguggccuccgagggcaucaaguacaccgaccggaaguggugcuucgacggggagcgcaacaaccagauccuggaggagaacauggacguggagaucuggaccaaggagggcgagaagaagaagcugcggccccgcuggcucgacgcccggacguacagcgacccccuggcccugaaggaguucaaggacuucgccgcgggccgcaaguccaucgcccucgaccuggucaccgagaucgggcgcgugccgagccaccuggcccaccggacccgcaacgcccucgacaaccuggugaugcugcacaccuccgagcacggcgggcgggccuaccgccacgcggucgaggagcuccccgagacgauggagacccugcugcuccugggccugaugauccuccugaccgggggcgccaugcuguuccucaucagcggcaaggggaucggcaagaccagcaucgggcugaucugcgugguggccuccagcggcaugcuguggauggccgacgucccccuccaguggaucgccuccgcgaucgugcuggaguucuucaugauggugcugcucaucccggagcccgagaagcagcggacgccccaggacaaccagcuggccuacgucgugaucgggauccugacccucgccgccaucguggccgcgaacgagaugggccugcuggagaccaccaagcgcgaccucggcaugagcaaggagcccggggucguguccccgacgagcuaccuggacguggaccugcaccccgccuccgccuggacccucuacgccgucgcgaccaccgugaucacgcccaugcugcggcacaccaucgagaacagcaccgccaacgugucccuggccgccaucgccaaccaggcggucgugcucaugggccuggacaagggguggcccaucagcaagauggaccugggcgugccgcuccuggcccuggggugcuacucccaggucaacccccucacccugacggccgccgugcugcuccuggugacccacuacgccaucaucggccccggccugcaggcgaaggccacccgcgaggcccagaagcggaccgccgccgggaucaugaagaaccccacggucgacggcaucaugaccaucgaccucgacccggugaucuacgacagcaaguucgagaagcagcugggccaggugaugcugcucguccugugcgcggugcagcugcuccugaugcgcaccuccugggccuucugcgaggcccugacccucgccacgggccccaucaccacccugugggagggcagccccgggaaguucuggaacaccacgaucgcgguguccauggccaacaucuuccggggcagcuaccuggccggggccggccucgccuucuccaucaugaaguccgucgggaccggcaagcgcggcaccgggagccagggcgagacccugggggagaaguggaagaagaagcugaaccagcucagccggaaggaguucgaccuguacaagaaguccggcaucacggagguggaccgcaccgaggcgaaggaggggcugaagcggggcgagaucacccaccacgccgugucccgcggcagcgccaagcuccagugguucgucgagcggaacauggugauccccgaggggcgcgugaucgaccugggcugcgggcggggcgggugguccuacuacugcgccggccugaagaaggucaccgaggugcgcggcuacaccaagggcgggccggggcacgaggagcccgugcccaugagcacguacggcuggaacaucgucaagcucauguccgggaaggacguguucuaccugcccccggagaagugcgacacccugcugugcgacaucggcgagagcucccccagccccaccguggaggagucccggaccauccgcguccucaagaugguggagcccuggcugaagaacaaccaguucugcaucaaggugcugaacccguacaugcccacggucaucgagcaccucgagcgccugcagcggaagcacggcgggaugcuggugcgcaacccccucagccggaacuccacccacgagauguacuggaucagcaacggcaccgggaacaucguguccagcgucaacauggugucccgccugcugcucaaccgguucaccaugacgcaccgccggcccaccaucgagaaggacgucgaccugggcgccggcacccgccacgugaacgcggagccggagacccccaacauggacgugaucggggagcggauccgccggaucaaggaggagcacagcuccacguggcacuacgacgaggagaaccccuacaagaccugggccuaccacggcagcuacgaggucaaggccaccggguccgccagcagcaugaucaacggcguggugaagcugcucaccaagccgugggacgucgugcccacggugacccagauggccaugaccgacaccacgcccuucgggcagcagcgcgucuucaaggagaagguggacacccggacgccccgcccgaugcccggcacccggaaggcgauggagaucaccgccgaguggcuguggcgcacccugggccggaacaagcgcccccggcucugcacccgcgaggaguucaccaagaaggugcgcacgaacgccgccaugggggcggucuucaccgaggagaaccagugggacuccgcccgggccgccguggaggacgaggaguucuggaagcugguggaccgcgagcgggagcugcacaagcucggcaagugcgggagcugcgucuacaacaugaugggcaagcgcgagaagaagcugggggaguucggcaaggccaagggcucccgggcgaucugguacauguggcugggggcccgcuaccucgaguucgaggcccugggcuuccugaacgaggaccacugguucagccgggagaacuccuucagcgggguggagggcgaggggcuccacaagcugggcuacauccugcgcgacaucuccaagauccccggcggggccauguacgccgacgacaccgcgggcugggacacccggaucacggaggacgaccuccacaacgaggagaagaucacccagcagauggagccggagcaccgccagcuggccaacgccaucuucaagcugaccuaccagaacaagguggucaaggugcagcggcccacccccaaggggacggugauggacaucaucagccgcaaggaccagcggggcuccggccaggucgggaccuacggccucaacaccuucaccaacauggaggugcagcugauccgccagauggagggggagggcgugcugagcaaggccgaccucgagaacccccaccuccuggagaaggagaucacccaguggcucgagacgaagggggucgagcggcugaagcgcauggccaucuccggcgacgacugcguggugaagccgaucgacgaccgguucgcggacgcccugcucgcccugaacgacaugggcaagguccgcaaggacaucccccaguggcagcccagcaagggguggcacgacuggcagcagguccccuucugcucccaccacuuccacgagcugaucaugaaggacggccggaagcucguggucccgugccgcccccaggacgagcugaucgggcgggcccgcaucagccagggcgccggguggucccugaaggagaccgcgugccucggcaaggccuacgcccagaugugggcccugauguacuuccaccgccgggaccugcgccucgcgagcaacgccaucugcuccgccgugcccgugcacuggguccccaccagccggaccacgugguccauccacgcccaccaccaguggaugaccaccgaggacaugcugaccguguggaaccgcguguggaucgaggacaacccguggauggaggacaagacgcccgucaccaccugggaggacgugcccuaccugggcaagcgggaggaccaguggugcgggagccucaucggccuggccagccgcgcgaccugggcccagaacauccugacggccauccagcagguccggucccucaucgggaacgaggaguuccuggacuacaugcccagcaugaagcgcuuccggaaggaggaggaguccgagggcgccaucugguga

SEQ ID NO: 10350 - RNA, 9873 nt, Artificial Sequence
  derived and/or modified CDS sequence (opt1) from DENV-3__KC762685__SS-prME
accagccugugccucaugaugaugcugcccgccacccuggccuuccaccucaccucccgcgacggcgagccccggaugaucguggggaagaacgagcgcggcaagagccugcuguucaagaccgccuccgggaucaacaugugcacccucaucgccauggaccugggcgagaugugcgacgacaccgugaccuacaagugcccccugaucaccgagguggagcccgaggacaucgacugcuggugcaaccucaccagcaccugggugacguacgggaccugcaaccaggccggcgagcaccggcgcgacaagcgguccguggcccuggcgccccacgugggcauggggcuggacacccgcgcgcagaccuggaugagcgccgagggcgccuggcggcaggucgagaaggucgagacgugggccuuccgccaccccggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacgugaccaccgacagccgcugccccacgcagggcgaggccauccugcccgaggagcaggaccagaacuacgucugcaagcacaccuacguggaccggggguggggcaacgggugcggccucuucgggaagggcucccuggugaccugcaccaaguuccagugccuggaguucaucgagggcaaggucgugcagcacgagaaccucaaguacacggugaucaucaccguccacaccggggaccagcaccaggugggcaacgagacccagggggucacggccgagaucacgccccaggccagcaccguggaggccauccugcccgaguacggcacccuggggcucgagugcagcccccgcaccggccuggacuucaacgagaugauccugcucacgaugaagaacaaggcguggauggugcaccggcagugguucuucgaccugccgcugcccuggaccagcggcgccaccaccgagacgcccaccuggaacaagaaggagcuccuggucaccuucaagaacgcccacgccaagaagcaggagguggugguccuggggucccaggagggcgccaugcacaccgcgcucacgggggccaccgagauccagaccagcggcgggaccuccaucuucgccggccaccugaagugccgccugaagauggacaagcucgagcugaagggcaugagcuacgccaugugccugaacgccuucgugcucaagaaggagguguccgagacgcagcacgggaccauccugaucaaggucgaguacaagggcgaggacgcgcccugcaagaucccguucagcaccgaggacgggcagggcaaggcccacaacggccggcugaucaccgccaaccccguggugacgaagaaggaggagcccgucaacaucgaggccgagcccccguucggggagagcaacaucgugaucggcaucggggacaaggcgcugaagaucaacugguacaagaagggcuccagcaucgggaagauguucgaggccaccgcccgcggcgcccggcgcauggccauccucggcgacaccgcgugggacuucggguccgugggcgggguccugaacagccugggcaagauggugcaccagaucuucggguccgccuacaccgcccucuucagcggcguguccuggaucaugaagaucggcaucgggguccugcugacguggaucggccucaacagcaagaacaccuccaugagcuucuccugcaucgugaucgggaucaucacccuguaccugggcgccgugguccaggccgacauggggugcgugaucaacuggaagggcaaggagcucaagugcggcagcgggaucuucgugaccaacgagguccacacguggaccgagcaguacaaguuccaggcggacucccccaagcggcuggccaccgccaucgccggcgccugggagaacggggugugcggcauccgcagcaccacgcgcauggagaaccugcucuggaagcagaucgcgaacgagcugaacuacauccugugggagaacaacaucaagcucaccguggucgugggggacaucaucggcgugcuggagcagggcaagcggacccugacgccccagcccauggagcucaaguacuccuggaagacgugggggaaggccaagaucgucaccgccgagacccagaacagcuccuucaucaucgacggcccgaacacccccgagugccccagcgccucccgcgcguggaacgugugggagguggaggacuacggguucggcgucuucacgaccaacaucuggcugaagcugcgggagauguacacccagcucugcgaccaccgccugaugagcgccgccgugaaggacgagcgggccgugcacgccgacaugggcuacuggaucgagagccagaagaacggguccuggaagcuggagaaggcgagccucaucgaggucaagaccugcaccuggcccaagucccacacgcuguggagcaacggcgugcuggaguccgacaugaucauccccaagucccucgccgggcccgugucccagcacaacuaccgccccggcuaccacacccagaccgccgggccguggcaccugggcaagcuggagcucgacuucaacuacugcgagggcaccacggucgugaucaccgagaacugcgggacccggggccccagccugcgcaccacgaccguguccgggaagcugauccacgaguggugcugccggagcugcacccugccgccccuccgcuacaugggcgaggacgggugcugguacggcauggagauccggccgaucaacgagaaggaggagaacauggucaagucccuggugagcgccggcuccgggaagguggacaacuucaccaugggcguccucugccuggccauccuguucgaggaggugaugcgcgggaaguucggcaagaagcacaugaucgcggggguccuguucacguucguccugcugcucagcggccagaucaccuggcgggacauggcccgcacccugaucaugaucggcuccaacgccagcgaccggauggggaugggcgugaccuaccuggcccucaucgccacguucaagauccagcccuuccuggcgcugggguucuuccuccgcaagcugaccucccgggagaaccugcuccugggcgugggccuggccauggccaccacccuccagcugcccgaggacaucgagcagauggccaacgggaucgcgcugggccucauggcccugaagcugaucacgcaguucgagaccuaccagcucuggaccgcccuggucagccugaugugcagcaacaccaucuucacgcucaccguggccuggcgcaccgccacccugauccuggcggggaucucccuccugcccgucugccagagcuccagcaugcggaagacggacuggcugccggugaccguggccgccaugggcgugccgccccucccccuguucaucuucucccugaaggacacccucaagcgccgcagcuggccgcugaacgagggggugauggccgugggccuggucuccauccucgccagcucccugcugcggaacgacgugcccauggcgggcccccucguggccgggggccugcugaucgccugcuacgucaucaccgggacgagcgccgaccucaccguggagaaggccgcggacgugaucugggaggaggaggccgagcagaccggcgucucccacaaccugaugaucaccguggacgacgacgggacgaugcgcaucaaggacgacgagaccgagaacauccugaccgugcuccugaagaccgcccugcucaucgucagcggcaucuuccccuacuccaucccggccacccugcugguguggcacacguggcagaagcagacccagcggagcggcgugcucugggacguccccagcccgcccgagacccagaaggccgagcuggaggaggggguguaccgcaucaagcagcagggcaucuucgggaagacccaggugggcgucggggugcagaaggagggcguguuccacacgauguggcacgucacccggggcgcggugcugacccacaacgggaagcgccucgagccgaacugggccagcgugaagaaggaccugaucuccuacggcgggggcuggcggcugagcgcccaguggcagaagggggaggagguccaggugaucgccguggagcccggcaagaaccccaagaacuuccagaccaugcccggcaucuuccagacgaccaccggggagaucggcgcgaucgcccuggacuucaagccggggaccuccggcagccccaucaucaaccgcgagggcaaggucguggggcucuacggcaacgggguggucacgaagaacggcggguacgugagcggcaucgcccagaccaacgccgagcccgacggcccgacccccgagcuggaggaggagauguucaagaagcggaaccugaccaucauggaccuccaccccggguccggcaagacgcgcaaguaccugcccgccaucgugcgggaggcgaucaagcgccggcugcgcacccucauccuggccccgacccgggucguggccgccgagauggaggaggcccugaaggggcuccccauccgcuaccagaccacggcgaccaagagcgcccacaccggcaaggagaucguggaccugaugugccacgccaccuucacgaugcggcugcucucccccguccgcgugcccaacuacaaccugaucaucauggacgaggcccacuucaccgacccggccagcaucgcggcccggggguacaucuccacccgcgugggcaugggcgaggccgccgcgaucuucaugaccgccacgccgcccgggaccgccgacgccuucccccagagcaacgccccgauccaggacgaggagcgggacauccccgagcgcuccuggaacagcggcaacgaguggaucaccgacuucgcggggaagaccgucugguucgugcccuccaucaaggccggcaacgacaucgccaacugccugcgcaagaacgggaagaaggugauccagcucagccggaagacguucgacaccgaguaccagaagaccaagcugaacgacugggacuucgucgugaccacggacaucuccgagaugggcgccaacuucaaggccgaccgcgugaucgacccccggcgcugccugaagccggucauccucaccgacggccccgagcgggugauccuggcggggcccaugcccgugaccgucgccagcgccgcccagcgccggggccgcguggggcggaacccgcagaaggagaacgaccaguacaucuucaccggccagccccugaacaacgacgaggaccacgcccacuggacggaggcgaagaugcuccuggacaacaucaacacccccgaggggaucauccccgcccuguucgagccggagcgcgagaaguccgccgccaucgacggcgaguaccggcucaagggcgagagccgcaagaccuucgucgagcugaugcggcgcggggaccugcccguguggcucgcgcacaagguggccuccgagggcaucaaguacaccgaccggaaguggugcuucgacggggagcgcaacaaccagauccuggaggagaacauggacgucgagaucuggaccaaggagggcgagaagaagaagcugcggccccgcuggcucgacgcccggacguacagcgacccccuggcccugaaggaguucaaggacuucgccgcgggccgcaaguccaucgcccucgaccuggugaccgagaucgggcgcgugccgagccaccuggcccaccggacccgcaacgcccucgacaaccuggucaugcugcacaccuccgagcacggcgggcgggccuaccgccacgcgguggaggagcuccccgagacgauggagacccugcugcuccugggccugaugauccuccugaccgggggcgccaugcuguuccucaucagcggcaaggggaucggcaagaccagcaucgggcugaucugcguggucgccuccagcggcaugcuguggauggccgacgugccccuccaguggaucgccuccgcgaucgugcuggaguucuucaugaugguccugcucaucccggagcccgagaagcagcggacgccccaggacaaccagcuggccuacguggugaucgggauccugacccucgccgccaucgucgccgcgaacgagaugggccugcuggagaccaccaagcgcgaccucggcaugagcaaggagcccggggugguguccccgacgagcuaccuggacgucgaccugcaccccgccuccgccuggacccucuacgccguggcgaccaccgugaucacgcccaugcugcggcacaccaucgagaacagcaccgccaacgucucccuggccgccaucgccaaccaggcgguggugcucaugggccuggacaagggguggcccaucagcaagauggaccugggcgucccgcuccuggcccuggggugcuacucccaggugaacccccucacccugacggccgccgugcugcuccuggucacccacuacgccaucaucggccccggccugcaggcgaaggccacccgcgaggcccagaagcggaccgccgccgggaucaugaagaaccccacgguggacggcaucaugaccaucgaccucgacccggugaucuacgacagcaaguucgagaagcagcuggggcaggucaugcugcucgugcugugcgcggugcagcugcuccugaugcgcaccuccugggccuucugcgaggcccugacccucgccacgggccccaucaccacccugugggagggcagccccgggaaguucuggaacaccacgaucgcggucuccauggccaacaucuuccggggcagcuaccuggccggggccggccucgccuucuccaucaugaaguccguggggaccggcaagcgcggcaccgggagccagggcgagacccugggggagaaguggaagaagaagcugaaccagcucagccggaaggaguucgaccuguacaagaaguccggcaucacggagguggaccgcaccgaggcgaaggaggggcugaagcggggcgagaucacccaccacgccgucucccgcggcagcgccaagcuccagugguucguggagcggaacauggugauccccgaggggcgcgucaucgaccugggcugcgggcggggcgggugguccuacuacugcgccggccugaagaaggugaccgaggugcgcggcuacaccaagggcgggccggggcacgaggagcccguccccaugagcacguacggcuggaacaucgugaagcucauguccgggaaggacguguucuaccugcccccggagaagugcgacacccugcugugcgacaucggcgagagcucccccagccccaccgucgaggagucccggaccauccgcgugcucaagaugguggagcccuggcugaagaacaaccaguucugcaucaagguccugaacccguacaugcccacggugaucgagcaccucgagcgccugcagcggaagcacggcgggaugcuggugcgcaacccccucagccggaacuccacccacgagauguacuggaucagcaacggcaccgggaacaucgucuccagcgugaacauggucucccgccugcugcucaaccgguucaccaugacgcaccgccggcccaccaucgagaaggacguggaccugggcgccggcacccgccacgugaacgcggagccggagacccccaacauggacgucaucggggagcggauccgccggaucaaggaggagcacagcuccacguggcacuacgacgaggagaaccccuacaagaccugggccuaccacggcagcuacgaggugaaggccaccggguccgccagcagcaugaucaacggcguggucaagcugcucaccaagccgugggacguggugcccacggucacccagauggccaugaccgacaccacgcccuucgggcagcagcgcguguucaaggagaagguggacacccggacgccccgcccgaugcccggcacccggaaggcgauggagaucaccgccgaguggcuguggcgcacccugggccggaacaagcgcccccggcucugcacccgcgaggaguucaccaagaagguccgcacgaacgccgccaugggggcgguguucaccgaggagaaccagugggacuccgcccgggccgccguggaggacgaggaguucuggaagcuggucgaccgcgagcgggagcugcacaagcucggcaagugcgggagcugcguguacaacaugaugggcaagcgcgagaagaagcugggggaguucggcaaggccaagggcucccgggcgaucugguacauguggcugggggcccgcuaccucgaguucgaggcccugggcuuccugaacgaggaccacugguucagccgggagaacuccuucagcgggguggagggcgaggggcuccacaagcugggcuacauccugcgcgacaucuccaagauccccggcggggccauguacgccgacgacaccgcgggcugggacacccggaucacggaggacgaccuccacaacgaggagaagaucacccagcagauggagccggagcaccgccagcuggccaacgccaucuucaagcugaccuaccagaacaaggucgugaaggugcagcggcccacccccaaggggacggucauggacaucaucagccgcaaggaccagcggggcuccggccagguggggaccuacggccucaacaccuucaccaacauggaggugcagcugauccgccagauggagggggagggcguccugagcaaggccgaccucgagaacccccaccuccuggagaaggagaucacccaguggcucgagacgaaggggguggagcggcugaagcgcauggccaucuccggcgacgacugcguggucaagccgaucgacgaccgguucgcggacgcccugcucgcccugaacgacaugggcaaggugcgcaaggacaucccccaguggcagcccagcaagggguggcacgacuggcagcagguccccuucugcucccaccacuuccacgagcugaucaugaaggacggccggaagcucgucgugccgugccgcccccaggacgagcugaucgggcgggcccgcaucagccagggcgccggguggucccugaaggagaccgcgugccucggcaaggccuacgcccagaugugggcccugauguacuuccaccgccgggaccugcgccucgcgagcaacgccaucugcuccgccgugcccguccacugggugcccaccagccggaccacgugguccauccacgcccaccaccaguggaugaccaccgaggacaugcugaccguguggaaccgcgucuggaucgaggacaacccguggauggaggacaagacgcccgugaccaccugggaggacgugcccuaccugggcaagcgggaggaccaguggugcgggagccucaucggccuggccagccgcgcgaccugggcccagaacauccugacggccauccagcagguccggucccucaucgggaacgaggaguuccuggacuacaugcccagcaugaagcgcuuccggaaggaggaggaguccgagggcgccaucugguga

SEQ ID NO: 10351 - RNA, 9873 nt, Artificial Sequence
  derived and/or modified CDS sequence (opt1) from DENV-3__KC762687__SS-prME
accucccugugccucaugaugaugcugcccgccacccuggccuuccaccucaccucccgcgacggggagccccggaugaucguggggaagaacgagcgcggcaagagccugcuguucaagaccgccuccgggaucaacaugugcacccucaucgccauggaccugggcgagaugugcgacgacaccgugaccuacaagugcccccugaucaccgagguggagcccgaggacaucgacugcuggugcaaccucaccagcaccugggugacguacgggaccugcaaccaggccggcgagcaccggcgcgacaagcgguccguggcccuggcgccccacgugggcauggggcuggacacccgcgcgcagaccuggaugagcgccgagggcgccuggcgccagguggagaagguggagacgugggccuuccgccaccccggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacgugaccaccgacagccgcugccccacgcagggcgaggccauccugccggaggagcaggaccagaacuacgucugcaagcacaccuacguggaccggggguggggcaacgggugcggccucuucgggaagggcucccuggugaccugcgccaaguuccagugccuggaguucaucgagggcaaggucgugcagcacgagaaccucaaguacaccgugaucaucacgguccacaccggggaccagcaccaggugggcaacgagacccagggggucaccgccgagaucacgccccaggccagcaccguggaggcgauccugcccgaguacggcacccuggggcucgagugcagcccccggaccggccuggacuucaacgagaugauccugcucaccaugaagaacaaggccuggauggugcaccggcagugguucuucgaccugccgcugcccuggacgagcggcgccaccaccgagacccccacguggaacaagaaggagcuccuggucaccuucaagaacgcccacgccaagaagcaggagguggugguccuggggucccaggagggcgcgaugcacaccgcccucaccggggccacggagauccagaccagcggcgggaccuccaucuucgccggccaccugaagugccgccugaagauggacaagcucgagcugaagggcaugagcuacgccaugugccugaacgcguucgugcucaagaaggagguguccgagacccagcacgggacgauccugaucaaggucgaguacaagggcgaggacgcccccugcaagaucccguucagcaccgaggacgggcagggcaaggcccacaacggccggcugaucaccgccaaccccgugguggucaagaaggaggagcccgugaacaucgaggcggagcccccguucggggagagcaacaucgugaucggcaucggggacaaggcccugaagaucaacugguacaagaagggcuccagcaucgggaagauguucgaggccaccgcccgcggcgcccggcgcauggcgauccucggcgacacggccugggacuucggguccgucggcggggugcugaacagccugggcaagauggugcaccagaucuucggguccgccuacaccgcccucuucagcggcgucuccuggaucaugaagaucggcaucggggugcugcugaccuggaucggccucaacagcaagaacaccuccaugagcuucuccugcaucgugaucgggaucaucacgcuguaccugggcgccgucgugcaggcggacauggggugcgugaucaacuggaagggcaaggagcucaagugcggcagcgggaucuucgucaccaacgaggugcacaccuggaccgagcaguacaaguuccaggccgacucccccaagcggcuggccacggccaucgccggcgcgugggagaacggggugugcggcauccgcagcaccacccgcauggagaaccugcucuggaagcagaucgccaacgagcugaacuacauccugugggagaacaacaucaagcucaccgucguggugggggacaucaucggcguccuggagcagggcaagcggacgcugacgccccagcccauggagcucaaguacuccuggaagaccugggggaaggccaagaucgugaccgccgagacgcagaacagcuccuucaucaucgacggcccgaacacccccgagugccccagcgcgucccgcgccuggaacgugugggaggucgaggacuacggguucggcguguucaccaccaacaucuggcugaagcugcgggagauguacacgcagcucugcgaccaccgccugaugagcgccgccgugaaggacgagcgggccguccacgcggacaugggcuacuggaucgagagccagaagaacggguccuggaagcuggagaaggccagccucaucgaggugaagaccugcaccuggcccaagucccacacccuguggagcaacggcgugcuggaguccgacaugaucauccccaagucccucgccgggcccgucucccagcacaacuaccgccccggcuaccacacccagacggccgggccguggcaccugggcaagcuggagcucgacuucaacuacugcgagggcaccaccguggugaucaccgagaacugcgggacgcggggccccagccugcgcaccaccaccgucuccgggaagcugauccacgaguggugcugccggagcugcacgcugccgccccuccgcuacaugggcgaggacgggugcugguacggcauggagauccggccgaucaacgagaaggaggagaacauggugaagucccuggugagcgccggcuccgggaaggucgacaacuucaccaugggcgugcucugccuggcgauccuguucgaggaggugaugcgcgggaaguucggcaagaagcacaugaucgccgggguccucuucaccuucgugcugcugcucagcggccagaucaccuggcgggacauggcccgcacgcugaucaugaucggcuccaacgccagcgaccggauggggaugggcgugaccuaccuggcccucaucgcgaccuucaagauccagcccuuccuggcccugggguucuuccuccgcaagcugaccucccgggagaaccugcuccugggcgucggccuggccauggccacgacccuccagcugcccgaggacaucgagcagauggcgaacgggaucgcccugggccucauggcccugaagcugaucacccaguucgagaccuaccagcucuggacggcccuggugagccugaugugcagcaacaccaucuucacccucaccgucgccuggcgcacggcgacccugauccuggccgggaucucccucuuccccgugugccagagcuccagcaugcggaagaccgacuggcugccggugaccgucgccgccaugggcgugccgccccugccccucuucaucuucucccugaaggacacgcugaagcgccgcagcuggccgcucaacgagggggugauggccgucggccugguguccauccuggcgagcucccuccugcggaacgacgugcccauggccggcccccuggucgccgggggccuccugaucgccugcuacgugaucaccgggaccagcgccgaccugaccguggagaaggcggccgacgucaucugggaggaggaggccgagcagacgggcgugucccacaaccucaugaucaccguggacgacgacgggaccaugcgcaucaaggacgacgagaccgagaacauccugacgguccugcucaagaccgcccugcugaucgugagcggcaucuuccccuacuccaucccggccacccuccugguguggcacaccuggcagaagcagacccagcggagcggcguccugugggacgugcccagcccgcccgagacgcagaaggcggagcucgaggaggggguguaccgcaucaagcagcagggcaucuucgggaagacccaggucggcgugggggugcagaaggagggcgucuuccacaccauguggcacgugacccggggcgccgugcugacgcacaacgggaagcgccuggagccgaacugggccagcgucaagaaggaccucaucuccuacggcgggggcuggcggcugagcgcccaguggcagaagggggaggagguccaggugaucgcggucgagcccggcaagaaccccaagaacuuccagaccaugcccggcaccuuccagaccacgaccggggagaucggcgccaucgcccuggacuucaagccggggaccuccggcagccccaucaucaaccgcgagggcaaggugguggggcuguacggcaacggggucgugaccaagaacggcggguacgugagcggcaucgcccagacgaacgccgagcccgacggcccgacccccgagcucgaggaggagauguucaagaagcggaaccugaccaucauggaccugcaccccggguccggcaagacccgcaaguaccuccccgcgaucguccgggaggccaucaagcgccggcugcgcacgcugauccucgccccgacccgggugguggccgccgagauggaggaggcgcugaaggggcugcccauccgcuaccagaccaccgccaccaagagcguccacaccggcaaggagaucguggaccucaugugccacgccaccuucaccaugcggcugcugucccccgugcgcguccccaacuacaaccucaucaucauggacgaggcccacuucacggacccggccagcaucgcggcccggggguacaucuccacccgcgugggcaugggcgaggccgccgcgaucuucaugaccgccacgccgcccgggacggccgacgccuucccccagagcaacgccccgauccaggacgaggagcgggacauccccgagcgcuccuggaacagcggcaacgaguggaucaccgacuucgcggggaagaccgugugguucguccccuccaucaaggccggcaacgacaucgccaacugccugcgcaagaacgggaagaaggugauccagcugagccggaagaccuucgacacggaguaccagaagaccaagcucaacgacugggacuucguggucaccaccgacaucuccgagaugggcgccaacuucaaggccgaccgcgugaucgacccccggcgcugccugaagccggugauccugacggacggccccgagcgggucauccucgcggggcccaugcccgugaccgucgccagcgccgcccagcgccggggccgcguggggcggaacccgcagaaggagaacgaccaguacaucuucaccggccagccccugaacaacgacgaggaccacgcccacuggaccgaggcgaagaugcugcucgacaacaucaacacgcccgaggggaucauccccgcccuguucgagccggagcgcgagaaguccgccgccaucgacggcgaguaccggcugaagggcgagagccgcaagaccuucguggagcucaugcggcgcggggaccugcccgucuggcuggcgcacaagguggccuccgagggcaucaaguacaccgaccggaaguggugcuucgacggggagcgcaacaaccagauccucgaggagaacauggacguggagaucuggaccaaggagggcgagaagaagaagcugcggccccgcuggcuggacgcccggaccuacagcgacccccucgcccugaaggaguucaaggacuucgccgcgggccgcaaguccaucgcccuggaccucgucacggagaucgggcgcgugccgagccaccuggcccacaagacccgguccgcccuggacaaccucgugaugcugcacaccagcgagcacggcgggcgcgccuaccggcacgcggucgaggagcugcccgagaccauggagacgcuccugcugcucggccugaugauccugcucaccgggggcgccaugcuguuccugaucagcggcaaggggaucggcaagaccuccaucgggcucaucugcgugguggccagcuccggcaugcuguggauggccgacgucccccugcaguggaucgccagcgcgaucgugcucgaguucuucaugauggugcugcugaucccggagcccgagaagcagcgcacgccccaggacaaccagcucgccuacgucgugaucgggauccugacgcuggccgccaucguggccgcgaacgagaugggccuccuggagaccaccaagcgggaccugggcauguccaaggagcccggggucgugagcccgaccuccuaccucgacguggaccugcaccccgccagcgccuggacgcuguacgccgucgcgaccaccgugaucacccccaugcuccgccacacgaucgagaacuccaccgccaacgugagccuggccgccaucgccaaccaggcggucgugcugaugggccucgacaagggguggcccaucuccaagauggaccugggcgugccgcugcucgcccuggggugcuacagccaggucaacccccugacccucaccgccgccgugcugcugcucgugacgcacuacgccaucaucggccccggccugcaggcgaaggccacccgggaggcccagaagcgcaccgccgccgggaucaugaagaaccccaccgucgacggcaucaugacgaucgaccuggacccggugaucuacgacuccaaguucgagaagcagcucggccaggugaugcugcugguccucugcgcggugcagcugcugcucaugcggaccagcugggccuucugcgaggcccugacccuggccaccggccccaucacgacccucugggagggcucccccgggaaguucuggaacaccaccaucgcggugagcauggccaacaucuuccgcggcuccuaccuggccggggccggccuggccuucagcaucaugaaguccgucgggacgggcaagcggggcaccgggagccagggcgagacccucggggagaaguggaagaagaagcugaaccagcugagccgcaaggaguucgaccucuacaagaaguccggcaucaccgagguggaccggacggaggcgaaggaggggcugaagcgcggcgagaucacccaccacgccgugagccggggcuccgccaagcugcagugguucgucgagcgcaacauggugauccccgaggggcgggugaucgaccucggcugcgggcgcggcggguggagcuacuacugcgccggccugaagaaggucaccgaggugcggggcuacaccaagggcgggccggggcacgaggagcccgugcccauguccaccuacggcuggaacaucgucaagcugaugagcgggaaggacguguucuaccucccgcccgagaagugcgacacgcugcugugcgacaucggcgaguccagccccucccccaccguggaggagagccgcaccauccggguccugaagaugguggagcccuggcucaagaacaaccaguucugcaucaaggugcugaaccccuacaugcccaccgucaucgagcaccuggagcgccuccagcgcaagcacggcgggaugcuggugcggaacccccugucccgcaacagcacgcacgagauguacuggaucuccaacggcaccgggaacaucgucagcuccgugaacauggugagccggcuccugcugaaccgcuucaccaugacccaccggcgccccacgaucgagaaggacgucgaccucggcgccggcacccggcacgugaacgcggagccggagacccccaacauggacgugaucggggagcgcauccggcgcaucaaggaggagcacuccagcaccuggcacuacgacgaggagaaccccuacaagacgugggccuaccacggcuccuacgaggucaaggccaccgggagcgccagcuccaugaucaacggcguggugaagcugcugaccaagccgugggacgucgugcccaccgugacgcagauggccaugaccgacaccacccccuucgggcagcagcgggucuucaaggagaagguggacacgcgcacgccccggccgaugcccggcacccgcaaggcgauggagaucaccgccgaguggcucuggcggacccugggccgcaacaagcggccccgccugugcacccgggaggaguucaccaagaaggugcgcaccaacgccgccaugggggcggucuucacggaggagaaccagugggacagcgccaaggccgccguggaggacgaggaguucuggaagcucguggaccgcgagcgggagcugcacaagcugggcaagugcggguccugcgucuacaacaugaugggcaagcgcgagaagaagcucggggaguucggcaaggccaagggcagccgggcgaucugguacauguggcugggggcccgcuaccuggaguucgaggcccucggcuuccugaacgaggaccacugguucucccgggagaacagcuucuccgggguggagggcgaggggcugcacaagcucggcuacauccugcgcgacaucagcaagauccccggcggggccauguacgccgacgacaccgcgggcugggacacccggaucaccgaggacgaccugcacaacgaggagaagaucacgcagcagauggacccggagcaccgccagcucgccaacgccaucuucaagcugaccuaccagaacaagguggucaaggugcagcggcccacccccaaggggaccgugauggacaucaucucccgcaaggaccagcggggcagcggccaggucgggacguacggccugaacaccuucaccaacauggaggugcagcucauccgccagauggagggggagggcgugcuguccaaggccgaccuggagaacccccaccuccuggagaaggagaucacccaguggcuggagaccaagggggucgagcggcucaagcgcauggccaucagcggcgacgacugcguggugaagccgaucgacgaccgguucgcggacgcccugcuggcccucaacgacaugggcaagguccgcaaggacaucccccaguggcagcccuccaagggguggcacgacuggcagcagguccccuucugcagccaccacuuccacgagcugaucaugaaggacggccggaagcugguggucccgugccgcccccaggacgagcucaucgggcgggcccgcaucucccagggcgccggguggagccugcgggagacggcgugccugggcaaggccuacgcccagaugugggcccucauguacuuccaccgccgcgaccugcggcuggcguccaacgccaucugcagcgccgugcccgugcacuggguccccaccucccgcaccaccuggagcauccacgcccaccaccaguggaugacgaccgaggacaugcucaccguguggaaccggguguggaucgaggacaacccguggauggaggacaagacccccgucacgaccugggaggacgugcccuaccugggcaagcgcgaggaccaguggugcgggagccugaucggccucgccucccgggcgaccugggcccagaacauccugaccgccauccagcagguccgcagccugaucgggaacgaggaguuccucgacuacaugcccuccaugaagcgguuccgcaaggaggaggagagcgagggcgccaucugguga

SEQ ID NO: 10352 - RNA, 9873 nt, Artificial Sequence
  derived and/or modified CDS sequence (opt1) from DENV-3__KC762688__SS-prME
accagccugugccucaugaugaugcugcccgccacccuggccuuccaccucaccagccgcgacggcgagccccggaugaucguggggaagaacgagcgcggcaagagccugcuguucaagaccgccuccgggaucaacaugugcacccucaucgccauggaccugggcgagaugugcgacgacaccgugaccuacaagugcccccugaucaccgagguggagcccgaggacaucgacugcuggugcaaccucaccagcaccugggugacguacgggaccugcaaccaggccggcgagcaccggcgcgacaagcgguccguggcccuggcgccccacgugggcauggggcuggacacccgcgcgcagaccuggaugagcgccgagggcgccuggcggcaggucgagaaggucgagacgugggccuuccgccaccccggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacgugaccaccgacagccgcugccccacgcagggcgaggccauccugcccgaggagcaggaccagaacuacgucugcaagcacaccuacguggaccggggguggggcaacgggugcggccucuucgggaagggcucccuggugaccugcgccaaguuccagugccuggaguucaucgagggcaaggucgugcagcacgagaaccucaaguacaccgugaucaucacgguccacaccggggaccagcaccaggugggcaacgagacccagggggucaccgccgagaucacgccccaggccagcaccguggaggcgauccugcccgaguacggcacccuggggcucgagugcagcccccgcaccggccuggacuucaacgagaugauccugcucaccaugaagaacaaggccuggauggugcaccggcagugguucuucgaccugccgcugcccuggacgagcggcgccaccaccgagacccccacguggaacaagaaggagcuccuggucaccuucaagaacgcccacgccaagaagcaggagguggugguccuggggucccaggagggcgcgaugcacaccgcccucaccggggccacggagauccagaccagcggcgggaccuccaucuucgccggccaccugaagugccgccugaagauggacaagcucgagcugaagggcaugagcuacgccaugugccugaacgcguucgugcucaagaaggagguguccgagacccagcacgggacgauccugaucaaggucgaguacaagggcgaggacgcccccugcaagaucccguucagcaccgaggacgggcagggcaaggcccacaacggccggcugaucaccgccaaccccguggugaccaagaaggaggagcccgucaacaucgaggcggagcccccguucggggagagcaacaucgugaucggcaucggggacaaggcccugaagaucaacugguacaagaagggcuccagcaucgggaagauguucgaggccacggcccgcggcgcccggcgcauggcgauccucggcgacaccgccugggacuucggguccgugggcgggguccugaacagccugggcaagauggugcaccagaucuucggguccgccuacaccgcccucuucagcggcguguccuggaucaugaagaucggcaucgggguccugcugaccuggaucggccucaacagcaagaacacguccaugagcuucuccugcaucgugaucgggaucaucacccuguaccugggcgccgugguccaggcggacauggggugcgugaucaacuggaagggcaaggagcucaagugcggcagcgggaucuucgugaccaacgagguccacaccuggacggagcaguacaaguuccaggccgacucccccaagcggcuggccaccgccaucgccggcgcgugggagaacggggugugcggcauccgcagcaccacccgcauggagaaccugcucuggaagcagaucgccaacgagcugaacuacauccugugggagaacaacaucaagcucacgguggucgugggggacaucaucggcgugcuggagcagggcaagcggacccugacgccccagcccauggagcucaaguacuccuggaagaccugggggaaggccaagaucgucacggccgagacccagaacagcuccuucaucaucgacggcccgaacacccccgagugccccagcgcgucccgcgccuggaacgugugggagguggaggacuacggguucggcgucuucaccacgaacaucuggcugaagcugcgggagauguacacccagcucugcgaccaccgccugaugagcgccgccgugaaggacgagcgggccgugcacgcggacaugggcuacuggaucgagagccagaagaacggguccuggaagcuggagaaggccagccucaucgaggucaagaccugcaccuggcccaagucccacacccuguggagcaacggcgugcuggaguccgacaugaucauccccaagucccucgccgggcccgugucccagcacaacuaccgccccggcuaccacacgcagaccgccgggccguggcaccugggcaagcuggagcucgacuucaacuacugcgagggcaccaccgucgugaucacggagaacugcgggacccggggccccagccugcgcaccaccacgguguccgggaagcugauccacgaguggugcugccggagcugcacccugccgccccuccgcuacaugggcgaggacgggugcugguacggcauggagauccggccgaucaacgagaaggaggagaacauggucaagucccuggugagcgccggcuccgggaagguggacaacuucaccaugggcguccucugccuggcgauccuguucgaggaggugaugcgcgggaaguucggcaagaagcacaugaucgccgggguccuguucaccuucguccugcugcucagcggccagaucacguggcgggacauggcccgcacccugaucaugaucggcuccaacgccagcgaccggauggggaugggcgugaccuaccuggcccucaucgcgaccuucaagauccagcccuuccuggcccugggguucuuccuccgcaagcugacgucccgggagaaccugcuccugggcgugggccuggccauggccaccacccuccagcugcccgaggacaucgagcagauggcgaacgggaucgcccugggccucauggcccugaagcugaucacccaguucgagacguaccagcucuggaccgcccuggucagccugaugugcagcaacacccucuucacccugacgguggccuggcgcaccgcgacccugauccucgccgggaucucccugcugcccgucugccagagcuccagcaugcggaagaccgacuggcucccggugacgguggccgccaugggcgugccgccccugccccuguucaucuucucccucaaggacacccugaagcgccgcagcuggccgcugaacgagggggugauggccgugggccucgucuccauccuggcgagcucccugcuccggaacgacgugcccauggccggcccccugguggccgggggccugcucaucgccugcuacgucaucaccgggaccagcgccgaccugacgguggagaaggcggccgacgugaucugggaggaggaggccgagcagaccggcgucucccacaaccugaugaucaccguggacgacgacgggaccaugcgcaucaaggacgacgagacggagaacauccucaccgugcugcugaagaccgcccuccugaucgucagcggcaucuuccccuacuccaucccggccacccugcucguguggcacaccuggcagaagcagacgcagcggagcggcgugcugugggacguccccagcccgcccgagacccagaaggcggagcuggaggaggggguguaccgcaucaagcagcagggcaucuucgggaagacccaggugggcgucggggugcagaaggagggcguguuccacaccauguggcacgucacgcggggcgccgugcucacccacaacgggaagcgccuggagccgaacugggccagcgugaagaaggaccugaucuccuacggcgggggcuggcggcugagcgcccaguggcagaagggggaggagguccaggugaucgcgguggagcccggcaagaaccccaagaacuuccagaccaugcccggcaucuuccagaccacgaccggggagaucggcgccaucgcccucgacuucaagccggggaccuccggcagccccaucaucaaccgcgagggcaaggucguggggcuguacggcaacgggguggucaccaagaacggcggguacgugagcggcaucgcccagacgaacgccgagcccgacggcccgacccccgagcuggaggaggagauguucaagaagcggaaccucaccaucauggaccugcaccccggguccggcaagacccgcaaguaccugcccgcgaucgugcgggaggccaucaagcgccggcuccgcacgcugauccuggccccgacccgggucguggccgccgagauggaggaggcgcucaaggggcugcccauccgcuaccagaccaccgccaccaagagcgcccacaccggcaaggagaucguggaccugaugugccacgccaccuucaccaugcggcuccugucccccguccgcgugcccaacuacaaccugaucaucauggacgaggcccacuucacggacccggcgagcaucgccgcccggggguacaucuccacccgcgugggcaugggcgaggccgcggccaucuucaugaccgccacgccgcccgggacggccgacgccuucccccagagcaacgcgccgauccaggacgaggagcgggacauccccgagcgcuccuggaacagcggcaacgaguggaucaccgacuucgccgggaagaccgucugguucgugcccuccaucaaggccggcaacgacaucgccaacugccuccgcaagaacgggaagaaggugauccagcugagccggaagaccuucgacacggaguaccagaagaccaagcugaacgacugggacuucgucgugaccaccgacaucuccgagaugggcgccaacuucaaggcggaccgcgugaucgacccccggcgcugccucaagccggucauccugacggacggccccgagcgggugauccuggccgggcccaugcccgugaccgucgccagcgccgcccagcgccggggccgcguggggcggaacccgcagaaggagaacgaccaguacaucuucaccggccagccccucaacaacgacgaggaccacgcgcacuggaccgaggccaagaugcugcuggacaacaucaacacgcccgaggggaucauccccgcccucuucgagccggagcgcgagaaguccgccgcgaucgacggcgaguaccggcugaagggcgagagccgcaagaccuucgucgagcugaugcggcgcggggaccuccccguguggcuggcccacaagguggccuccgagggcaucaaguacaccgaccggaaguggugcuucgacggggagcgcaacaaccagauccuggaggagaacauggacgucgagaucuggaccaaggagggcgagaagaagaagcuccggccccgcuggcuggacgcccggaccuacagcgacccccuggcccucaaggaguucaaggacuucgcggccggccgcaaguccaucgcccuggaccuggugacggagaucgggcgcgugccgagccaccucgcccaccggacccgcaacgcccuggacaaccuggucaugcuccacaccuccgagcacggcgggcgggcguaccgccacgccguggaggaguuccccgagaccauggagacgcugcugcuccugggccugaugauccuccugaccgggggcgccaugcuguuccucaucagcggcaaggggaucggcaagaccagcaucgggcugaucugcguggucgccuccagcggcaugcuguggauggccgacgugccccuccaguggaucgcguccgccaucgugcuggaguucuucaugaugguccugcucaucccggagcccgagaagcagcggacgccccaggacaaccagcuggccuacguggugaucgggauccugacgcucgccgccaucgucgcggccaacgagaugggccugcuggagaccaccaagcgcgaccucggcaugagcaaggagcccggggugguguccccgaccagcuaccuggacgucgaccugcaccccgccuccgccuggacgcucuacgcgguggccaccaccgugaucacccccaugcugcggcacacgaucgagaacagcaccgccaacgucucccuggccgccaucgcgaaccaggccguggugcucaugggccuggacaagggguggcccaucagcaagauggaccugggcgucccgcuccuggcccuggggugcuacucccaggugaacccccucacccugaccgccgccgugcugcuccuggucacgcacuacgcgaucaucggccccggccugcaggccaaggccacccgcgaggcccagaagcggaccgccgcggggaucaugaagaaccccaccguggacggcaucaugacgaucgaccucgacccggugaucuacgacagcaaguucgagaagcagcuggggcaggucaugcugcucgugcugugcgccgugcagcugcuccugaugcgcaccuccugggccuucugcgaggcccugacccucgcgaccggccccaucacgacccugugggagggcagccccgggaaguucuggaacaccaccaucgccgucuccauggccaacaucuuccggggcagcuaccuggccggggccggccucgcguucuccaucaugaaguccguggggacgggcaagcgcggcaccgggucccagggcgagacccugggggagaaguggaagaagaagcugaaccagcucagccggaaggaguucgaccuguacaagaaguccggcaucaccgagguggaccgcacggaggccaaggaggggcugaagaagggcgagaucacccaccacgccgucucccggggcagcgccaagcuccagugguucguggagcgcaacauggugauccccgaggggcgggucaucgaccugggcugcgggcgcggcgggugguccuacuacugcgccggccugaagaaggugaccgaggugcggggcuacaccaagggcgggccggggcacgaggagcccguccccaugagcaccuacggcuggaacaucgugaagcucauguccgggaaggacguguucuaccugcccccggagaagugcgacacgcugcugugcgacaucggcgagagcucccccagccccaccgucgaggagucccgcaccauccgggugcucaagaugguggagcccuggcugaagaacaaccaguucugcaucaagguccugaacccguacaugcccaccgugaucgagcaccucgagcgccugcagcgcaagcacggcgggaugcuggugcggaacccccucagccgcaacuccacgcacgagauguacuggaucagcaacggcaccgggaacaucgucuccagcgugaacauggucucccggcugcugcucaaccgcuucaccaugacccaccggcgccccacgaucgagaaggacguggaccugggcgcgggcacccggcacgugaacgccgagccggagacccccaacauggacgucaucggggagcgcauccggcgcaucaaggaggagcacagcuccaccuggcacuacgacgaggagaaccccuacaagacgugggccuaccacggcagcuacgaggugaaggccaccggguccgccagcagcaugaucaacggcguggucaagcugcucaccaagccgugggacguggugcccaccgucacgcagauggcgaugaccgacaccacccccuucgggcagcagcggguguucaaggagaagguggacacgcgcacgccccggccgaugcccggcacccgcaaggccauggagaucaccgccgaguggcuguggcggacccugggccgcaacaagcggccccgccucugcacccgggaggaguucaccaagaagguccgcaccaacgccgcgaugggggccguguucacggaggagaaccagugggacuccgcccgcgccgccguggaggacgaggaguucuggaagcuggucgaccgggagcgcgagcugcacaagcucggcaagugcgggagcugcguguacaacaugaugggcaagcgggagaagaagcugggggaguucggcaaggcgaagggcucccgcgccaucugguacauguggcugggggcccgguaccucgaguucgaggcccugggcuuccugaacgaggaccacugguucagccgcgagaacuccuucagcgggguggagggcgaggggcuccacaagcugggcuacauccugcgggacaucuccaagauccccggcggggccauguacgcggacgacaccgccggcugggacacccgcaucaccgaggacgaccuccacaacgaggagaagaucacgcagcagauggacccggagcaccggcagcuggccaacgccaucuucaagcugaccuaccagaacaaggucgugaaggugcagcgccccacccccaaggggaccgucauggacaucaucagccggaaggaccagcgcggcuccggccagguggggacguacggccucaacaccuucaccaacauggaggugcagcugauccggcagauggagggggagggcguccugagcaaggccgaccucgagaacccccaccuccuggagaaggagaucacccaguggcucgagaccaaggggguggagcgccugaagcggauggcgaucuccggcgacgacugcguggucaagccgaucgacgaccgcuucgccgacgcccugcucgcccugaacgacaugggcaaggugcggaaggacaucccccaguggcagcccagcaagggguggcacgacuggcagcagguccccuucugcucccaccacuuccacgagcugaucaugaaggacggccgcaagcucgucgugccgugccggccccaggacgagcugaucgggcgcgcccggaucagccagggcgcgggguggucccugaaggagacggccugccucggcaaggccuacgcccagaugugggcgcugauguacuuccaccgccgcgaccugcggcucgccagcaacgccaucugcuccgccgugcccguccacugggugcccaccagccgcaccaccugguccauccacgcccaccaccaguggaugacgaccgaggacaugcugaccguguggaaccgggucuggaucgaggacaacccguggaucgaggacaagacccccgugacgaccugggaggacgugcccuaccugggcaagcgcgaggaccaguggugcgggagccucaucggccuggcgagccgggccaccugggcccagaacauccugaccgccauccagcagguccgcucccucaucgggaacgaggaguuccuggacuacaugcccagcaugaagcgguuccgcaaggaggaggaguccgagggcgccaucugguga

SEQ ID NO: 10353 - RNA, 9873 nt, Artificial Sequence
  derived and/or modified CDS sequence (opt1) from DENV-3__KC762689__SS-prME
accagccugugccucaugaugaugauccccgccacccuggccuuccaccugaccagccgcgacggcgagccccggaugaucguggggaagaacgagcgcggcaagagccuccuguucaagaccgcgagcgggaucaacaugugcacccugaucgccauggaccucggcgagaugugcgacgacaccgugaccuacaagugcccccugaucaccgagguggagcccgaggacaucgacugcuggugcaaccugaccagcaccugggugaccuacgggaccugcaaccaggccggcgagcaccggcgcgacaagcgguccgucgcccucgcgccccacgugggcauggggcuggacacccgcgcgcagaccuggaugagcgccgagggcgccuggcggcaggucgagaaggucgagacgugggccuuccgccaccccggguucaccauccuggcccucuuccuggcccacuacaucggcaccucccugacccagaagguggugaucuucauccuccugaugcuggucacgcccagcaugaccaugcggugcgugggggugggcaaccgcgacuucgucgagggccucuccggggccaccuggguggacgugguccuggagcacggcgggugcgugaccacgauggccaagaacaagcccacccuggacaucgagcuccagaagaccgaggccacccagcuggcgacgcugcggaagcucugcaucgagggcaagaucaccaacgugaccaccgacagccgcugccccacgcagggcgaggccauccugccggaggagcaggaccagaacuacgucugcaagcacaccuacguggaccggggguggggcaacgggugcggccuguucgggaagggcucccucgugaccugcgccaaguuccagugccuggaguucaucgagggcaaggucgugcagcacgagaaccugaaguacaccgugaucaucacgguccacaccggggaccagcaccaggugggcaacgagacccagggggucaccgccgagaucacgccccaggccagcaccguggaggcgauccuccccgaguacggcacccuggggcuggagugcagcccccgcaccggccucgacuucaacgagaugauccugcugaccaugaagaacaaggccuggauggugcaccggcagugguucuucgaccucccgcugcccuggacgagcggcgccaccaccgagacccccacguggaacaagaaggagcugcucgucaccuucaagaacgcccacgccaagaagcaggagguggugguccuggggucccaggagggcgcgaugcacaccgcccugaccggggccacggagauccagaccagcggcgggaccuccaucuucgccggccaccucaagugccgccugaagauggacaagcuggagcucaagggcaugagcuacgccaugugccugaacgcguucgugcugaagaaggagguguccgagacccagcacgggacgauccucaucaaggucgaguacaagggcgaggacgcccccugcaagaucccguucagcaccgaggacgggcagggcaaggcccacaacggccggcugaucaccgccaaccccguggugaccaagaaggaggagcccgucaacaucgaggcggagcccccguucggggagagcaacaucgugaucggcaucggggacaaggcccugaagaucaacugguacaagaagggcuccagcaucgggaagauguucgaggccacggcccgcggcgcccggcgcauggcgauccugggcgacaccgccugggacuucggguccgugggcgggguccucaacagccugggcaagauggugcaccagaucuucggguccgccuacaccgcccuguucagcggcguguccuggaucaugaagaucggcaucgggguccuccugaccuggaucggccugaacagcaagaacacguccaugagcuucuccugcaucgugaucgggaucaucacccucuaccugggcgccgugguccaggcggacauggggugcgugaucaacuggaagggcaaggagcugaagugcggcagcgggaucuucgugaccaacgagguccacaccuggacggagcaguacaaguuccaggccgacucccccaagcggcucgccaccgccaucgccggcgcgugggagaacggggugugcggcauccgcagcaccacccgcauggagaaccugcuguggaagcagaucgccaacgagcucaacuacauccugugggagaacaacaucaagcugacgguggucgugggggacaucaucggcgugcucgagcagggcaagcggacccugacgccccagcccauggagcugaaguacuccuggaagaccugggggaaggccaagaucgucacggccgagacccagaacagcuccuucaucaucgacggcccgaacacccccgagugccccagcgcgucccgcgccuggaacgugugggagguggaggacuacggguucggcgucuucaccacgaacaucuggcucaagcugcgggagauguacacccagcugugcgaccaccgccucaugagcgccgccgugaaggacgagcgggccgugcacgcggacaugggcuacuggaucgagagccagaagaacggguccuggaagcuggagaaggccagccugaucgaggucaagaccugcaccuggcccaagucccacacccucuggagcaacggcgugcuggaguccgacaugaucauccccaagucccuggccgggcccgugucccagcacaacuaccgccccggcuaccacacgcagaccgccgggccguggcaccucggcaagcuggagcuggacuucaacuacugcgagggcaccaccgucgugaucacggagagcugcgggacccggggccccucccuccgcaccaccacggugagcgggaagcugauccacgaguggugcugccgguccugcacccugccgccccuccgcuacaugggcgaggacgggugcugguacggcauggagauccggccgaucaacgagaaggaggagaacauggucaagagccugguguccgccggcagcgggaagguggacaacuucaccaugggcguccugugccucgcgauccuguucgaggaggugaugcgcgggaaguucggcaagaagcacaugaucgccggggugcuguucaccuucguccuccugcuguccggccagaucacguggcgggacauggcccgcacccucaucaugaucggcagcaacgccuccgaccggauggggaugggcgugaccuaccuggcccugaucgcgaccuucaagauccagcccuuccucgcccugggguucuuccugcgcaagcucacgagccgggagaaccugcugcucggcgugggccuggccauggccaccacccugcagcuccccgaggacaucgagcagauggcgaacgggaucgcccugggccugauggcccucaagcugaucacccaguucgagacguaccagcuguggaccgcccucgucagccugaugugcuccaacaccaucuucacccugacgguggccuggcgcaccgcgacccucauccuggccgggaucagccugcuccccgucugccaguccagcuccaugcggaagaccgacuggcugccggugacgguggccgccaugggcgugccgccccugccccucuucaucuucagccugaaggacacccugaagcgccgcuccuggccgcucaacgagggggugauggccgugggccuggucagcauccuggcguccagccuccugcggaacgacgugcccauggccggcccccugguggccgggggccuccugaucgccugcuacgucaucaccgggaccuccgccgaccugacgguggagaaggcggccgacgugaucugggaggaggaggccgagcagaccggcgucagccacaaccucaugaucaccguggacgacgacgggaccaugcgcaucaaggacgacgagacggagaacauccugaccgugcugcucaagaccgcccugcugaucgucuccggcaucuuccccuacagcaucccggccacccuccugguguggcacaccuggcagaagcagacgcagcgguccggcgugcugugggacguccccuccccgcccgagacccagaaggcggagcucgaggaggggguguaccgcaucaagcagcagggcaucuucgggaagacccaggugggcgucggggugcagaaggagggcguguuccacaccauguggcacgucacgcggggcgccgugcugacccacaacgggaagcgccuggagccgaacugggccuccgugaagaaggaccucaucagcuacggcgggggcuggcggcuguccgcccaguggcagaagggggaggagguccaggugguggcggucgagcccggcaagaaccccaagaacuuccagaccaugcccggcaucuuccagaccacgaccggggagaucggcgccaucgcccuggacuucaagccggggaccagcggcagccccaucaucaaccgcgagggcaaggugguggggcuguacggcaacggggucgugaccaagaacggcggguacguguccggcaucgcccagacgaacgccgagcccgacggcccgacccccgaccucgaggaggagauguucaagaagcggaaccugaccaucauggaccugcaccccgggagcggcaagacccgcaaguaccuccccgcgaucguccgggaggccaucaagcgccggcugcgcacgcugauccucgccccgacccgggugguggccgccgagauggaggaggcgcugaaggggcugcccauccgcuaccagaccaccgccacgaaguccguccacaccggcaaggagaucguggaccucaugugccacgccaccuucaccaugcggcugcugagccccgugcgcguccccaacuacaaccucaucaucauggacgaggcccacuucacggacccggccuccaucgcggcccggggguacaucagcacccgcgugggcaugggcgaggccgccgcgaucuucaugaccgccacgccgcccgggacggccgacgccuucccccaguccaacgccccgauccaggacgaggagcgggacauccccgagcgcagcuggaacuccggcaacgaguggaucaccgacuucgcggggaagaccgugugguucguccccagcaucaaggccggcaacgacaucgccaacugccugcgcaagaacgggaagaaggugauccagcugucccggaagaccuucgacacggaguaccagaagaccaagcucaacgacugggacuucguggucaccaccgacaucagcgagaugggcgccaacuucaaggccgaccgcgugaucgacccccggcgcugccugaagccggugauccugacggacggccccgagcgggucauccucgcggggcccaugcccgugaccgucgccuccgccgcccagcgccggggccgcguggggcggaacccgcagaaggagaacgaccaguacaucuucaccggccagccccugaacaacgacgaggaccacgcccacuggaccgaggcgaagaugcugcucgacaacaucaacacgcccgaggggaucauccccgcccuguucgagccggagcgcgagaaguccgccgccaucgacggcgaguaccggcugaagggcgagucccgcaagaccuucguggagcucaugcggcgcggggaccugcccgucuggcuggcgcacaagguggccagcgagggcaucaaguacaccgaccggaaguggugcuucgacggggagcgcaacaaccagauccucgaggagaacauggacguggagaucuggaccaaggagggcgagaagaagaagcugcggccccgcuggcuggacgcccggaccuacuccgacccccucgcccugaaggaguucaaggacuucgccgcgggccgcaagagcaucgcccuggaccucgucacggagaucgggcgcgugccgucccaccuggccuaccggacccgcaacgcccuggacaaccucgugaugcugcacaccagcgagcacggcgggcgggccuaccgccacgcggucgaggagcugcccgagaccauggagacgcuccugcugcucggccugaugauccugcucaccgggggcgccaugcuguuccugaucagcggcaaggggaucggcaagaccuccaucgggcucaucugcgugguggccagcuccggcaugcuguggauggccgacgucccccugcaguggaucgccagcgcgaucgugcucgaguucuucaugauggugcugcugaucccggagcccgagaagcagcggacgccccaggacaaccagcucgccuacgucgugaucgggauccugacgcuggccgccaucguggccgcgaacgagaugggccuccuggagaccaccaagcgcgaccugggcauguccaaggagcccggggucgugagcccgaccuccuaccucgacguggaccugcaccccgccagcgccuggacgcuguacgccgucgcgaccaccgugaucacccccaugcuccggcacacgaucgagaacuccaccgccaacgugagccuggccgccaucgccaaccaggcggucgugcugaugggccucgacaagggguggcccaucuccaagguggaccugggcgucccgcugcucgcccuggggugcuacagccaggugaacccccugacccucaccgccgccgugcugcugcucgucacgcacuacgccaucaucggccccggccugcaggcgaaggccacccgcgaggcccagaagcggaccgccgccgggaucaugaagaaccccaccguggacggcaucaugacgaucgaccuggacccggugaucuacgacuccaaguucgagaagcagcucgggcaggucaugcugcuggugcucugcgcggugcagcugcugcucaugcgcaccagcugggccuucugcgaggcccugacccuggccaccggccccaucacgacccucugggagggcucccccgggaaguucuggaacaccaccaucgcggucagcauggccaacaucuuccggggcuccuaccuggccggggccggccuggccuucagcaucaugaaguccguggggacgggcaagcgcggcaccgggagccagggcgagacccucggggagaaguggaagaagaagcugaaccagcugagccggaaggaguucgaccucuacaagaaguccggcaucaccgagguggaccgcacggaggcgaaggaggggcugaagcggggcgagaccacccaccacgccgucagccgcggcuccgccaagcugcagugguucguggagcggaacauggugauccccgaggggcgcgucaucgaccucggcugcgggcggggcggguggagcuacuacugcgccggccugaagaaggugaccgaggugcgcggcuacaccaagggcgggccggggcacgaggagcccguccccauguccacguacggcuggaacaucgugaagcugaugagcgggaaggacguguucuaccucccgcccgagaagugcgacacccugcugugcgacaucggcgaguccagccccucccccaccgucgaggagagccggaccauccgcgugcugaagaugguggagcccuggcucaagaacaaccaguucugcaucaagguccugaaccccuacaugcccacggugaucgagcaccuggagcgccuccagcggaagcacggcgggaugcugguccgcaacccccugucccggaacagcacccacgagauguacuggaucuccaacggcaccgggaacaucgugagcuccgugaacauggucagccgccuccugcugaaccgguucaccaugacgcaccgccggcccaccaucgagaaggacguggaccucggcgccggcacccgccacgugaacgcggagccggagacccccaacauggacgucaucggggagcggauccgccggaucaaggaggagcacuccagcacguggcacuacgacgaggagaaccccuacaagaccugggccuaccacggcuccuacgaggugaaggccaccgggagcgccagcuccaugaucaacggcguggucaagcugcugaccaagccgugggacguggugcccacggucacccagauggccaugaccgacaccacgcccuucgggcagcagcgcguguucaaggagaagguggacacccggacgccccgcccgaugcccggcacccggaaggcgauggagaucaccgccgaguggcucuggcgcacccugggccggaacaagcgcccccggcugugcacccgcgaggaguucaccaagaagguccgcacgaacgccgccaugggggcgguguucaccgaggagaaccagugggacagcgcccgggccgccguggaggacgaggaguucuggaagcucgucgaccgcgagcgggagcugcacaagcugggcaagugcggguccugcguguacaacaugaugggcaagcgcgagaagaagcucggggaguucggcaaggccaagggcagccgggcgaucugguacauguggcugggggcccgcuaccuggaguucgaggcccucggcuuccugaacgaggaccacugguucucccgggagaacagcuucuccgggguggagggcgaggggcugcacaagcucggcuacauccugcgcgacaucagcaagauccccggcggggccauguacgccgacgacaccgcgggcugggacacccggaucacggaggacgaccugcacaacgaggagaagaucacccagcagauggacccggagcaccgccagcucgccaacgccaucuucaagcugaccuaccagaacaaggucgugaaggugcagcggcccacccccaaggggacggucauggacaucaucucccgcaaggaccagcggggcagcggccagguggggaccuacggccugaacaccuucaccaacauggaggugcagcucauccgccagauggagggggagggcguccuguccaaggccgaccuggagaacccccaccuccuggagaaggagaucacccaguggcuggagacgaaggggguggagcggcucaagcgcauggccaucagcggcgacgacugcguggucaagccgaucgacgaccgguucgcggacgcccugcuggcccucaacgacaugggcaaggugcgcaaggacaucccccaguggcagcccuccaagggguggcacgacuggcagcagguccccuucugcagccaccacuuccacgagcugaucaugaaggacggccggaagcuggucgugccgugccgcccccaggacgagcucaucgggcgggcccgcaucucccagggcgccggguggagccugaaggagaccgcgugccugggcaaggccuacgcccagaugugggcccucauguacuuccaccgccgggaccugcgccuggcguccaacgccaucugcagcgccgugcccguccacugggugcccaccucccggaccacguggagcauccacgcccaccaccaguggaugaccaccgaggacaugcucaccguguggaaccgcgucuggaucgaggacaacccguggauggaggacaagacgcccgugaccaccugggaggacgugcccuaccugggcaagcgggaggaccaguggugcgggagccugaucggccucgccucccgcgcgaccugggcccagaacauccugacggccauccagcagguccggagccugaucgggaacgaggaguuccucgacuacaugcccuccaugaagcgcuuccggaaggaggaggagagcgagggcgccaucugguga

SEQ ID NO: 10354 - RNA, 9873 nt, Artificial Sequence
  derived and/or modified CDS sequence (opt1) from DENV-3__KC762690__SS-prME
accagccugugccucaugaugaugcugcccgccacccuggccuuccaccucaccagccgcgacggcgagccccggaugaucguggggaagaacgagcgcggcaagagccugcuguucaagaccgccuccgggaucaacaugugcacccucaucgccauggaccugggcgagaugugcgacgacaccgugaccuacaagugcccccugaucaccgagguggagcccgaggacaucgacugcuggugcaaccucaccagcaccugggugacguacgggaccugcaaccaggccggcgagcaccggcgcgacaagcgguccguggcccuggcgccccacgugggcauggggcuggacacccgcgcgcagaccuggaugagcgccgagggcgccuggcggcaggucgagaaggucgagacgugggccuuccgccaccccggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacgugaccaccgacagccgcugccccacgcagggcgaggccauccugcccgaggagcaggaccagaacuacgucugcaagcacaccuacguggaccggggguggggcaacgggugcggccucuucgggaagggcucccuggugaccugcgccaaguuccagugccuggaguucaucgagggcaaggucgugcagcacgagaaccucaaguacaccgugaucaucacgguccacaccggggaccagcaccaggugggcaacgagacccagggggucaccgccgagaucacgccccaggccagcaccguggaggcgauccugcccgaguacggcacccuggggcucgagugcagcccccgcaccggccuggacuucaacgagaugauccugcucaccaugaagaacaaggccuggauggugcaccggcagugguucuucgaccugccgcugcccuggacgagcggcgccaccaccgagacccccacguggaacaagaaggagcuccuggucaccuucaagaacgcccacgccaagaagcaggagguggugguccuggggucccaggagggcgcgaugcacaccgcccucaccggggccacggagauccagaccagcggcgggaccuccaucuucgccggccaccugaagugccgccugaagauggacaagcucgagcugaagggcaugagcuacgccaugugccugaacgcguucgugcucaagaaggagguguccgagacccagcacgggacgauccugaucaaggucgaguacaagggcgaggacgcccccugcaagaucccguucagcaccgaggacgggcagggcaaggcccacaacggccggcugaucaccgccaaccccguggugaccaagaaggaggagcccgucaacaucgaggcggagcccccguucggggagagcaacaucgugaucggcaucggggacaaggcccugaagaucaacugguacaagaagggcuccagcaucgggaagauguucgaggccacggcccgcggcgcccggcgcauggcgauccucggcgacaccgccugggacuucggguccgugggcgggguccugaacagccugggcaagauggugcaccagaucuucggguccgccuacaccgcccucuucagcggcguguccuggaucaugaagaucggcaucgggguccugcugaccuggaucggccucaacagcaagaacacguccaugagcuucuccugcaucgugaucgggaucaucacccuguaccugggcgccgugguccaggcggacauggggugcgugaucaacuggaagggcaaggagcucaagugcggcagcgggaucuucgugaccaacgagguccacaccuggacggagcaguacaaguuccaggccgacucccccaagcggcuggccaccgccaucgccggcgcgugggagaacggggugugcggcauccgcagcaccacccgcauggagaaccugcucuggaagcagaucgccaacgagcugaacuacauccugugggagaacaacaucaagcucacgguggucgugggggacaucaucggcgugcuggagcagggcaagcggacccugacgccccagcccauggagcucaaguacuccuggaagaccugggggaaggccaagaucgucacggccgagacccagaacagcuccuucaucaucgacggcccgaacacccccgagugccccagcgcgucccgcgccuggaacgugugggagguggaggacuacggguucggcgucuucaccacgaacaucuggcugaagcugcgggagauguacacccagcucugcgaccaccgccugaugagcgccgccgugaaggacgagcgggccgugcacgcggacaugggcuacuggaucgagagccagaagaacggguccuggaagcuggagaaggccagccucaucgaggucaagaccugcaccuggcccaagucccacacccuguggagcaacggcgugcuggaguccgacaugaucauccccaagucccucgccgggcccgugucccagcacaacuaccgccccggcuaccacacgcagaccgccgggccguggcaccugggcaagcuggagcucgacuucaacuacugcgagggcaccaccgucgugaucacggagaacugcgggacccggggccccagccugcgcaccaccacgguguccgggaagcugauccacgaguggugcugccggagcugcacccugccgccccuccgcuacaugggcgaggacgggugcugguacggcauggagauccggccgaucaacgagaaggaggagaacauggucaagucccuggugagcgccggcuccgggaagguggacaacuucaccaugggcguccucugccuggcgauccuguucgaggaggugaugcgcgggaaguucggcaagaagcacaugaucgccgggguccuguucaccuucguccugcugcucagcggccagaucacguggcgggacauggcccgcacccugaucaugaucggcuccaacgccagcgaccggauggggaugggcgugaccuaccuggcccucaucgcgaccuucaagauccagcccuuccuggcccugggguucuuccuccgcaagcugacgucccgggagaaccugcuccugggcgugggccuggccauggccaccacccuccagcugcccgaggacaucgagcagauggcgaacgggaucgcccugggccucauggcccugaagcugaucacccaguucgagacguaccagcucuggaccgcccuggucagccugaugugcagcaacaccaucuucacccucacgguggccuggcgcaccgcgacccugauccuggccgggaucucccuccugcccgucugccagagcuccagcaugcggaagaccgacuggcugccggugacgguggccgccaugggcgugccgccccucccccuguucaucuucucccugaaggacacccucaagcgccgcagcuggccgcugaacgagggggugauggccgugggccuggucuccauccucgcgagcucccugcugcggaacgacgugcccauggccggcccccucguggccgggggccugcugaucgccugcuacgucaucaccgggaccagcgccgaccucacgguggagaaggcggccgacgugaucugggaggaggaggccgagcagaccggcgucucccacaaccugaugaucaccguggacgacgacgggaccaugcgcaucaaggacgacgagacggagaacauccugaccgugcuccugaagaccgcccugcucaucgucagcggcaucuuccccuacuccaucccggccacccugcugguguggcacaccuggcagaagcagacgcagcggagcggcgugcucugggacguccccagcccgcccgagacccagaaggcggagcuggaggaggggguguaccgcaucaagcagcagggcaucuucgggaagacccaggugggcgucggggugcagaaggagggcguguuccacaccauguggcacgucacgcggggcgccgugcugacccacaacgggaagcgccucgagccgaacugggccagcgugaagaaggaccugaucuccuacggcgggggcuggcggcugagcgcccaguggcagaagggggaggagguccaggugaucgcgguggagcccggcaagaaccccaagaacuuccagaccaugcccggcaucuuccagaccacgaccggggagaucggcgccaucgcccuggacuucaagccggggaccuccggcagccccaucaucaaccgcgagggcaaggucguggggcucuacggcaacgggguggucaccaagaacggcggguacgugagcggcaucgcccagacgaacgccgagcccgacggcccgacccccgagcuggaggaggagauguucaagaagcggaaccugaccaucauggaccuccaccccggguccggcaagacccgcaaguaccugcccgcgaucgugcgggaggccaucaagcgccggcugcgcacgcucauccuggccccgacccgggucguggccgccgagauggaggaggcgcugaaggggcuccccauccgcuaccagaccaccgccaccaagagcgcccacaccggcaaggagaucguggaccugaugugccacgccaccuucaccaugcggcugcucucccccguccgcgugcccaacuacaaccugaucaucauggacgaggcccacuucacggacccggcgagcaucgccgcccggggguacaucuccacccgcgugggcaugggcgaggccgcggccaucuucaugaccgccacgccgcccgggacggccgacgccuucccccagagcaacgcgccgauccaggacgaggagcgggacauccccgagcgcuccuggaacagcggcaacgaguggaucaccgacuucgccgggaagaccgucugguucgugcccuccaucaaggccggcaacgacaucgccaacugccugcgcaagaacgggaagaaggugauccagcucagccggaagaccuucgacacggaguaccagaagaccaagcugaacgacugggacuucgucgugaccaccgacaucuccgagaugggcgccaacuucaaggcggaccgcgugaucgacccccggcgcugccugaagccggucauccucacggacggccccgagcgggugauccuggccgggcccaugcccgugaccgucgccagcgccgcccagcgccggggccgcguggggcggaacccgcagaaggagaacgaccaguacaucuucaccggccagccccugaacaacgacgaggaccacgcgcacuggaccgaggccaagaugcuccuggacaacaucaacacgcccgaggggaucauccccgcccuguucgagccggagcgcgagaaguccgccgcgaucgacggcgaguaccggcucaagggcgagagccgcaagaccuucgucgagcugaugcggcgcggggaccugcccguguggcucgcccacaagguggccuccgagggcaucaaguacaccgaccggaaguggugcuucgacggggagcgcaacaaccagauccuggaggagaacauggacgucgagaucuggaccaaggagggcgagaagaagaagcugcggccccgcuggcucgacgcccggaccuacagcgacccccuggcccugaaggaguucaaggacuucgcggccggccgcaaguccaucgcccucgaccuggugacggagaucgggcgcgugccgagccaccuggcccaccggacccgcaacgcccucgacaaccuggucaugcugcacaccuccgagcacggcgggcgggcguaccgccacgccguggaggagcuccccgagaccauggagacgcugcugcuccugggccugaugauccuccugaccgggggcgccaugcuguuccucaucagcggcaaggggaucggcaagaccagcaucgggcugaucugcguggucgccuccagcggcaugcuguggauggccgacgugccccuccaguggaucgcguccgccaucgugcuggaguucuucaugaugguccugcucaucccggagcccgagaagcagcggacgccccaggacaaccagcuggccuacguggugaucgggauccugacgcucgccgccaucgucgcggccaacgagaugggccugcuggagaccaccaagcgcgaccucggcaugagcaaggagcccggggugguguccccgaccagcuaccuggacgucgaccugcaccccgccuccgccuggacgcucuacgcgguggccaccaccgugaucacccccaugcugcggcacacgaucgagaacagcaccgccaacgucucccuggccgccaucgcgaaccaggccguggugcucaugggccuggacaagggguggcccaucagcaagauggaccugggcgucccgcuccuggcccuggggugcuacucccaggugaacccccucacccugaccgccgccgugcugcuccuggucacgcacuacgcgaucaucggccccggccugcaggccaaggccacccgcgaggcccagaagcggaccgccgcggggaucaugaagaaccccaccguggacggcaucaugacgaucgaccucgacccggugaucuacgacagcaaguucgagaagcagcuggggcaggucaugcugcucgugcugugcgccgugcagcugcuccugaugcgcaccuccugggccuucugcgaggcccugacccucgcgaccggccccaucacgacccugugggagggcagccccgggaaguucuggaacaccaccaucgccgucuccauggccaacaucuuccggggcagcuaccuggccggggccggccucgcguucuccaucaugaaguccguggggacgggcaagcgcggcaccgggucccagggcgagacccugggggagaaguggaagaagaagcugaaccagcucagccggaaggaguucgaccuguacaagaaguccggcaucaccgagguggaccgcacggaggccaaggaggggcugaagcggggcgagaucacccaccacgccgucucccgcggcagcgccaagcuccagugguucguggagcggaacauggugauccccgaggggcgcgucaucgaccugggcugcgggcggggcgggugguccuacuacugcgccggccugaagaaggugaccgaggugcgcggcuacaccaagggcgggccggggcacgaggagcccguccccaugagcaccuacggcuggaacaucgugaagcucauguccgggaaggacguguucuaccugcccccggagaagugcgacacgcugcugugcgacaucggcgagagcucccccagccccaccgucgaggagucccggaccauccgcgugcucaagaugguggagcccuggcugaagaacaaccaguucugcaucaagguccugaacccguacaugcccaccgugaucgagcaccucgagcgccugcagcggaagcacggcgggaugcuggugcgcaacccccucagccggaacuccacgcacgagauguacuggaucagcaacggcaccgggaacaucgucuccagcgugaacauggucucccgccugcugcucaaccgguucaccaugacccaccgccggcccacgaucgagaaggacguggaccugggcgcgggcacccgccacgugaacgccgagccggagacccccaacauggacgucaucggggagcggauccgccggaucaaggaggagcacagcuccaccuggcacuacgacgaggagaaccccuacaagacgugggccuaccacggcagcuacgaggugaaggccaccggguccgccagcagcaugaucaacggcguggucaagcugcucaccaagccgugggacguggugcccaccgucacgcagauggcgaugaccgacaccacccccuucgggcagcagcgcguguucaaggagaagguggacacgcggacgccccgcccgaugcccggcacccggaaggccauggagaucaccgccgaguggcuguggcgcacccugggccggaacaagcgcccccggcucugcacccgcgaggaguucaccaagaagguccgcaccaacgccgcgaugggggccguguucacggaggagaaccagugggacuccgcccgggccgccguggaggacgaggaguucuggaagcuggucgaccgcgagcgggagcugcacaagcucggcaagugcgggagcugcguguacaacaugaugggcaagcgcgagaagaagcugggggaguucggcaaggcgaagggcucccgggccaucugguacauguggcugggggcccgcuaccucgaguucgaggcccugggcuuccugaacgaggaccacugguucagccgggagaacuccuucagcgggguggagggcgaggggcuccacaagcugggcuacauccugcgcgacaucuccaagauccccggcggggccauguacgcggacgacaccgccggcugggacacccggaucaccgaggacgaccuccacaacgaggagaagaucacgcagcagauggagccggagcaccgccagcuggccaacgccaucuucaagcugaccuaccagaacaaggucgugaaggugcagcggcccacccccaaggggaccgucauggacaucaucagccgcaaggaccagcggggcuccggccagguggggacguacggccucaacaccuucaccaacauggaggugcagcugauccgccagauggagggggagggcguccugagcaaggccgaccucgagaacccccaccuccuggagaaggagaucacccaguggcucgagaccaaggggguggagcggcugaagcgcauggcgaucuccggcgacgacugcguggucaagccgaucgacgaccgguucgccgacgcccugcucgcccugaacgacaugggcaaggugcgcaaggacaucccccaguggcagcccagcaagggguggcacgacuggcagcagguccccuucugcucccaccacuuccacgagcugaucaugaaggacggccggaagcucgucgugccgugccgcccccaggacgagcugaucgggcgggcccgcaucagccagggcgcgggguggucccugaaggagacggccugccucggcaaggccuacgcccagaugugggcgcugauguacuuccaccgccgggaccugcgccucgccagcaacgccaucugcuccgccgugcccguccacugggugcccaccagccggaccaccugguccauccacgcccaccaccaguggaugacgaccgaggacaugcugaccguguggaaccgcgucuggaucgaggacaacccguggauggaggacaagacccccgugacgaccugggaggacgugcccuaccugggcaagcgggaggaccaguggugcgggagccucaucggccuggcgagccgcgccaccugggcccagaacauccugaccgccauccagcagguccggucccucaucgggaacgaggaguuccuggacuacaugcccagcaugaagcgcuuccggaaggaggaggaguccgagggcgccaucugguga

SEQ ID NO: 10355 - RNA, 9873 nt, Artificial Sequence
  derived and/or modified CDS sequence (opt1) from DENV-3__KC762691__SS-prME
accagccugugccucaugaugaugcugcccgccacccuggccuuccaccucaccucccgcgacggggagccccggaugaucguggggaagaacgagcgcggcaagagccugcuguucaagaccgccuccgggaucaacaugugcacccucaucgccauggaccugggcgagaugugcgacgacaccgugacguacaagugcccccugaucaccgagguggagcccgaggacaucgacugcuggugcaaccucaccagcaccugggugacguacgggaccugcaaccaggccggcgagcaccggcgcgacaagcgguccguggcccuggcgccccacgugggcauggggcuggacacccgcgcgcagaccuggaugagcgccgagggcgccuggcggcaggucgagaaggucgagacgugggccuuccgccaccccggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacgugaccaccgacagccgcugccccacgcagggcgaggccauccugccggaggagcaggaccagaacuacgucugcaagcacaccuacguggaccggggguggggcaacgggugcggccucuucgggaagggcucccuggugaccugcgccaaguuccagugccuggagcucaucgagggcaaggucgugcagcacgagaaccugaaguacaccgugaucaucacgguccacaccggggaccagcaccaggugggcaacgagacccagggggucaccgccgagaucacgccccaggccagcaccguggaggcgauccugcccgaguacggcacccucgggcuggagugcagcccccggaccggccuggacuucaacgagaugauccuccugaccaugaaggacaaggccuggauggugcaccggcagugguucuucgaccugccgcuccccuggacgagcggcgccaccaccgagacccccacguggaacaagaaggagcugcuggucaccuucaagaacgcccacgccaagaagcaggagguggugguccucgggucccaggagggcgcgaugcacaccgcccugaccggggccacggagauccagaccagcggcgggaccuccaucuucgccggccaccugaagugccgccucaagauggacaagcuggagcugaagggcaugagcuacaccaugugcuccaacgccuucgugcucaagaaggaggugagcgagacgcagcacgggaccauccugaucaaggucgaguacaagggcgaggacgcgcccugcaagaucccguucagcaccgaggacgggcagggcaaggcccacaacggccggcugaucaccgccaaccccguggugacgaagaaggaggagcccgucaacaucgaggccgagcccccguucggggaguccaacaucaucaucggcaucggggacaaggcgcugaagaucaacugguacaagaagggcagcuccaucgggaagauguucgaggccaccgcccgcggcgcccggcgcauggccauccucggcgacaccgcgugggacuucgggagcgugggcggggugcugaacucccugggcaagaugguccaccagaucuucgggagcgccuacaccgcccucuucuccggcgugagcuggaucaugaagaucggcaucggggugcugcugacguggaucggccucaacuccaagaacaccagcauguccuucagcugcaucgucaucgggaucaucacccuguaccugggcgccguggugcaggccgacauggggugcgucaucaacuggaagggcaaggagcucaagugcggcuccgggaucuucgugaccaacgaggugcacacguggaccgagcaguacaaguuccaggcggacagcccccggcgccuggccaccgccaucgccggcgccugggagaacggggucugcggcauccgcuccaccacgcggauggagaaccugcucuggaagcagaucgcgaacgagcugaacuacauccugugggagaacaacaucaagcucaccgugguggucggggacaccaucggcgugcuggagcagggcaagcgcacccugacgccccagcccauggagcucaaguacagcuggaagaccugggggaaggccaagaucgugaccgccgagacccagaacuccagcuucaucaucgacggcccgaacacgcccgagugccccaacgccucccgggcguggaacgucugggagguggaggacuacggguucggcguguucaccaccaacaucuggcugaagcugcgcgagauguacacccagcucugcgaccaccggcugaugagcgccgccgucaaggacgagcgcgccgugcacgccgacaugggcuacuggaucgagagccagaagaacggguccuggaagcuggagaaggcgagccucaucgaggugaagaccugcacguggcccaagucccacacccuguggagcaacggcguccuggaguccgacaugaucauccccaagucccucgccgggcccaucucccagcacaacuaccggcccggcuaccacacccagaccgccgggccguggcaccugggcaagcuggagcucgacuucaacuacugcgagggcacgaccguggugaucaccgagaacugcggggcccgcggccccagccugcggaccacgaccgucuccgggaagcugauccacgaguggugcugccgcagcugcacccugccgccccuccgguacaugggcgaggacgggugcugguacggcauggagauccgcccgaucaacgagaaggaggagaacauggugaagucccuggugagcgccggcuccgggaaggucgacaacuucaccaugggcgugcucugccuggcgauccuguucgaggaggugaugcgggggaaguucggcaagaagcacaugaucgccgggguccucuucacguucgugcugcugcucagcggccagaucaccuggcgcgacauggcccggacccugaucaugaucggcuccaacgccagcgaccgcauggggaugggcgugaccuaccuggcccucaucgcgacguucaagauccagcccuuccuggcccugggguucuuccuccggaagcugaccucccgcgagaaccugcuccugggcgucggccuggccauggccaccacccuccagcugcccgaggacaucgagcagauggcgaacgggaucgcccugggccucauggcccugaagcugaucacgcaguucgagaccuaccagcucuggaccgcccuggugagccugaugugcagcaacaccaucuucacgcucaccguggccuggcggaccgcgacccugauccuggccgggaucucccucuuccccgucugccagagcuccagcaugcgcaagacggacuggcugccgaugaccguggccgccaugggcgugccgccccugccccucuucaucuucucccugaaggacacccugaagcgccggagcuggccgcucaacgagggggugauggccgugggccuggucuccauccuggcgagcucccuccugcgcaacgacgugcccauggccggcccccugguggccgggggccuccugaucgccugcuacgucaucaccgggacgagcgccgaccugaccguggagaaggcggccgacgugaccugggaggaggaggccgagcagaccggcgucucccacaaccucaugaucacgguggacgacgacgggaccaugcggaucaaggacgacgagaccgagaacauccugaccgugcugcucaagaccgcccugcugaucgucagcggcaucuuccccuacuccaucccggccacgcuccugguguggcacaccuggcagaagcagacccagcgcagcggcgugcugugggacguccccagcccgcccgagacccagaaggcggagcucgaggaggggguguaccggaucaagcagcagggcaucuucgggaagacccaggugggcgucggggugcagaaggagggcguguuccacaccauguggcacgucacccgcggcgccgugcugaccuacaacgggaagcggcuggagccgaacugggccagcgugaagaaggaccucaucuccuacggcgggggcuggcgccugagcgcccaguggcagaagggggaggagguccaggugaucgcgguggagcccggcaagaaccccaagaacuuccagacgaugcccggcaucuuccagaccaccaccggggagaucggcgccaucgcccuggacuucaagccggggacguccggcagccccaucaucaaccgggagggcaaggucguggggcuguacggcaacgggguggucaccaagaacggcggguacgugagcggcaucgcccagaccaacgccgagcccgacggcccgacccccgagcucgaggaggagauguucaagaagcgcaaccugacgaucauggaccugcaccccggguccggcaagacccggaaguaccuccccgcgaucgugcgcgaggccaucaagcggcgccugcggacccugauccucgccccgacccgcgucguggccgccgagauggaggaggcgcugaaggggcugcccauccgguaccagacgaccgccaccaagagcgagcacaccggcaaggagaucguggaccucaugugccacgccacguucaccaugcgccugcugucccccguccgggugcccaacuacaaccucaucaucauggacgaggcccacuucaccgacccggccagcaucgcggcccgcggguacaucuccacccgggugggcaugggcgaggccgccgcgaucuucaugacggccacgccgcccgggaccgccgacgccuucccccagagcaacgccccgauccaggacgaggagcgcgacauccccgagcgcuccuggaacagcggcaacgacuggaucaccgacuucgcggggaagacggucugguucgugcccuccaucaaggccggcaacgacaucgccaacugccugcggaagaacgggaagaaggugauccagcugagccgcaagaccuucgacaccgaguaccagaagaccaagcucaacgacugggacuucgucgugacgaccgacaucuccgagaugggcgccaacuucaaggccgaccgggugaucgacccccgccggugccugaagccggucauccugaccgacggccccgagcgcgugauccucgcggggcccaugcccgugaccgucgccagcgccgcccagcggcgcggccggaucgggcgcaacccgcagaaggagaacgaccaguacaucuucacgggccagccccugaacaacgacgaggaccacgcccacuggaccgaggcgaagaugcugcucgacaacaucaacacccccgaggggaucauccccgcccuguucgagccggagcgggagaaguccgccgccaucgacggcgaguaccgccugaagggcgagagccggaagaccuucguggagcucaugcgccgcggggaccugcccguguggcuggcgcacaaggucgccuccgagggcaucaaguacaccgaccgcaaguggugcuucgacggggagcggaacaaccagauccucgaggagaacauggacguggagaucuggacgaaggagggcgagaagaagaagcugcgcccccgguggcuggacgcccgcaccuacagcgacccccucgcccugaaggaguucaaggacuucgccgcgggccgcaaguccaucgcccuggaccucgucaccgagaucgggcgggugccgagccaccuggcccaccgcacccggaacgcccuggacaaccucgugaugcugcacacguccgagcacggcgggcgcgccuaccggcacgcggucgaggagcugcccgagaccauggagacccuccugcugcucggccugaugauccugcucaccgggggcgccaugcuguuccugaucagcggcaagggggugggcaagacgagcaucgggcucaucugcguggucgccuccagcggcaugcuguggauggccgacaucccccugcaguggaucgccuccgcgaucgugcucgaguucuucaugauggugcugcugaucccggagcccgagaagcagcgcacgccccaggacaaccagcucgccuacgucgugaucgggauccugacccuggccgccaucguggccgcgaacgagaugggccuccuggagaccacgaagcgggaccugggcaugagcaaggagcccggggucguguccccgaccagcuaccucgacguggaccugcaccccgccuccgccuggacccuguacgccgucgcgaccacggugaucacccccaugcuccgccacaccaucgagaacagcaccgccaacgugucccuggccgccaucgccaaccaggcggucgugcugaugggccucgacaagggguggcccaucagcaagauggaccugggcgugccgcugcucgcccuggggugcuacucccaggucaacccccugacgcucaccgccgccgugcugcugcucgugacccacuacgccaucaucggccccggccugcaggcgaaggccacccgggaggcccagaagcgcacggccgccgggaucaugaagaaccccaccgucgacggcaucaugaccaucgaccuggacccggugaucuacgacagcaaguucgagaagcagcucggccaggugaugcugcugguccucugcgcggugcagcugcugcucaugcggaccuccugggccuucugcgaggcccugacgcuggccaccggccccaucaccacccucugggagggcagccccgggaaguucuggaacacgaccaucgcgguguccauggccaacaucuuccgcggcagcuaccuggccggggccggccuggccuucuccaucaugaaguccgucgggaccggcaagcggggcaccgggagccagggcgagacgcucggggagaaguggaagaagaagcugaaccagcugagccgcaaggaguucgaccucuacaagaaguccggcaucaccgagguggaccggaccgaggcgaaggaggggcugaagcgcggcgagaucacccaccacgccgugucccggggcagcgccaagcugcagugguucgucgagcgcaacauggugauccccgaggggcgggugaucgaccucggcugcgggcgcggcgggugguccuacuacugcgccggccugaagaaggucaccgaggugcggggcuacacgaagggcgggccggggcacgaggagcccgugcccaugagcaccuacggcuggaacaucgucaagcugauguccgggaaggacguguucuaccucccgcccgagaagugcgacacccugcugugcgacaucggcgagagcucccccagccccaccguggaggagucccgcacgauccgcguccugaagaugguggagcccuggcucaagaacaaccaguucugcaucaaggugcugaaccccuacaugcccaccgucaucgagcaccuggagcggcuccagcgcaagcacggcgggaugcuggugcggaacccccugagccgcaacuccacccacgagauguacuggaucagcaacggcaccgggaacaucguguccagcgucaacauggugucccggcuccugcugaaccgcuucacgaugaccuaccggcgccccaccaucgagaaggacguggaccucggcgccggcacccggcacgucaacgcggagccggagacgcccaacauggacgugaucggggagcgcauccggcgcaucaaggaggagcacagcuccaccuggcacuacgacgacgagaaccccuacaagaccugggccuaccacggcagcuacgaggucaaggccaccggguccgccagcagcaugaucaacggcguggugaagcugcugacgaagccgugggacgucgugcccaccgugacccagauggccaugaccgacacgacccccuucgggcagcagcgggucuucaaggagaagguggacacccgcacccccaagccgaugcccggcacgcggaaggugauggagaucaccgcggaguggcucuggcgcacccugggccggaacaagcgcccccggcugugcacccgcgaggaguucacgaagaagguccgcaccaacgccgccaugggggccguguucaccgaggagaaccagugggacuccgcgcgggccgccguggaggacgaggaguucuggaagcucgucgaccgcgagcgggagcugcacaagcugggcaagugcgggagcugcguguacaacaugaugggcaagcgcgagaagaagcucggggaguucggcaaggccaagggcucccgggccaucugguacauguggcugggggcgcgcuaccuggaguucgaggcccucggcuuccugaacgaggaccacugguucagccgggagaacuccuacagcgggguggagggcgaggggcugcacaagcucggcuacauccugcgcgacaucuccaagauccccggcggggccauguacgccgacgacaccgccggcugggacacgcggaucaccgaggacgaccugcacaacgaggagaagaucacccagcagauggacccggagcaccgccagcucgcgaacgccaucuucaagcugaccuaccagaacaaggucgugaaggugcagcggcccacgcccaaggggaccgucauggacaucaucagccgcaaggaccagcggggcuccggccagguggggaccuacggccugaacaccuucaccaacauggaggcccagcucauccgccagauggagggggagggcgugcugagcaagacggaccuggagaacccccaccuccuggagaagaagaucacccaguggcuggagaccaagggggucgagcggcucaagcgcauggccaucuccggcgacgacugcguggugaagccgaucgacgaccgguucgccaacgcgcugcuggcccucaacgacaugggcaagguccgcaaggacaucccccaguggcagcccagcaagggguggcacgacuggcagcagguccccuucugcucccaccacuuccacgagcugaucaugaaggacggccggaagcugguggucccgugccgcccccaggacgagcucaucgggcgggcccgcaucagccagggcgccggguggucccugaaggagaccgccugccugggcaaggcguacgcccagaugugggcccucauguacuuccaccgccgggaccugcgccuggccagcaacgcgaucugcuccgccgugcccgugcacuggguccccacgagccggaccaccugguccauccacgcccaccaccaguggaugaccacggaggacaugcucaccguguggaaccgcguguggaucgaggacaacccguggauggaggacaagacccccgucaccacgugggaggacgugcccuaccugggcaagcgggaggaccaguggugcgggagccugaucggccucaccagccgcgccaccugggcccagaacauccugaccgcgauccagcagguccggucccugaucgggaacgaggaguuccucgacuacaugcccagcaugaagcgcuuccggaaggaggaggaguccgagggcgccaucugguga

SEQ ID NO: 10356 - RNA, 9873 nt, Artificial Sequence
  derived and/or modified CDS sequence (opt1) from DENV-3__KC762692__SS-prME
accagccugugccucaugaugaugcugcccgccacccuggccuuccaccucaccucccgcgacggcgagccccggaugaucguggggaagaacgagcgcggcaagagccugcuguucaagaccgcguccgggaucaacaugugcacccucaucgccauggaccugggcgagaugugcgacgacaccgugacguacaagugcccccugaucaccgagguggagcccgaggacaucgacugcuggugcaaccucaccagcaccugggugacguacgggaccugcaaccaggccggcgagcaccggcgcgacaagcgguccguggcccuggcgccccacgugggcauggggcuggacacccgcgcgcagaccuggaugagcgccgagggcgccuggcgccagguggagaaggucgagacgugggccuuccgccaccccggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacgugaccaccgacagccgcugccccacgcagggcgaggccauccugcccgaggagcaggaccagaacuacgucugcaagcacaccuacguggaccggggguggggcaacgggugcggccucuucgggaagggcucccuggugaccugcgccaaguuccagugccuggagcucaucgagggcaaggucgugcagcacgagaaccugaaguacaccgugaucaucacgguccacaccggggaccagcaccaggugggcaacgagacccagggggucaccgccgagaucacgccccaggccagcaccguggaggcgauccugcccgaguacggcacccucgggcuggagugcagcccccggaccggccuggacuucaacgagaugauccuccugaccaugaagaacaaggccuggauggugcaccggcagugguucuucgaccugccgcuccccuggacgagcggcgccaccaccgagacccccacguggaacaagaaggagcugcuggucaccuucaagaacgcccacgccaagaagcaggagguggugguccucgggucccaggagggcgcgaugcacaccgcccugaccggggccacggagauccagaccagcggcgggaccuccaucuucgccggccaccugaagugccgccucaagauggacaagcuggagcugaagggcaugagcuacgccaugugcuccaacgcguucgugcucaagaaggaggugagcgagacccagcacgggacgauccugaucaaggucgaguacaagggcgaggacgcccccugcaagaucccguucagcaccgaggacgggcagggcaaggcccacaacggccggcugaucaccgccaaccccguggugaccaagaaggaggagcccgucaacaucgaggcggagcccccguucggggaguccaacaucaucaucggcaucggggacaaggcccugaagaucaacugguacaagaagggcagcuccaucgggaagauguucgaggccacggcccgcggcgcccggcgcauggcgauccucggcgacaccgccugggacuucgggagcgugggcggggugcugaacucccugggcaagaugguccaccagaucuucgggagcgccuacaccgcccucuucuccggcgugagcuggaucaugaagaucggcaucggggugcugcugaccuggaucggccucaacuccaagaacacgagcauguccuucagcugcaucgucaucgggaucaucacccuguaccugggcgccguggugcaggcggacauggggugcgucaucaacuggaagggcaaggagcucaagugcggcuccgggaucuucgugaccaacgaggugcacaccuggacggagcaguacaaguuccaggccgacagccccaagcggcuggccaccgccaucgucggcgccugggagaacggggugugcggcauccgcuccaccacccgcauggagaaccugcucuggaagcagaucgcgaacgagcugaacuacauccugugggagaacaacaucaagcucacgguggucgugggggacaucaucggcgugcuggagcagggcaagcggacccugacgccccagcccauggagcucaaguacagcuggaagaccugggggaaggccaagaucgucacggccgagauccagaacuccagcuucaucaucgacggcccgaacacccccgagugccccaacgccucccgcgcguggaacgugugggagguggaggacuacggguucggcgucuucaccaccaacaucuggcugaagcugcgggagauguacacgcagcucugcgaccaccgccugaugagcgccgccgugaaggacgagcgggccgugcacgccgacaugggcuacuggaucgagagccagaagaacggguccuggaagcuggagaaggcgagccucaucgaggucaagaccugcaccuggcccaagucccacacccuguggagcaacggcgugcuggaguccgacaugaucauccccaagucccucgccgggcccaucucccagcacaacuaccgccccggcuaccacacccagacggccgggccguggcaccugggcaagcuggagcucgacuucaacuacugcgagggcaccaccguggucaucaccgagaacugcgggacgcggggccccagccugcgcaccaccaccguguccgggaagcugauccacgaguggugcugccggagcugcacgcugccgccccuccgcuacaugggcgaggacgggugcugguacggcauggagauccggccgaucaacgagaaggaggagaacauggugaagucccuggucagcgccggcuccgggaagguggacaacuucaccaugggcgugcucugccuggccauccuguucgaggaggucaugcgcgggaaguucggcaagaagcacaugaucgcggggguccucuucauguucgugcugcugcucagcggccagaucaccuggcgggacauggcccgcacccugaucaugaucggcuccaacgccagcgaccggauggggaugggcgucacguaccuggcccucaucgccaccuucaagauccagcccuuccuggcgcugggguucuuccuccgcaagcugaccucccgggagaaccugcuccugggcgugggccuggccauggccaccacgcuccagcugcccgaggacaucgagcagauggccaacgggaucgcgcugggccucauggugcugaagcugaucacccaguucgagaccuaccagcucuggaccgcccuggucagccugacgugcagcaacaccaucuucacccucaccguggccuggcgcacggccacccugauccuggccgggaccucccuccugcccgucugccagagcuccagcaugcggaagaccgacuggcugccgaugacgguggcggccaugggcgugccgccccucccccuguucaucuucucccugaaggacacccucaagcgccgcagcuggccgcugaacgagggggucauggccgugggccugguguccauccucgccagcucccugcugcggaacgacguccccauggccggcccccucguggccggcgggcugcugaucgccugcuacgugaucaccgggaccagcgccgaccucacggucgagaaggccgccgacgugaccugggaggaggaggcggagcagaccggggugucccacaaccugaugaucaccgucgacgacgacgggacgaugcgcaucaaggacgacgagaccgagaacauccugaccgugcuccugaagaccgcccugcucaucgugagcggcaucuuccccuacuccaucccggccacccugcuggucuggcacacguggcagaagcagacccagcggagcggcgugcucugggacgugcccagcccgcccgagacccagaaggccgagcuggaggagggggucuaccgcaucaagcagcagggcaucuucgggaagacccaggugggcguggggguccagaaggagggcguguuccacacgauguggcacgugacccggggcgccguccugaccuacaacgggaagcgccucgagccgaacugggcgagcgugaagaaggaccugaucuccuacggcgggggcuggcggcugagcgcccaguggcagaagggggaggaggugcaggucaucgccguggagcccggcaagaaccccaagaacuuccagaccaugcccggcaucuuccagacgaucaccggggagaucggcgccaucgcgcuggacuucaagccggggaccuccggcagccccaucaucaaccgcgagggcaagguggucgggcucuacggcaacgggguggugaccaagaacggcggguacgucagcggcaucgcccagacgaacgccgagcccgacggcccgacccccgagcuggaggaggagauguucaagaagcggaaccugaccaucauggaccuccaccccggguccggcaagacccgcaaguaccugcccacgaucgugcgggaggccaucaagcgccggcugcgcacccucauccuggccccgacccggguggucgcggccgagauggaggaggcccugaaggggcuccccauccgcuaccagaccacggccaccaagagcgagcacaccggcaaggagaucguggaccugaugugccacgccaccuucacgaugcggcugcucucccccgugcgcguccccaacuacaaccugaucaucauggacgaggcgcacuucaccgacccggccagcaucgccgcccggggguacaucuccacccgcgugggcaugggcgaggccgcggccaucuucaugaccgccacgccgcccgggaccgccgacgcguucccccagagcaacgccccgauccaggacgaggagcgggacauccccgagcgcuccuggaacagcggcaacgacuggaucaccgacuucgccgggaagaccgugugguucguccccuccaucaaggccggcaacgacaucgccaacugccugcgcaagaacgggaagaaggugauccagcucagccggaagacguucgacaccgaguaccagaagaccaagcugaacgacugggacuucguggucaccacggacaucuccgagaugggcgcgaacuucaaggccgaccgcgugaucgacccccggcgcugccugaagccggugauccucaccgacggccccgagcgggucauccuggccgggcccaugcccgugaccguggccagcgccgcgcagcgccggggccgcgucgggcggaacccgcagaaggagaacgaccaguacaucuucaccggccagccccugaacaacgacgaggaccacgcccacuggacggaggccaagaugcuccuggacaacaucaacacccccgaggggaucauccccgcccuguucgagccggagcgcgagaaguccgccgcgaucgacggcgaguaccggcucaagggcgagagccgcaagaccuucguggagcugaugcggcgcggggaccugcccgucuggcucgcccacaagguggccuccgagggcaucaaguacaccgaccggaaguggugcuucgacggggagcgcaacaaccagauccuggaggagaacauggacguggagaucuggaccaaggagggcgagaagaagaagcugcggccccgcuggcucgacgcccggacguacagcgacccccuggcgcugaaggaguucaaggacuucgccgccggccgcaaguccaucgcccucgaccuggucaccgagaucgggcgcgugccgagccaccuggcccaccggacccgcaacgcgcucgacaaccuggugaugcugcacaccuccgagcacggcgggcgggccuaccgccacgccgucgaggagcuccccgagacgauggagacccugcugcuccugggccugaugauccuccugaccgggggcgccaugcuguuccucaucagcggcaagggggugggcaagaccagcaucgggcugaucugcguggucgccuccagcggcaugcuguggauggcggacaucccccuccaguggaucgccuccgccaucgugcuggaguucuucaugauggugcugcucaucccggagcccgagaagcagcggacgccccaggacaaccagcuggccuacgucgugaucgggauccugacccucgccgcgaucguggccgccaacgagaugggccugcuggagaccaccaagcgcgaccucggcaugagcaaggagcccggggucguguccccgacgagcuaccuggacguggaccugcaccccgccuccgccuggacccucuacgcggucgccaccaccgugaucacgcccaugcugcggcacaccaucgagaacagcaccgccaacgugucccuggccgcgaucgccaaccaggccgucgugcucaugggccuggacaagggguggcccaucagcaagauggaccugggcgugccgcuccuggcccuggggugcuacucccaggucaacccccucacccugacggccgcggugcugcuccuggugacccacuacgccaucaucggccccggccugcaggccaaggccacccgcgaggcccagaagcggaccgcggccgggaucaugaagaaccccacggucgacggcaucaugaccaucgaccucgacccggugaucuacgacagcaaguucgagaagcagcugggccaggugaugcugcucguccugugcgccgugcagcugcuccugaugcgcaccuccugggccuucugcgaggcccugacccucgcgacgggccccaucaccacccugugggagggcagccccgggaaguucuggaacaccacgaucgccguguccauggccaacaucuuccggggcagcuaccuggccggggcgggccucgccuucuccaucaugaaguccgucgggaccggcaagcgcggcaccgggagccagggcgagacccugggggagaaguggaagaagaagcugaaccagcucagccggaaggaguucgaccuguacaagaaguccggcaucacggagguggaccgcaccgaggccaaggaggggcugaagcggggcgagaucacccaccacgccgugucccgcggcagcgccaagcuccagugguucgucgagcggaacauggugauccccgaggggcgcgugaucgaccugggcugcgggcggggcgggugguccuacuacugcgcgggccugaagaaggucaccgaggugcgcggcuacaccaagggcgggccggggcacgaggagcccgugcccaugagcacguacggcuggaacaucgucaagcucauguccgggaaggacguguucuaccugcccccggagaagugcgacacccugcugugcgacaucggcgagagcucccccagccccaccguggaggagucccggaccauccgcguccucaagaugguggagcccuggcugaagaacaaccaguucugcaucaaggugcugaacccguacaugcccacggucaucgagcaccucgagcgccugcagcggaagcacggcgggaugcuggugcgcaacccccucagccggaacuccacccacgagauguacuggaucagcaacggcaccgggaacaucguguccagcgucaacauggugucccgccugcugcucaaccgguucaccaugacguaccgccggcccaccaucgagaaggacgucgaccugggcgccggcacccgccacgugaacgccgagccggagacccccaacauggacgugaucggggagcggauccgccggaucaaggaggagcacagcuccacguggcacuacgacgacgagaaccccuacaagaccugggccuaccacggcagcuacgaggucaaggccaccggguccgcgagcagcaugaucaacggcguggugaagcugcucaccaagccgugggacgucgugcccacggugacccagauggccaugaccgacaccacgcccuucgggcagcagcgcgucuucaaggagaagguggacacccggacccccaagccgaugcccggcacccgcaagaucauggagaucacggccggcuggcuguggcggacccuggggcgcaacaagcggccccgccucugcacccgggaggaguucaccaagaaggugcgcacgaacgccgccaugggcgcggucuucaccgaggagaaccagugggacuccgcccgcgccgccguggaggacgaggaguucuggaagcugguggaccgggagcgcgagcugcacaagcaggggaagugcggcagcugcgucuacaacaugauggggaagcgggagaagaagcucggcgaguucggcaaggcgaaggggucccgcgccaucugguacauguggcugggcgcccgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgcggacgacaccgccgggugggacacccgcaucacggaggacgaccugcacaacgaggagaagaucacccagcagauggacccggagcaccggcagcucgccaacgccaucuucaagcugaccuaccagaacaagguggucaaggugcagcgccccacccccaagggcacggugauggacaucaucagccggaaggaccagcgcggcuccgggcaggucggcaccuacgggcugaacaccuucaccaacauggaggcccagcucauccggcagauggagggcgagggggugcugagcaagaccgaccuggagaacccccaccuccuggagaagaagaucacgcaguggcuggagaccaagggcguggagcgccucaagcggauggcgaucuccggcgacgacugcgucgugaagccgaucgacgaccgcuucgccaacgcccugcuggcccucaacgacauggggaaggugcggaaggacaucccccaguggcagcccagcaagggcuggcacgacuggcagcagguccccuucugcucccaccacuuccacgagcugaucaugaaggacgggcgcaaccugguggugccgugccggccccaggacgagcucaucggccgcgcccggaucagccagggggcgggcuggucccugaaggagaccgccugccugggcaaggccuacgcccagaugugggcccucauguacuuccaccgccgcgaccugcggcuggcgagcaacgccaucugcuccgccguccccgugcacugggugcccaccagccgcacgaccugguccauccacgcccaccaccaguggaugaccaccgagaacaugcucacggucuggaaccggguguggaucgaggacaacccguggauggaggacaagacccccgugaccaccugggaggacguccccuaccuggggaagcgcgaggaccaguggugcggcagccugaucgggcucacgagccgggcgaccugggcccagaacauccugaccgccauccagcagguccgcucccugaucggcaacgaggaguuccucgacuacaugcccagcaugaagcgguuccgcaaggaggaggaguccgagggggccaucugguga

SEQ ID NO: 10357 - RNA, 9873 nt, Artificial Sequence
  derived and/or modified CDS sequence (opt1) from DENV-3__JQ920481__SS-prME
accagccugugccucaugaugaugcugcccgccacccuggccuuccaccucaccagccgggacggcgagccccggaugaucguggggaagaacgagcgcggcaagagccugcuguucaagaccgccagcgggaucaacaugugcacccucaucgccauggaccugggcgagaugugcgacgacaccgugaccuacaagugcccccugaucaccgagguggagcccgaggacaucgacugcuggugcaaccucaccagcaccugggugaccuacgggaccugcaaccaggccggcgagcaccggcgcgacaagcggagcguggcccuggcgccccacgugggcauggggcuggacacccgcacccagaccuggaugagcgcggagggcgccuggcgccagguggagaaggucgagaccugggccuuccgccaccccggguucaccauccucgcccuguuccuggcgcacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacgugaccacggacagccgcugccccacccagggcgaggcgauccugcccgaggagcaggaccagaacuacgucugcaagcacaccuacguggaccggggguggggcaacgggugcggccucuucgggaagggcucccuggugaccugcgccaaguuccagugccuggagagcaucgagggcaaggccguccagcacgagaaccucaaguacacggugaucaucaccgugcacaccggggaccagcaccaggucggcaacgagacccagggggugacggccgagaucacgccccaggccuccaccgucgaggcgauccugcccgaguacggcacccuggggcucgagugcagcccccgcaccggccuggacuucaacgagaugauccugcucacgaugaagaacaaggccuggauggugcaccggcagugguucuucgaccugccgcugcccuggaccuccggcgccaccaccgagacgcccaccuggaacaagaaggagcuccuggugaccuucaagaacgcccacgccaagaagcaggaggucguggugcuggggagccaggagggcgcgaugcacaccgcccucacgggggccaccgagauccagaccuccggcgggaccagcaucuucgccggccaccugaagugccgccugaagauggacaagcucgagcugaagggcauguccuacgccaugugccugaacgcguucguccucaagaaggaggugagcgagacgcagcacgggaccauccugaucaagguggaguacaagggcgaggacgcccccugcaagaucccguucagcaccgaggacgggcagggcaaggcccacaacggccggcugaucaccgccaaccccaucgucacgaagaaggaggagcccgugaacaucgaggcggagcccccguucggggaguccaacaucgugaucggcaucggggacaaggcccugaagaucaacugguacaagaagggcagcuccaucgggaagauguucgaggccaccgcccgcggcgcccggcgcauggcgauccucggcgacaccgccugggacuucgggagcgucggcggggugcugaacucccugggcaagauggugcaccagaucuucgggagcgccuacaccgcccucuucuccggcgucagcuggaucaugaagaucggcaucggggugcugcugacguggaucggccucaacuccaagaacaccagcauguccuucagcugcaucgugaucgggaucaucacccuguaccugggcgccgucgugcaggcggacauggggugcgugaucaacuggaagggcaaggagcucaagugcggcuccgggaucuucgucaccaacgaggugcacacguggaccgagcaguacaaguuccaggccgacagccccaagcggcuggccaccgccaucgccggcgcgugggagaacggggugugcggcauccgcuccaccacgcgcauggagaaccugcucuggaagcagaucgccaacgagcugaacuacauccugugggagaacaacaucaagcucaccgucguggugggggacgucaucggcgugcuggagcagggcaagcggacccugacgccccagcccauggagcucaaguacagcuggaagacgugggggaaggccaagaucgugaccgccgagacccagaacuccagcuucaucaucgacggcccgaacacccccgagugccccuccgcgagccgcgccuggaacgucugggagguggaggacuacggguucggcguguucacgaccaacaucuggcugaagcugcgggagauguacacccagcucugcgaccaccgccugaugagcgccgccgucaaggacgagcgggccgugcacgcggacaugggcuacuggaucgagucccagaagaacgggagcuggaagcuggagaaggccucccucaucgaggugaagaccugcaccuggcccaagagccacacgcugugguccaacggcguccuggagagcgacaugaucaucccgaagucccucgccgggcccaucagccagcacaacuaccgccccggcuaccacacccagaccgccgggccguggcaccugggcaagcuggagcucgacuucaacuacugcgagggcaccacgguggugaucaccgagaacugcgggacccggggccccucccugcgcaccacgaccgucagcgggaagcugauccacgaguggugcugccgguccugcacccugccgccccuccgcuacaugggcgaggacgggugcugguacggcauggagauccggccgaucaacgagaaggaggagaacauggucaagagccugguguccgccggcagcgggaaggcggacaacuucaccaugggcguccucugccuggccauccuguucgaggaggugaugcgcgggaaguucggcaagaagcacaugaucgccggggcccucuucacguucgugcugcugcucuccggccagaucaccuggcgggacauggcccacacccugaucaugaucggcagcaacgcguccgaccgcauggggaugggcgucaccuaccuggcccucaucgccacguucaagauccagcccuuccuggcccugggguucuuccuccggaagcugaccagccgcgagaaccugcuccugggcgugggccuggcgauggccaccacccuccagcugcccgaggacaucgagcagauggccaacgggaucgcccugggccucauggcccugaagcugaucacgcaguucgagaccuaccagcucuggaccgcgcuggugagccugaugugcuccaacaccaucuucacgcucaccgucgccuggcggaccgccacccugauccuggccgugaucagccuccugcccgugugccaguccagcuccaugcgcaagacggacuggcugccgaugaccgucgccgcgaugggggugccgccccucccccuguucaucuucagccugaaggacacccucaagcggcgcuccuggccgcugaacgagggcgucauggccguggggcuggugagcauccucgccuccagcuuccugcgcaacgacguccccauggccggcccccugguggccggcgggcuccugaucgcgugcuacgugaucaccggcacguccgccgaccugaccgucgagaaggccgccgacgugaccugggaggaggaggccgagcagaccggggugagccacaaccucaugaucacggucgacgacgacggcaccaugcggaucaaggacgacgagaccgagaacauccugaccgugcugcucaagaccgcgcugcugaucguguccgggaucuuccccuacagcaucccggccacgcuccuggucuggcacaccuggcagaagcagacccagcgcuccggcgugcugugggacgugcccuccccgcccgagacccagaaggccgagcucgaggagggcgucuaccggaucaagcagcaggggaucuucggcaagacccaggugggggugggcguccagaaggaggggguguuccacaccauguggcacgugacccgcggcgccguccugacccacaacggcaagcggcuggagccgaacugggcgaacgugaagaaggaccucaucuccuacgggggcggguggaagcugagcgcccaguggcagaagggcgaggaggugcaggucaucgccguggagcccgggaagaaccccaagaacuuccagacgaugcccggcaucuuccagaccaccaccggcgagaucggggccaucgcccuggacuucaagccgggcacguccgggagccccaucaucaaccgcgagggcaagguggucggccuguacgggaacggcguggugaccaagaacgggggcuacgucagcgggaucgcgcagaccaacgccgagcccgacggcccgacccccgagcucgaggaggagauguucaagaagcggaaccugacgaucauggaccugcaccccggcuccgggaagacccgcaaguaccuccccgccaucgugcgggaggccaucaagcgccggcugcgcacccugauccucgccccgacccggguggucgcggccgagauggaggaggcccugaagggccugcccauccgcuaccagacgaccgccaccaagagcgagcacaccgggcgggagaucguggaccucaugugccacgccacguucaccaugcgccugcugucccccgugcggguccccaacuacaaccucaucgugauggacgaggcgcacuucaccgacccggccagcaucgccgcccgcggcuacaucuccacccggguggggaugggcgaggcggccgccaucuucaugacggccacgccgcccggcaccgccgacgcguucccccagagcaacgccccgauccaggacgaggagcgcgacauccccgagcgguccuggaacagcgggaacgaguggaucaccgacuucgccggcaagacggucugguucgugcccuccaucaaggccgggaacgacaucgccaacugccugcgcaagaacggcaagaaggugauccagcugagccgcaagaccuucgacaccgaguaccagaagaccaagcucaacgacugggacuucgucgugacgaccgacaucuccgagaugggggcgaacuucaaggccgaccgggugaucgacccccgccggugccugaagccggucauccugaccgacggccccgagcgcgugauccucgccggccccaugcccgugaccgucgccagcgccgcgcagcggcgcgggcgggugggccgcaacccgcagaaggagaacgaccaguacaucuucacggggcagccccugaacaacgacgaggaccacgcccacuggaccgaggccaagaugcugcucgacaacaucaacacccccgagggcaucauccccgcccuguucgagccggagcgggagaaguccgcggccaucgacggggaguaccgccugaagggcgagagccggaagaccuucguggagcucaugcgccggggcgaccugcccgucuggcuggcccacaagguggccuccgaggggaucaaguacaccgaccgcaaguggugcuucgacggcgagcggaacaaccagauccucgaggagaacauggacgucgagaucuggacgaaggagggggagaagaagaagcugcgcccccgguggcuggacgcccgcaccuacagcgacccccucgcgcugaaggaguucaaggacuucgccgccggccggaaguccaucgcccuggaccucgugaccgagaucggccgcgugccgagccaccuggcccaccgcacccggaacgcgcuggacaaccucgucaugcugcacacguccgagcacgggggccgcgccuaccggcacgccguggaggagcugcccgagaccauggagacccuccugcugcucgggcugaugauccugcucaccggcggggccaugcuguuccugaucagcggcaagggcaucgggaagacgagcaucggccucaucugcguggucgccuccagcgggaugcuguggauggcggacgugccccugcaguggaucgccuccgccaucgugcucgaguucuucaugaugguccugcugaucccggagcccgagaagcagcgcacgccccaggacaaccagcucgccuacguggugaucggcauccugacccuggccgcgaucgucgccgccaacgagauggggcuccuggagaccacgaagcgggaccugggcaugagcaaggagcccggcgugguguccccgaccagcuaccucgacgucgaccugcaccccgccuccgcguggacccuguacgccguggccaccacggugaucacccccaugcuccgccacaccaucgagaacagcaccgccaacgucucccuggccgcgaucgccaaccaggccguggugcugauggggcucgacaagggcuggcccaucagcaagauggaccugggggucccgcugcucgcccugggcugcuacucccaggugaacccccugacgcucaccgccgcggugcugcugcucgucacccacuacgccaucaucgggcccggccugcaggccaaggccacccgggaggcccagaagcgcacggcggccggcaucaugaagaaccccaccguggacgggaucaugaccaucgaccuggacccggugaucuacgacagcaaguucgagaagcagcucggccaggucaugcugcuggugcucugcgccgugcagcugcugcucaugcggaccuccugggccuucugcgaggcgcugacgcuggccaccgggcccaucaccacccucugggagggcagccccggcaaguucuggaacacgaccaucgccgucuccauggccaacaucuuccgcgggagcuaccuggccggcgcggggcuggccuucuccaucaugaaguccgugggcaccgggaagcggggcaccggcucccagggggagacgcucggcgagaaguggaagaagaagcugaaccagcugagccgcaaggaguucgaccucuacaagaaguccgggaucaccgagguggaccggaccgaggccaaggagggccugaagcgcggggagaucacccaccacgccgucucccggggcagcgccaagcugcagugguucguggagcgcaacauggugauccccgagggccgggucaucgaccucgggugcggccgcgggggcugguccuacuacugcgcggggcugaagaaggugaccgaggugcggggcuacacgaagggcgggccgggccacgaggagcccguccccaugagcaccuacggguggaacaucgugaagcugauguccggcaaggacguguucuaccucccgcccgagaagugcgacacccugcugugcgacaucggggagagcucccccagccccaccgucgaggagucccgcacgauccgggugcugaagaugguggagcccuggcucaagaacaaccaguucugcaucaagguccugaaccccuacaugcccaccgugaucgagcaccuggagcgccuccagcgcaagcacggcggcaugcuggugcggaacccccugagccgcaacuccacccacgagauguacuggaucagcaacgggaccggcaacaucgucuccagcgugaacauggugucccggcuccugcugaaccgcuucacgaugacccaccggcgccccaccaucgagaaggacgucgaccucggggccggcacccggcacgugaacgccgagccggagacgcccaacauggacgucaucggcgagcgcauccggcgcaucaaggaggagcacagcuccaccuggcacuacgacgacgagaaccccuacaagaccugggccuaccacgggagcuacgaggugaaggccaccggcuccgcgagcagcaugaucaacgggguggucaagcugcugacgaagccgugggacguggugcccauggucacccagauggccaugaccgacaccacgcccuucggccagcagcggguguucaaggagaagguggacacccgcacgccccggccgaugcccgggacccgcaaggucauggagaucacggccgaguggcucuggcggacccugggccgcaacaagcggccccgccugugcacccgggaggaguucaucaagaaggugcgcaccaacgccgcgaugggcgccguguucacggaggagaaccagugggacuccgcccgcgccgccgucgaggacgaggaguucuggaagcucguggaccgggagcgcgagcugcacaagcuggggaagugcggcagcugcguguacaacaugauggggaagcgggagaagaagcucggcgaguucgggaaggcgaagggcucccgcgccaucugguacauguggcugggcgcccgguaccuggaguucgaggcccucggguuccugaacgaggaccacugguucagccgcgagaacuccuacagcggcgucgagggggagggccugcacaagcucggguacauccugcgggacaucuccaagauccccggcggcgccauguacgcggacgacaccgccgggugggacacccgcaucaccgaggacgaccugcacaacgaggagaagaucacgcagcagauggacccggagcaccggcagcucgccaacgccaucuucaagcugaccuaccagaacaagguggugaagguccagcgccccacccccaagggcaccgugauggacaucaucagccggaaggaccagcgcggguccggccaggugggcacguacgggcugaacaccuucaccaacauggaggcccagcucauccggcagauggagggcgaggggguccugagcaaggcggaccuggagaacccccaccuccuggagaagaaggugacccaguggcuggagaccaagggcguggagcgccucaagcggauggccaucuccggggacgacugcgucgugaagccgaucgacgaccgcuucgccaacgcccugcuggcccucaacgacaugggcaaggugcggaaggacaucccccaguggcagcccagcaagggcuggcacgacuggcagcagguccccuucugcucccaccacuuccacgagcugaucaugaaggacgggcgcaagcugguggugccgugccggccccaggacgagcucaucggccgcgcgcggaucagccagggggccggcuggucccugcgcgagacggccugccuggggaaggccuacgcgcagaugugggcccucauguacuuccaccgccgggaccugcgccuggccagcaacgccaucugcuccgccguccccgugcacugggugcccaccagccggaccaccugguccauccacgcgcaccaccaguggaugacgaccgaggacaugcucaccgucuggaaccgcguguggaucgaggacaacccguggauggaggacaagacccccgugacgaccugggaggacguccccuaccugggcaagcgggaggaccaguggugcggcagccugaucgggcucaccagccgcgccaccugggcccagaacauccugacggccauccagcagguccggucccugaucggcaacgaggaguuccucgacuacaugcccagcaugaagcgcuuccggaaggaggaggaguccgagggggccaucugguga

SEQ ID NO: 10358 - RNA, 9873 nt, Artificial Sequence
  derived and/or modified CDS sequence (opt1) from DENV-3__JQ920483__SS-prME
accagccucugccucaugaugaugcugcccgccacccuggccuuccaccucaccagccgggacggcgagccccggaugaucguggggaagaacgagcggggcaagagccugcuguucaagaccgccagcgggaucaacaugugcacccucaucgccauggaccugggcgagaugugcgacgacaccgugaccuacaagugcccccugaucaccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgcggagggcgccuggcgccagguggagaaggucgagaccugggccuuccgccaccccggguucaccauccucgcccuguuccuggcgcacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacgugaccacggacagccgcugccccacccagggcgaggcgauccugcccgaggagcagaaccagaacuacgucugcaagcacaccuacguggaccggggguggggcaacgggugcggccucuucgggaagggcucccuggugaccugcgccaaguuccagugccuggagagcaucgagggcaaggccguccagcacgagaaccucaaguacacggugaucaucaccgugcacaccggggaccagcaccaggucggcaacgagacccagggggugacggccgagaucacgccccaggccuccaccgucgaggcgauccugcccgaguacggcacccuggggcucgagugcagcccccgcaccggccuggacuucaacgagaugauccugcucacgaugaagaacaaggccuggauggugcaccggcagugguucuucgaccugccgcugcccuggaccuccggcgccaccaccgagacgcccaccuggaacaagaaggagcuccuggugaccuucaagaacgcccacgccaagaagcaggaggucguggugcuggggagccaggagggcgcgaugcacaccgcccucacgggggccaccgagauccagaccuccggcgggaccagcaucuucgccggccaccugaagugccgccugaagauggacaagcucgagcugaagggcauguccuacgccaugugccugaacgcguucguccucaagaaggaggugagcgagacgcagcacgggaccauccugaucaagguggaguacaagggcgaggacgcccccugcaagauccccuucagcaccgaggacgggcagggcaaggcccacaacggccggcugaucaccgccaaccccaucgucacgaagaaggaggagcccgugaacaucgaggcggagccgcccuucggggaguccaacaucgugaucggcaucggggacaaggcccugaagaucaacugguacaagaagggcagcuccaucgggaagauguucgaggccaccgcccgcggcgcccggcgcauggcgauccucggcgacaccgccugggacuucgggagcgucggcggggugcugaacucccugggcaagauggugcaccagaucuucgggagcgccuacaccgcccucuucuccggcgucagcuggaucaugaagaucggcaucggggugcugcugacguggaucggccucaacuccaagaacaccagcauguccuucagcugcaucgugaucgggaucaucacccuguaccugggcgccgucgugcaggcggacauggggugcgugaucaacuggaagggcaaggagcucaagugcggcuccgggaucuucgucaccaacgaggugcacacguggaccgagcaguacaaguuccaggccgacagccccaagcggcuggccaccgccaucgccggcgcgugggagaacggggugugcggcauccgcuccaccacgcgcauggagaaccugcucuggaagcagaucgccaacgagcugaacuacauccugugggagaacaacaucaagcucaccaucgucgugggggacgugaucggcguccuggagcagggcaagcggacccugacgccccagcccauggagcucaaguacagcuggaagacgugggggaaggccaagaucgugaccgccgagacccagaacuccagcuucaucaucgacggccccaacacccccgagugccccuccgcgagccgcgccuggaacgugugggaggucgaggacuacggguucggcguguucacgaccaacaucuggcugaagcugcgggagaaguacacccagcucugcgaccaccgccugaugagcgccgccgugaaggacgagcgggccguccacgcggacaugggcuacuggaucgagucccagaagaacgggagcuggaagcuggagaaggccucccucaucgaggugaagaccugcaccuggcccaagagccacacgcugugguccaacggcgugcuggagagcgacaugaucaucccgaagucccucgccgggcccaucagccagcacaacuaccgccccggcuaccacacccagaccgccgggccguggcaccugggcaagcuggagcucgacuucaacuacugcgagggcaccacggucgugaucaccgagaacugcgggauccggggccccucccugcgcaccaccacggugagcgggaagcugauccacgaguggugcugccgguccugcacccugccgccccuccgcuacaugggcgaggacgggugcugguacggcauggagauccggccgaucaacgagaaggaggagaacauggucaagagccugguguccgccggcagcgggaagaccgacaacuucaccaugggcgugcucugccuggcgauccuguucgaggaggucaugcgcgggaaguucggcaagaagcacaugaucgccggggcccucuucacguucgugcugcugcucuccggccagaucaccuggcgggacauggcccacacccugaucaugaucggcagcaacgccuccgaccgcauggggaugggcgugaccuaccuggcgcucaucgccacguucaagauccagcccuuccuggcccugggguucuuccuccggaagcugaccagccgcgagaaccugcuccugggcgucggccuggccauggcgaccacccuccagcugcccgaggacaucgagcagauggccaacgggaucgcccugggccucauggcccugaagcugaucacgcaguucgagaccuaccagcucuggaccgcccugaucagccugaugugcuccaacaccaucuucacgcucaccguggcguggcggaccgccacccugauccuggccgugaucagccuccugcccgucugccaguccagcuccaugcgcaagacggacuggcugccgaugaccguggccgccaugggggugccgccccucccccuguucaucuucagccugaaggacacccucaagcggcgcuccuggccgcugaacgagggcgucauggcgguggggcuggucagcauccucgccuccagcuuccugcgcaacgacgugcccauggccggcccccugguggccggcgggcuccugaucgccugcuacgucaucaccggcacguccgcggaccugaccguggagaaggccgccgacgugaccugggaggaggaggccgagcagaccggggucagccacaaccucaugaucacgguggacgacgacggcaccaugcggaucaaggacgacgagaccgagaacauccugaccgugcugcucaagaccgcccugcugaucgucuccgggaucuuccccuacagcaucccggcgacgcuccugguguggcacaccuggcagaagcagacccagcgcuccggcgugcugugggacguccccuccccgcccgagacccagaaggccgagcucgaggagggcguguaccggaucaagcagcaggggaucuucggcaagacccaggugggggucggcgugcagaaggaggggguguuccacaccauguggcacgucacccgcggcgccgugcugacccacaacggcaagcggcuggagccgaacugggccaacgugaagaaggaccucaucuccuacgggggcggguggaagcugagcgcgcaguggcagaagggcgaggagguccaggugaucgccguggagcccgggaagaaccccaagaacuuccagacgaugcccggcaucuuccagaccaccaccggcgagaucggggccaucgcccuggacuucaagccgggcacguccgggagccccaucaucaaccgcgagggcaaggucgugggccuguacgggaacggcguggucaccaagaacgggggcuacgugagcgggaucgcccagaccaacgcggagcccgacggcccgacccccgagcucgaggaggagauguucaagaagcggaaccugacgaucauggaccugcaccccggcuccgggaagacccgcaaguaccuccccgccaucgugcgggaggccaucaagcgccggcugcgcacccugauccucgccccgacccgggucguggccgcggagauggaggaggcccugaagggccugcccauccgcuaccagacgaccgccaccaagagcgagcacaccgggcgggagaucguggaccucaugugccacgccacguucaccaugcgccugcugucccccguccgggugcccaacuacaaccucaucgugauggacgaggcccacuucaccgacccggcgagcaucgccgcccgcggcuacaucuccacccgggucgggaugggcgaggccgcggccaucuucaugacggccacgccgcccggcaccgccgacgccuucccccagagcaacgcgccgauccaggacgaggagcgcgacauccccgagcgguccuggaacagcgggaacgaguggaucaccgacuucgccggcaagacggugugguucgugcccuccaucaaggccgggaacgacaucgccaacugccugcgcaagaacggcaagaaggucauccagcugagccgcaagaccuucgacaccgaguaccagaagaccaagcucaacgacugggacuucguggugacgaccgacaucuccgagaugggggccaacuucaaggcggaccgggucaucgacccccgccggugccugaagccggugauccugaccgacggccccgagcgcgugauccucgccggccccaugcccgucaccguggccagcgccgcccagcggcgcgggcgggugggccgcaacucccagaaggagaacgaccaguacaucuucacggggcagccgcugaacaacgacgaggaccacgcgcacuggaccgaggccaagaugcugcucgacaacaucaacacccccgagggcaucauccccgcccuguucgagcccgagcgggagaaguccgccgcgaucgacggggaguaccgccugaagggcgagucccggaagaccuucgucgagcucaugcgccggggcgaccugccgguguggcuggcccacaagguggccagcgaggggaucaaguacaccgaccgcaaguggugcuucgacggcgagcggaacaaccagauccucgaggagaacauggacgucgagaucuggacgaaggagggggagaagaagaagcugcgcccccgguggcuggacgcccgcaccuacuccgacccccucgcccugaaggaguucaaggacuucgcggccggccgcaagagcaucgcccuggaccucgugaccgagaucggccgcguccccucccaccuggcccaccgcacccggaacgcccuggacaaccucgugaugcugcacacgagcgagcacgggggccgcgcguaccggcacgccguggaggagcugccggagaccauggagacccuccugcugcucgggcugaugauccugcucaccggcggggccaugcuguuccugaucagcggcaagggcaucgggaagacguccaucggccucaucugcgucguggccagcuccgggaugcuguggauggccgacgugccccugcaguggaucgcgagcgccaucguccucgaguucuucaugauggugcugcugauccccgagccggagaagcagcgcacgccccaggacaaccagcucgccuacguggucaucggcauccugacccuggccgccaucguggcggccaacgagauggggcuccuggagaccacgaagcgggaccugggcauguccaaggagcccggcguggucagccccaccuccuaccucgacguggaccugcacccggccagcgccuggacccuguacgcgguggccaccacggucaucacccccaugcuccgccacaccaucgagaacuccaccgccaacgugagccuggccgccaucgcgaaccaggccgugguccugauggggcucgacaagggcuggcccaucuccaagauggaccugggggugccccugcucgcccugggcugcuacagccaggugaacccgcugacgcucaccgccgccguccugcugcucgugacccacuacgcgaucaucgggcccggccugcaggccaaggccacccgggaggcccagaagcgcacggccgcgggcaucaugaagaaccccaccguggacgggaucaugaccaucgaccuggaccccgucaucuacgacuccaaguucgagaagcagcucggccaggugaugcugcuggugcucugcgccguccagcugcugcucaugcggaccagcugggccuucugcgaggcccugacgcuggcgaccgggccgaucaccacccucugggagggcucccccggcaaguucuggaacacgaccaucgccgugagcauggccaacaucuuccgcggguccuaccuggccggcgccgggcuggcguucagcaucaugaaguccgugggcaccgggaagcggggcaccggcagccagggggagacgcucggcgagaaguggaagaagaagcugaaccagcugagccgcaaggaguucgaccucuacaagaaguccgggaucaccgaggucgaccggaccgaggccaaggagggccugaagcgcggggagaucacccaccacgccgugagccggggcuccgccaagcugcagugguucguggagcgcaacauggucauccccgagggccgggugaucgaccucgggugcggccgcgggggcuggagcuacuacugcgccgggcugaagaaggugaccgagguccggggcuacacgaagggcgggcccggccacgaggagccggugcccauguccaccuacggguggaacaucgugaagcugaugagcggcaaggacgucuucuaccugccgcccgagaagugcgacacccugcugugcgacaucggggaguccagcccgucccccaccguggaggagagccgcacgauccgggugcugaagauggucgagcccuggcucaagaacaaccaguucugcaucaaggugcugaaccccuacaugccgaccgugaucgagcaccuggagcgccuccagcgcaagcacggcggcaugcugguccggaacccccugucccgcaacagcacccacgagauguacuggaucuccaacgggaccggcaacaucgugagcuccgugaacauggucagccggcuccugcugaaccgcuucacgaugacccaccggcgccccaccaucgagaaggacguggaccucggggcgggcacccggcacgugaacgccgagcccgagacgccgaacauggacgucaucggcgagcgcauccggcgcaucaaggaggagcacuccagcaccuggcacuacgacgacgagaaccccuacaagaccugggccuaccacggguccuacgaggugaaggccaccggcagcgccagcuccaugaucaacggggucgugaagcugcugacgaagcccugggacguggucccgauggugacccagauggcgaugaccgacaccacgcccuucggccagcagcggguguucaaggagaaggucgacacccgcacgccccggcccaugccggggacccgcaaggugauggagaucacggccgaguggcucuggcggacccugggccgcaacaagcggccccgccugugcacccgggaggaguucaucaagaaggugcgcaccaacgccgccaugggcgcggucuucacggaggagaaccagugggacagcgcccgcgccgccguggaggacgaggaguucuggaagcucguggaccgggagcgcgagcugcacaagcuggggaagugcggcuccugcgucuacaacaugauggggaagcgggagaagaagcucggcgaguucgggaaggccaagggcagccgcgcgaucugguacauguggcugggcgcccgguaccuggaguucgaggcccucggguuccugaacgaggaccacugguucucccgcgagaacagccacuccggcguggagggggagggccugcacaagcucggguacauccugcgggacaucagcaagauccccggcggcgccauguacgccgacgacaccgcggggugggacacccgcaucaccgaggacgaccugcacaacgaggagaagaucacgcagcagauggaccccgagcaccggcagcucgccaacgccaucuucaagcugaccuaccagaacaagguggucaaggugcagcgcccgacccccaagggcaccgugauggacaucaucucccggaaggaccagcgcgggagcggccaggucggcacguacgggcugaacaccuucaccaacauggaggcccagcucauccggcagauggagggcgagggggugcuguccaaggccgaccuggagaacccccaccuccuggagcgcaaggugacccaguggcuggagaccaagggcgucgagcggcucaagcgcauggcgaucagcggggacgacugcguggugaagcccaucgacgaccgguucgccaacgcccugcuggcccucaacgacaugggcaagguccgcaaggacaucccgcaguggcagcccuccaagggcuggcacgacuggcagcagguccccuucugcagccaccacuuccacgagcugaucaugaaggacgggcggaagcuggugguccccugccgcccgcaggacgagcucaucggccgggcccgcaucucccagggggcgggcuggagccugcgcgagacggccugccuggggaaggccuacgcccagaugugggcgcucauguacuuccaccggcgcgaccugcggcuggccuccaacgccaucugcagcgccgugcccgugcacuggguccccaccucccgcaccaccuggagcauccacgcccaccaccaguggaugacgaccgaggacaugcucaccguguggaaccggguguggaucgaggacaaccccuggauggaggacaagaccccggucacgaccugggaggacgugcccuaccugggcaagcgcgaggaccaguggugcggcagccugaucgggcucaccucccgggcgaccugggcccagaacauccugacggccauccagcagguccgcagccugaucggcaacgaggaguuccucgacuacaugcccuccaugaagcgguuccgcaaggaggaggagagcgagggggccaucugguga

SEQ ID NO: 10359 - RNA, 9873 nt, Artificial Sequence
  derived and/or modified CDS sequence (opt1) from DENV-3__JQ920482__SS-prME
accagccucugccucaugaugaugcugcccgccacccuggccuuccaccucaccagccgggacggcgagccccggaugaucguggggaagaacgagcggggcaagagccugcuguucaagaccgccagcgggaucaacaugugcacccucaucgccauggaccugggcgagaugugcgacgacaccgugaccuacaagugcccccugaucaccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgcggagggcgccuggcgccagguggagaaggucgagaccugggccuuccgccaccccggguucaccauccucgcccuguuccuggcgcacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacgugaccacggacagccgcugccccacccagggcgaggcgauccugcccgaggagcaggaccagaacuacgucugcaagcacaccuacguggaccggggguggggcaacgggugcggccucuucgggaagggcucccuggugaccugcgccaaguuccagugccuggagagcaucgagggcaaggccguccagcacgagaaccucaaguacacggugaucaucaccgugcacaccggggaccagcaccaggucggcaacgagacccagggggugacggccgagaucacgccccaggccuccaccgucgaggcgauccugcccgaguacggcacccuggggcucgagugcagcccccgcaccggccuggacuucaacgagaugauccugcucacgaugaagaacaaggccuggauggugcaccggcagugguucuucgaccugccgcugcccuggaccuccggcgccaccaccgagacgcccaccuggaacaagaaggagcuccuggugaccuucaagaacgcccacgccaagaagcaggaggucguggugcuggggagccaggagggcgcgaugcacaccgcccucacgggggccaccgagauccagaccuccggcgggaccagcaucuucgccggccaccugaagugccgccugaagauggacaagcucgagcugaagggcauguccuacgccaugugccugaacgcguucguccucaagaaggaggugagcgagacgcagcacgggaccauccugaucaagguggaguacaagggcgaggacgcccccugcaagauccccuucagcaccgaggacgggcagggcaaggcccacaacggccggcugaucaccgccaaccccaucgucacgaagaaggaggagcccgugaacaucgaggcggagccgcccuucggggaguccaacaucgugaucggcaucggggacaaggcccugaagaucaacugguacaagaagggcagcuccaucgggaagauguucgaggccaccgcccgcggcgcccggcgcauggcgauccucggcgacaccgccugggacuucgggagcgucggcggggugcugaacucccugggcaagauggugcaccagaucuucgggagcgccuacaccgcccucuucuccggcgucagcuggaucaugaagaucggcaucggggugcugcugacguggaucggccucaacuccaagaacaccagcauguccuucagcugcaucgugaucgggaucaucacccuguaccugggcgccgucgugcaggcggacauggggugcgugaucaacuggaagggcaaggagcucaagugcggcuccgggaucuucgucaccaacgaggugcacacguggaccgagcaguacaaguuccaggccgacagccccaagcggcuggccaccgccaucgccggcgcgugggagaacggggugugcggcauccgcuccaccacgcgcauggagaaccugcucuggaagcagaucgccaacgagcugaacuacauccugugggagaacaacaucaagcucaccaucgucgugggggacgugaucggcguccuggagcagggcaagcggacccugacgccccagcccauggagcucaaguacagcuggaagacgugggggaaggccaagaucgugaccgccgagacccagaacuccagcuucaucaucgacggccccaacacccccgagugccccuccgcgagccgcgccuggaacgugugggaggucgaggacuacggguucggcguguucacgaccaacaucuggcugaagcugcgggagaaguacacccagcucugcgaccaccgccugaugagcgccgccgugaaggacgagcgggccguccacgcggacaugggcuacuggaucgagucccagaagaacgggagcuggaagcuggagaaggccucccucaucgaggugaagaccugcaccuggcccaagagccacacgcugugguccaacggcgugcuggagagcgacaugaucaucccgaagucccucgccgggcccaucagccagcacaacuaccgccccggcuaccacacccagaccgccgggccguggcaccugggcaagcuggagcucgacuucaacuacugcgagggcaccacggucgugaucaccgagaacugcgggauccggggccccucccugcgcaccaccacggugagcgggaagcugauccacgaguggugcugccgguccugcacccugccgccccuccgcuacaugggcgaggacgggugcugguacggcauggagauccggccgaucaacgagaaggaggagaacauggucaagagccugguguccgccggcagcgggaagaccgacaacuucaccaugggcgugcucugccuggcgauccuguucgaggaggucaugcgcgggaaguucggcaagaagcacaugaucgccggggcccucuucacguucgugcugcugcucuccggccagaucaccuggcgggacauggcccacacccugaucaugaucggcagcaacgccuccgaccgcauggggaugggcgugaccuaccuggcgcucaucgccacguucaagauccagcccuuccuggcccugggguucuuccuccggaagcugaccagccgcgagaaccugcuccugggcgucggccuggccauggcgaccacccuccagcugcccgaggacaucgagcagauggccaacgggaucgcccugggccucauggcccugaagcugaucacgcaguucgagaccuaccagcucuggaccgcccugaucagccugaugugcuccaacaccaucuucacgcucaccguggcguggcggaccgccacccugauccuggccgugaucagccuccugcccgucugccaguccagcuccaugcgcaagacggacuggcugccgaugaccguggccgccaugggggugccgccccucccccuguucaucuucagccugaaggacacccucaagcggcgcuccuggccgcugaacgagggcgucauggcgguggggcuggucagcauccucgccuccagcuuccugcgcaacgacgugcccauggccggcccccugguggccggcgggcuccugaucgccugcuacgucaucaccggcacguccgcggaccugaccguggagaaggccgccgacgugaccugggaggaggaggccgagcagaccggggucagccacaaccucaugaucacgguggacgacgacggcaccaugcggaucaaggacgacgagaccgagaacauccugaccgugcugcucaagaccgcccugcugaucgucuccgggaucuuccccuacagcaucccggcgacgcuccugguguggcacaccuggcagaagcagacccagcgcuccggcgugcugugggacguccccuccccgcccgagacccagaaggccgagcucgaggagggcguguaccggaucaagcagcaggggaucuucggcaagacccaggugggggucggcgugcagaaggaggggguguuccacaccauguggcacgucacccgcggcgccgugcugacccacaacggcaagcggcuggagccgaacugggccaacgugaagaaggaccucaucuccuacgggggcggguggaagcugagcgcgcaguggcagaagggcgaggagguccaggugaucgccguggagcccgggaagaaccccaagaacuuccagacgaugcccggcaucuuccagaccaccaccggcgagaucggggccaucgcccuggacuucaagccgggcacguccgggagccccaucaucaaccgcgagggcaaggucgugggccuguacgggaacggcguggucaccaagaacgggggcuacgugagcgggaucgcccagaccaacgcggagcccgacggcccgacccccgagcucgaggaggagauguucaagaagcggaaccugacgaucauggaccugcaccccggcuccgggaagacccgcaaguaccuccccgccaucgugcgggaggccaucaagcgccggcugcgcacccugauccucgccccgacccgggucguggccgcggagauggaggaggcccugaagggccugcccauccgcuaccagacgaccgccaccaagagcgagcacaccgggcgggagaucguggaccucaugugccacgccacguucaccaugcgccugcugucccccguccgggugcccaacuacaaccucaucgugauggacgaggcccacuucaccgacccggcgagcaucgccgcccgcggcuacaucuccacccgggucgggaugggcgaggccgcggccaucuucaugacggccacgccgcccggcaccgccgacgccuucccccagagcaacgcgccgauccaggacgaggagcgcgacauccccgagcgguccuggaacagcgggaacgaguggaucaccgacuucgccggcaagacggugugguucgugcccuccaucaaggccgggaacgacaucgccaacugccugcgcaagaacggcaagaaggucauccagcugagccgcaagaccuucgacaccgaguaccagaagaccaagcucaacgacugggacuucguggugacgaccgacaucuccgagaugggggccaacuucaaggcggaccgggucaucgacccccgccggugccugaagccggugauccugaccgacggccccgagcgcgugauccucgccggccccaugcccgucaccguggccagcgccgcccagcggcgcgggcgggugggccgcaacucccagaaggagaacgaccaguacaucuucacggggcagccgcugaacaacgacgaggaccacgcgcacuggaccgaggccaagaugcugcucgacaacaucaacacccccgagggcaucauccccgcccuguucgagcccgagcgggagaaguccgccgcgaucgacggggaguaccgccugaagggcgagucccggaagaccuucgucgagcucaugcgccggggcgaccugccgguguggcuggcccacaagguggccagcgaggggaucaaguacaccgaccgcaaguggugcuucgacggcgagcggaacaaccagauccucgaggagaacauggacgucgagaucuggacgaaggagggggagaagaagaagcugcgcccccgguggcuggacgcccgcaccuacuccgacccccucgcccugaaggaguucaaggacuucgcggccggccgcaagagcaucgcccuggaccucgugaccgagaucggccgcguccccucccaccuggcccaccgcacccggaacgcccuggacaaccucgugaugcugcacacgagcgagcacgggggccgcgcguaccggcacgccguggaggagcugccggagaccauggagacccuccugcugcucgggcugaugauccugcucaccggcggggccaugcuguuccugaucagcggcaagggcaucgggaagacguccaucggccucaucugcgucguggccagcuccgggaugcuguggauggccgacgugccccugcaguggaucgcgagcgccaucguccucgaguucuucaugauggugcugcugauccccgagccggagaagcagcgcacgccccaggacaaccagcucgccuacguggucaucggcauccugacccuggccgccaucguggcggccaacgagauggggcuccuggagaccacgaagcgggaccugggcauguccaaggagcccggcguggucagccccaccuccuaccucgacguggaccugcacccggccagcgccuggacccuguacgcgguggccaccacggucaucacccccaugcuccgccacaccaucgagaacuccaccgccaacgugagccuggccgccaucgcgaaccaggccgugguccugauggggcucgacaagggcuggcccaucuccaagauggaccugggggugccccugcucgcccugggcugcuacagccaggugaacccgcugacgcucaccgccgccguccugcugcucgugacccacuacgcgaucaucgggcccggccugcaggccaaggccacccgggaggcccagaagcgcacggccgcgggcaucaugaagaaccccaccguggacgggaucaugaccaucgaccuggaccccgucaucuacgacuccaaguucgagaagcagcucggccaggugaugcugcuggugcucugcgccguccagcugcugcucaugcggaccagcugggccuucugcgaggcccugacgcuggcgaccgggccgaucaccacccucugggagggcucccccggcaaguucuggaacacgaccaucgccgugagcauggccaacaucuuccgcggguccuaccuggccggcgccgggcuggcguucagcaucaugaaguccgugggcaccgggaagcggggcaccggcagccagggggagacgcucggcgagaaguggaagaagaagcugaaccagcugagccgcaaggaguucgaccucuacaagaaguccgggaucaccgaggucgaccggaccgaggccaaggagggccugaagcgcggggagaucacccaccacgccgugagccggggcuccgccaagcugcagugguucguggagcgcaacauggucauccccgagggccgggugaucgaccucgggugcggccgcgggggcuggagcuacuacugcgccgggcugaagaaggugaccgagguccggggcuacacgaagggcgggcccggccacgaggagccggugcccauguccaccuacggguggaacaucgugaagcugaugagcggcaaggacgucuucuaccugccgcccgagaagugcgacacccugcugugcgacaucggggaguccagcccgucccccaccguggaggagagccgcacgauccgggugcugaagauggucgagcccuggcucaagaacaaccaguucugcaucaaggugcugaaccccuacaugccgaccgugaucgagcaccuggagcgccuccagcgcaagcacggcggcaugcugguccggaacccccugucccgcaacagcacccacgagauguacuggaucuccaacgggaccggcaacaucgugagcuccgugaacauggucagccggcuccugcugaaccgcuucacgaugacccaccggcgccccaccaucgagaaggacguggaccucggggcgggcacccggcacgugaacgccgagcccgagacgccgaacauggacgucaucggcgagcgcauccggcgcaucaaggaggagcacuccagcaccuggcacuacgacgacgagaaccccuacaagaccugggccuaccacggguccuacgaggugaaggccaccggcagcgccagcuccaugaucaacggggucgugaagcugcugacgaagcccugggacguggucccgauggugacccagauggcgaugaccgacaccacgcccuucggccagcagcggguguucaaggagaaggucgacacccgcacgccccggcccaugccggggacccgcaaggugauggagaucacggccgaguggcucuggcggacccugggccgcaacaagcggccccgccugugcacccgggaggaguucaucaagaaggugcgcaccaacgccgccaugggcgcggucuucacggaggagaaccagugggacagcgcccgcgccgccguggaggacgaggaguucuggaagcucguggaccgggagcgcgagcugcacaagcuggggaagugcggcuccugcgucuacaacaugauggggaagcgggagaagaagcucggcgaguucgggaaggccaagggcagccgcgcgaucugguacauguggcugggcgcccgguaccuggaguucgaggcccucggguuccugaacgaggaccacugguucucccgcgagaacagccacuccggcguggagggggagggccugcacaagcucggguacauccugcgggacaucagcaagauccccggcggcgccauguacgccgacgacaccgcggggugggacacccgcaucaccgaggacgaccugcacaacgaggagaagaucacgcagcagauggaccccgagcaccggcagcucgccaacgccaucuucaagcugaccuaccagaacaagguggucaaggugcagcgcccgacccccaagggcaccgugauggacaucaucucccggaaggaccagcgcgggagcggccaggucggcacguacgggcugaacaccuucaccaacauggaggcccagcucauccggcagauggagggcgagggggugcuguccaaggccgaccuggagaacccccaccuccuggagaagaaggugacccaguggcuggagaccaagggcgucgagcgccucaagcggauggcgaucagcggggacgacugcguggugaagcccaucgacgaccgcuucgccaacgcccugcuggcccucaacgacaugggcaagguccggaaggacaucccgcaguggcagcccuccaagggcuggcacgacuggcagcagguccccuucugcagccaccacuuccacgagcugaucaugaaggacgggcgcaagcuggugguccccugccggccgcaggacgagcucaucggccgcgcccggaucucccagggggcgggcuggagccugcgcgagacggccugccuggggaaggccuacgcccagaugugggcgcucauguacuuccaccgccgggaccugcgccuggccuccaacgccaucugcagcgccgugcccgugcacuggguccccaccucccggaccaccuggagcauccacgcccaccaccaguggaugacgaccgaggacaugcucaccguguggaaccgcguguggaucgaggacaaccccuggauggaggacaagaccccggucacgaccugggaggacgugcccuaccugggcaagcgggaggaccaguggugcggcagccugaucgggcucaccucccgcgcgaccugggcccagaacauccugacggccauccagcagguccggagccugaucggcaacgaggaguuccucgacuacaugcccuccaugaagcgcuuccggaaggaggaggagagcgagggggccaucugguga

SEQ ID NO: 10360 - RNA, 9873 nt, Artificial Sequence
  derived and/or modified CDS sequence (opt1) from DENV-3__JQ920484__SS-prME
accagccucugccucaugaugaugcugcccgccacccuggccuuccaccucaccagccgggacggcgagccccggaugaucguggggaagaacgagcggggcaagagccugcuguucaagaccgccagcgggaucaacaugugcacccucaucgccauggaccugggcgagaugugcgacgacaccgugaccuacaagugcccccugaucaccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgcggagggcgccuggcgccagguggagaaggucgagaccugggccuuccgccaccccggguucaccauccucgcccuguuccuggcgcacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacgugaccacggacagccgcugccccacccagggcgaggcgauccugcccgaggagcaggaccagaacuacgucugcaagcacaccuacguggaccggggguggggcaacgggugcggccucuucgggaagggcucccuggugaccugcgccaaguuccagugccuggagagcaucgagggcaaggccguccagcacgagaaccucaaguacacggugaucaucaccgugcacaccggggaccagcaccaggucggcaacgagacccagggggugacggccgagaucacgccccaggccuccaccgucgaggcgauccugcccgaguacggcacccuggggcucgagugcagcccccgcaccggccuggacuucaacgagaugauccugcucacgaugaagaacaaggccuggauggugcaccggcagugguucuucgaccugccgcugcccuggaccuccggcgccaccaccgagacgcccaccuggaacaagaaggagcuccuggugaccuucaagaacgcccacgccaagaagcaggaggucguggugcuggggagccaggagggcgcgaugcacaccgcccucacgggggccaccgagauccagaccuccggcgggaccagcaucuucgccggccaccugaagugccgccugaagauggacaagcucgagcugaagggcauguccuacgccaugugccugaacgcguucguccucaagaaggaggugagcgagacgcagcacgggaccauccugaucaagguggaguacaagggcgaggacgcccccugcaagauccccuucagcaccgaggacgggcagggcaaggcccacaacggccggcugaucaccgccaaccccaucgucacgaagaaggaggagcccgugaacaucgaggcggagccgcccuucggggaguccaacaucgugaucggcaucggggacaaggcccugaagaucaacugguacaagaagggcagcuccaucgggaagauguucgaggccaccgcccgcggcgcccggcgcauggcgauccucggcgacaccgccugggacuucgggagcgucggcggggugcugaacucccugggcaagauggugcaccagaucuucgggagcgccuacaccgcccucuucuccggcgucagcuggaucaugaagaucggcaucggggugcugcugacguggaucggccucaacuccaagaacaccagcauguccuucagcugcaucgugaucgggaucaucacccuguaccugggcgccgucgugcaggcggacauggggugcgugaucaacuggaagggcaaggagcucaagugcggcuccgggaucuucgucaccaacgaggugcacacguggaccgagcaguacaaguuccaggccgacagccccaagcggcuggccaccgccaucgccggcgcgugggagaacggggugugcggcauccgcuccaccacgcgcauggagaaccugcucuggaagcagaucgccaacgagcugaacuacauccugugggagaacaacaucaagcucaccaucgucgugggggacgccaucggcgugcuggagcagggcaagcggacccugacgccccagcccauggagcucaaguacagcuggaagacgugggggaaggccaagaucgucaccgcggagacccagaacuccagcuucaucaucgacggccccaacacccccgagugccccuccgccagccgcgccuggaacgugugggagguggaggacuacggguucggcgucuucacgaccaacaucuggcugaagcugcgggagaaguacacccagcucugcgaccaccgccugaugagcgccgccgugaaggacgagcgggcggugcacgccgacaugggcuacuggaucgagucccagaagaacgggagcuggaagcuggagaaggccucccucaucgaggucaagaccugcaccuggcccaagagccacacgcugugguccaacggcgugcuggagagcgacaugaucaucccgaagucccucgccgggcccaucagccagcacaacuaccgccccggcuaccacacccagaccgccgggccguggcaccugggcaagcuggagcucgacuucaacuacugcgagggcaccacgguggucaucaccgagaacugcgggauccggggccccucccugcgcaccaccacggugagcgggaagcugauccacgaguggugcugccgguccugcacccugccgccccuccgcuacaugggcgaggacgggugcugguacggcauggagauccggccgaucaacgagaaggaggagaacauggucaagagccuggucuccgcgggcagcgggaagaccgacaacuucaccaugggcgugcucugccuggccauccuguucgaggaggugaugcgcgggaaguucggcaagaagcacaugaucgccggggcccucuucacguucguccugcugcucuccggccagaucaccuggcgggacauggcccacacccugaucaugaucggcagcaacgcguccgaccgcauggggaugggcgugaccuaccuggcccucaucgccacguucaagauccagcccuuccuggcccugggguucuuccuccggaagcugaccagccgcgagaaccugcuccugggcgugggccuggcgauggccaccacccuccagcugcccgaggacaucgagcagauggccaacgggaucgcccugggccucauggcccugaagcugaucacgcaguucgagaccuaccagcucuggaccgcgcugaucagccugaugugcuccaacaccaucuucacgcucaccgucgccuggcggaccgccacccugauccuggccgugaucagccuccugcccgugugccaguccagcuccaugcgcaagacggacuggcugccgaugaccgucgccgcgaugggggugccgccccucccccuguucaucuucagccugaaggacacccucaagcggcgcuccuggccgcugaacgagggcgugauggccgucgggcuggugagcauccucgccuccagcuuccugcgcaacgacguccccauggccggcccccugguggccggcgggcuccugaucgcgugcuacgugaucaccggcacguccgccgaccugaccgucgagaaggccgccgacgugaccugggaggaggaggccgagcagaccggggugagccacaaccucaugaucacggucgacgacgacggcaccaugcggaucaaggacgacgagaccgagaacauccugaccgugcugcucaagaccgcgcugcugaucguguccgggaucuuccccuacagcaucccggccacgcuccuggucuggcacaccuggcagaagcagacccagcgcuccggcgugcugugggacgugcccuccccgcccgagacccagaaggccgagcucgaggagggcgucuaccggaucaagcagcaggggaucuucggcaagacccaggugggggugggcguccagaaggaggggguguuccacaccauguggcacgugacccgcggcgccguccugaccuacaacggcaagcggcuggagccgaacugggcgaacgugaagaaggaccucaucuccuacgggggcggguggaagcugagcgcccaguggcagaagggcgaggaggugcaggucaucgccguggagcccgggaagaaccccaagaacuuccagacgaugcccggcaucuuccagaccaccaccggcgagaucggggccaucgcccuggacuucaagccgggcacguccgggagccccaucaucaaccgcgagggcaagguggucggccuguacgggaacggcguggugaccaagaacgggggcuacgucagcgggaucgcgcagaccaacgccgagcccgacggcccgacccccgagcucgaggaggagauguucaagaagcggaaccugacgaucauggaccugcaccccggcuccgggaagacccgcaaguaccuccccgccaucgugcgggaggccaucaagcgccggcugcgcacccugauccucgccccgacccggguggucgcggccgagauggaggaggcccugaagggccugcccauccgcuaccagacgaccgccaccaagagcgagcacaccgggcgggagaucguggaccucaugugccacgccacguucaccaugcgccugcugucccccgugcggguccccaacuacaaccucaucgugauggacgaggcgcacuucaccgacccggccagcaucgccgcccgcggcuacaucuccacccggguggggaugggcgaggcggccgccaucuucaugacggccacgccgcccggcaccgccgacgcguucccccagagcaacgccccgauccaggacgaggagcgcgacauccccgagcgguccuggaacagcgggaacgaguggaucaccgacuucgccggcaagacggucugguucgugcccuccaucaaggccgggaacgacaucgccaacugccugcgcaagaacggcaagaaggugauccagcugagccgcaagaccuucgacaccgaguaccagaagaccaagcucaacgacugggacuucgucgugacgaccgacaucuccgagaugggggcgaacuucaaggccgaccgggugaucgacccccgccggugccugaagccggucauccugaccgacggccccgagcgcgugauccucgccggccccaugcccgugaccgucgccagcgccgcgcagcggcgcgggcgggugggccgcaacucccagaaggagaacgaccaguacaucuucacggggcagccgcugaacaacgacgaggaccacgcccacuggaccgaggccaagaugcugcucgacaacaucaacacccccgagggcaucauccccgcccuguucgagcccgagcgggagaaguccgcggccaucgacggggaguaccgccugaagggcgagucccggaagaccuucguggagcucaugcgccggggcgaccugccggucuggcuggcccacaagguggccagcgaggggaucaaguacaccgaccgcaaguggugcuucgacggcgagcggaacaaccagauccucgaggagaacauggacguggagaucuggacgaaggagggggagaagaagaagcugcgcccccgguggcuggacgcccgcaccuacuccgacccccucgcgcugaaggaguucaaggacuucgccgccggccgcaagagcaucgcccuggaccucgucaccgagaucggccgcgugcccucccaccuggcccaccgcacccggaacgcgcuggacaaccucgucaugcugcacacgagcgagcacgggggccgcgccuaccggcacgccguggaggagcugccggagaccauggagacccuccugcugcucgggcugaugauccugcucaccggcggggccaugcuguuccugaucagcggcaagggcaucgggaagacguccaucggccucaucugcguggucgccagcuccgggaugcuguggauggcggacgugccccugcaguggaucgccagcgccaucgugcucgaguucuucaugaugguccugcugauccccgagccggagaagcagcgcacgccccaggacaaccagcucgccuacguggugaucggcauccugacccuggccgcgaucgucgccgccaacgagauggggcuccuggagaccacgaagcgggaccugggcauguccaaggagcccggcguggugagccccaccuccuaccucgacgucgaccugcacccggccagcgcguggacccuguacgccguggccaccacggugaucacccccaugcuccgccacaccaucgagaacuccaccgccaacgucagccuggccgcgaucgccaaccaggccguggugcugauggggcucgacaagggcuggcccaucuccaagauggaccugggggucccccugcucgcccugggcugcuacagccaggugaacccgcugacgcucaccgccgcggugcugcugcucgucacccacuacgccaucaucgggcccggccugcaggccaaggccacccgggaggcccagaagcgcacggcggccggcaucaugaagaaccccaccguggacgggaucaugaccaucgaccuggaccccgugaucuacgacuccaaguucgagaagcagcucggccaggucaugcugcuggugcucugcgccgugcagcugcugcucaugcggaccagcugggccuucugcgaggcgcugacgcuggccaccgggccgaucaccacccucugggagggcucccccggcaaguucuggaacacgaccaucgccgucagcauggccaacaucuuccgcggguccuaccuggccggcgcggggcuggccuucagcaucaugaaguccgugggcaccgggaagcggggcaccggcagccagggggagacgcucggcgagaaguggaagaagaagcugaaccagcugagccgcaaggaguucgaccucuacaagaaguccgggaucaccgagguggaccggaccgaggccaaggagggccugaagcgcggggagaucacccaccacgccgucagccggggcuccgccaagcugcagugguucguggagcgcaacauggugauccccgagggccgggucaucgaccucgggugcggccgcgggggcuggagcuacuacugcgcggggcugaagaaggugaccgaggugcggggcuacacgaagggcgggcccggccacgaggagccgguccccauguccaccuacggguggaacaucgugaagcugaugagcggcaaggacguguucuaccugccgcccgagaagugcgacacccugcugugcgacaucggggaguccagcccgucccccaccgucgaggagagccgcacgauccgggugcugaagaugguggagcccuggcucaagaacaaccaguucugcaucaagguccugaaccccuacaugccgaccgugaucgagcaccuggagcgccuccagcgcaagcacggcggcaugcuggugcggaacccccugucccgcaacagcacccacgagauguacuggaucuccaacgggaccggcaacaucgucagcuccgugaacauggugagccggcuccugcugaaccgcuucacgaugacccaccggcgccccaccaucgagaaggacgucgaccucggggccggcacccggcacgugaacgccgagcccgagacgccgaacauggacgugaucggcgagcgcauccggcgcaucaaggaggagcacuccagcaccuggcacuacgacgacgagaaccccuacaagaccugggccuaccacggguccuacgaggucaaggccaccggcagcgcgagcuccaugaucaacgggguggucaagcugcugacgaagcccugggacguggugccgauggucacccagauggccaugaccgacaccacgcccuucggccagcagcggguguucaaggagaagguggacacccgcacgccccggcccaugccggggacccgcaaggucauggagaucacggccgaguggcucuggcggacccugggccgcaacaagcggccccgccugugcacccgggaggaguucaucaagaaggugcgcaccaacgccgcgaugggcgccguguucacggaggagaaccagugggacagcgcccgcgccgccgucgaggacgaggaguucuggaagcucguggaccgggagcgcgagcugcacaagcuggggaagugcggcuccugcguguacaacaugauggggaagcgggagaagaagcucggcgaguucgggaaggcgaagggcagccgcgccaucugguacauguggcugggcgcccgguaccuggaguucgaggcccucggguuccugaacgaggaccacugguucucccgcgagaacagccacuccggcgucgagggggagggccugcacaagcucggguacauccugcgggacaucagcaagauccccggcggcgccauguacgcggacgacaccgccgggugggacacccgcaucaccgaggacgaccugcacaacgaggagaagaucacgcagcagauggaccccgagcaccggcagcucgccaacgccaucuucaagcugaccuaccagaacaagguggugaagguccagcgcccgacccccaagggcaccgugauggacaucaucucccggaaggaccagcgcgggagcggccaggugggcacguacgggcugaacaccuucaccaacauggaggcccagcucauccggcagauggagggcgaggggguccuguccaaggcggaccuggagaacccccaccuccuggagaagaaggugacccaguggcuggagaccaagggcguggagcgccucaagcggauggccaucagcggggacgacugcgucgugaagcccaucgacgaccgcuucgccaacgcccugcuggcccucaacgacaugggcaaggugcggaaggacaucccgcaguggcagcccuccaagggcuggcacgacuggcagcagguccccuucugcagccaccacuuccacgagcugaucaugaaggacgggcgcaagcugguggugcccugccggccgcaggacgagcucaucggccgcgcgcggaucucccagggggccggcuggagccugcgcgagacggccugccuggggaaggccuacgcgcagaugugggcccucauguacuuccaccgccgggaccugcgccuggccuccaacgccaucugcagcgccguccccgugcacugggugcccaccucccggaccaccuggagcauccacgcgcaccaccaguggaugacgaccgaggacaugcucaccgucuggaaccgcguguggaucgaggacaaccccuggauggaggacaagaccccggugacgaccugggaggacguccccuaccugggcaagcgggaggaccaguggugcggcagccugaucgggcucaccucccgcgccaccugggcccagaacauccugacggccauccagcagguccggagccugaucggcaacgaggaguuccucgacuacaugcccuccaugaagcgcuuccggaaggaggaggagagcgagggggccaucugguga

SEQ ID NO: 10361 - RNA, 9873 nt, Artificial Sequence
  derived and/or modified CDS sequence (opt1) from DENV-3__JQ920486__SS-prME
accagccucugccucaugaugaugcugcccgccacccuggccuuccaccucaccagccgggacggcgagccccggaugaucguggggaagaacgagcggggcaagagccugcuguucaagaccgccagcgggaucaacaugugcacccucaucgccauggaccugggcgagaugugcgacgacaccgugaccuacaagugcccccugaucaccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgcggagggcgccuggcgccagguggagaaggucgagaccugggccuuccgccaccccggguucaccauccucgcccuguuccuggcgcacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacgugaccacggacagccgcugccccacccagggcgaggcgauccugcccgaggagcaggaccagaacuacgucugcaagcacaccuacguggaccggggguggggcaacgggugcggccucuucgggaagggcucccuggugaccugcgccaaguuccagugccuggagagcaucgagggcaaggccguccagcacgagaaccucaaguacacggugaucaucaccgugcacaccggggaccagcaccaggucggcaacgagacccagggggugacggccgagaucacgccccaggccuccaccgucgaggcgauccugcccgaguacggcacccuggggcucgagugcagcccccgcaccggccuggacuucaacgagaugauccugcucacgaugaagaacaaggccuggauggugcaccggcagugguucuucgaccugccgcugcccuggaccuccggcgccaccaccgagacgcccaccuggaacaagaaggagcuccuggugaccuucaagaacgcccacgccaagaagcaggaggucguggugcuggggagccaggagggcgcgaugcacaccgcccucacgggggccaccgagauccagaccuccggcgggaccagcaucuucgccggccaccugaagugccgccugaagauggacaagcucgagcugaagggcauguccuacgccaugugccugaacgcguucguccucaagaaggaggugagcgagacgcagcacgggaccauccugaucaagguggaguacaagggcgaggacgcccccugcaagauccccuucagcaccgaggacgggcagggcaaggcccacaacggccggcugaucaccgccaaccccaucgucacgaagaaggaggagcccgugaacaucgaggcggagccgcccuucggggaguccaacaucgugaucggcaucggggacaaggcccugaagaucaacugguacaagaagggcagcuccaucgggaagauguucgaggccaccgcccgcggcgcccggcgcauggcgauccucggcgacaccgccugggacuucgggagcgucggcggggugcugaacucccugggcaagauggugcaccagaucuucgggagcgccuacaccgcccucuucuccggcgucagcuggaucaugaagaucggcaucggggugcugcugacguggaucggccucaacuccaagaacaccagcauguccuucagcugcaucgugaucgggaucaucacccuguaccugggcgccgucgugcaggcggacauggggugcgugaucaacuggaagggcaaggagcucaagugcggcuccgggaucuucgucaccaacgaggugcacacguggaccgagcaguacaaguuccaggccgacagccccaagcggcuggccaccgccaucgccggcgcgugggagaacggggugugcggcauccgcuccaccacgcgcauggagaaccugcucuggaagcagaucgccaacgagcugaacuacauccugugggagaacaacaucaagcucaccaucgucgugggggacgccaucggcgugcuggagcagggcaagcggacccugacgccccagcccauggagcucaaguacagcuggaagacgugggggaaggccaagaucgucaccgcggagacccagaacuccagcuucaucaucgacggccccaacacccccgagugccccuccgccagccgcgccuggaacgugugggagguggaggacuacggguucggcgucuucacgaccaacaucuggcugaagcugcgggagaaguacacccagcucugcgaccaccgccugaugagcgccgccgugaaggacgagcgggcggugcacgucgacaugggcuacuggaucgagucccagaagaacgggagcuggaagcuggagaaggccucccucaucgaggugaagaccugcaccuggcccaagagccacacgcugugguccaacggcgugcuggagagcgacaugaucaucccgaagucccucgccgggcccaucagccagcacaacuaccgccccggcuaccacacccagaccgccgggccguggcaccugggcaagcuggagcucgacuucaacuacugcgagggcaccacggucgugaucaccgagaacugcgggauccggggccccucccugcgcaccaccacggugagcgggaagcugauccacgaguggugcugccgguccugcacccugccgccccuccgcuacaugggcgaggacgggugcugguacggcauggagauccggccgaucaacgagaaggaggagaacauggucaagagccugguguccgccggcagcgggaagaccgacaacuucaccaugggcgugcucugccuggcgauccuguucgaggaggucaugcgcgggaaguucggcaagaagcacaugaucgccggggcccucuucacguucgugcugcugcucuccggccagaucaccuggcgggacauggcccacacccugaucaugaucggcagcaacgccuccgaccgcauggggaugggcgugaccuaccuggcgcucaucgccacguucaagauccagcccuuccuggcccugggguucuuccuccggaagcugaccagccgcgagaaccugcuccugggcgucggccuggccauggcgaccacccuccagcugcccgaggacaucgagcagauggccaacgggaucgcccugggccucauggcccugaagcugaucacgcaguucgagaccuaccagcucuggaccgcccugaucagccugaugugcuccaacaccaucuucacgcucaccguggcguggcggaccgccacccugauccuggccgugaucagccuccugcccgucugccaguccagcuccaugcgcaagacggacuggcugccgaugaccguggccgccaugggggugccgccccucccccuguucaucuucagccugaaggacacccucaagcggcgcuccuggccgcugaacgagggcgucauggcgguggggcuggucagcauccucgccuccagcuuccugcgcaacgacgugcccauggccggcccccugguggccggcgggcuccugaucgccugcuacgucaucaccggcacguccgcggaccugaccguggagaaggccgccgacgugaccugggaggaggaggccgagcagaccggggucagccacaaccucaugaucacgguggacgacgacggcaccaugcggaucaaggacgacgagaccgagaacauccugaccgugcugcucaagaccgcccugcugaucgucuccgggaucuuccccuacagcaucccggcgacgcuccugguguggcacaccuggcagaagcagacccagcgcuccggcgugcugugggacguccccuccccgcccgagacccagaaggccgagcucgaggagggcguguaccggaucaagcagcaggggaucuucggcaagacccaggugggggucggcgugcagaaggaggggguguuccacaccauguggcacgucacccgcggcgccgugcugacccacaacggcaagcggcuggagccgaacugggccaacgugaagaaggaccucaucuccuacgggggcggguggaagcugagcgcgcaguggcagaagggcgaggagguccaggugaucgccguggagcccgggaagaaccccaagaacuuccagacgaugcccggcaucuuccagaccaccaccggcgagaucggggccaucgcccuggacuucaagccgggcacguccgggagccccaucaucaaccgcgagggcaaggucgugggccuguacgggaacggcguggucaccaagaacgggggcuacgugagcgggaucgcccagaccaacgcggagcccgacggcccgacccccgagcucgaggaggagauguucaagaagcggaaccugacgaucauggaccugcaccccggcuccgggaagacccgcaaguaccuccccgccaucgugcgggaggccaucaagcgccggcugcgcacccugauccucgccccgacccgggucguggccgcggagauggaggaggcccugaagggccugcccauccgcuaccagacgaccgccaccaagagcgagcacaccgggcgggagaucguggaccucaugugccacgccacguucaccaugcgccugcugucccccguccgggugcccaacuacaaccucaucgugauggacgaggcccacuucaccgacccggcgagcaucgccgcccgcggcuacaucuccacccgggucgggaugggcgaggccgcggccaucuucaugacggccacgccgcccggcaccgccgacgccuucccccagagcaacgcgccgauccaggacgaggagcgcgacauccccgagcgguccuggaacagcgggaacgaguggaucaccgacuucgccggcaagacggugugguucgugcccuccaucaaggccgggaacgacaucgccaacugccugcgcaagaacggcaagaaggucauccagcugagccgcaagaccuucgacaccgaguaccagaagaccaagcucaacgacugggacuucguggugacgaccgacaucuccgagaugggggccaacuucaaggcggaccgggucaucgacccccgccggugccugaagccggugauccugaccgacggccccgagcgcgugauccucgccggccccaugcccgucaccguggccagcgccgcccagcggcgcgggcgggugggccgcaacucccagaaggagaacgaccaguacaucuucacggggcagccgcugaacaacgacgaggaccacgcgcacuggaccgaggccaagaugcugcucgacaacaucaacacccccgagggcaucauccccgcccuguucgagcccgagcgggagaaguccgccgcgaucgacggggaguaccgccugaagggcgagucccggaagaccuucgucgagcucaugcgccggggcgaccugccgguguggcuggcccacaagguggccagcgaggggaucaaguacaccgaccgcaaguggugcuucgacggcgagcggaacaaccagauccucgaggagaacauggacgucgagaucuggacgaaggagggggagaagaagaagcugcgcccccgguggcuggacgcccgcaccuacuccgacccccucgcccugaaggaguucaaggacuucgcggccggccgcaagagcaucgcccuggaccucgugaccgagaucggccgcguccccucccaccuggcccaccgcacccggaacgcccuggacaaccucgugaugcugcacacgagcgagcacgggggccgcgcguaccggcacgccguggaggagcugccggagaccauggagacccuccugcugcucgggcugaugauccugcucaccggcggggccaugcuguuccugaucagcggcaagggcaucgggaagacguccaucggccucaucugcgucguggccagcuccgggaugcuguggauggccgacgugccccugcaguggaucgcgagcgccaucguccucgaguucuucaugauggugcugcugauccccgagccggagaagcagcgcacgccccaggacaaccagcucgccuacguggucaucggcauccugacccuggccgccaucguggcggccaacgagauggggcuccuggagaccacgaagcgggaccugggcauguccaaggagcccggcguggucagccccaccuccuaccucgacguggaccugcacccggccagcgccuggacccuguacgcgguggccaccacggucaucacccccaugcuccgccacaccaucgagaacuccaccgccaacgugagccuggccgccaucgcgaaccaggccgugguccugauggggcucgacaagggcuggcccaucuccaagauggaccugggggugccccugcucgcccugggcugcuacagccaggugaacccgcugacgcucaccgccgccguccugcugcucgugacccacuacgcgaucaucgggcccggccugcaggccaaggccacccgggaggcccagaagcgcacggccgcgggcaucaugaagaaccccaccguggacgggaucaugaccaucgaccuggaccccgucaucuacgacuccaaguucgagaagcagcucggccaggugaugcugcuggugcucugcgccguccagcugcugcucaugcggaccagcugggccuucugcgaggcccugacgcuggcgaccgggccgaucaccacccucugggagggcucccccggcaaguucuggaacacgaccaucgccgugagcauggccaacaucuuccgcggguccuaccuggccggcgccgggcuggcguucagcaucaugaaguccgugggcaccgggaagcggggcaccggcagccagggggagacgcucggcgagaaguggaagaagaagcugaaccagcugagccgcaaggaguucgaccucuacaagaaguccgggaucaccgaggucgaccggaucgaggccaaggagggccugaagcgcggggagaucacccaccacgccgugagccggggcuccgccaagcugcagugguucguggagcgcaacauggucauccccgagggccgggugaucgaccucgggugcggccgcgggggcuggagcuacuacugcgccgggcugaagaaggugaccgagguccggggcuacaccaagggcgggcccggccacgaggagccggugcccauguccacguacggguggaacaucgugaagcugaugagcggcaaggacgucuucuaccugccgcccgagaagugcgacacccugcugugcgacaucggggaguccagcccgucccccaccguggaggagagccgcaccauccgggugcugaagauggucgagcccuggcucaagaacaaccaguucugcaucaaggugcugaaccccuacaugccgacggugaucgagcaccuggagcgccuccagcgcaagcacggcggcaugcugguccggaacccccugucccgcaacagcacccacgagauguacuggaucuccaacgggaccggcaacaucgugagcuccgugaacauggucagccggcuccugcugaaccgcuucaccaugacgcaccggcgccccaccaucgagaaggacguggaccucggggcgggcacccggcacgugaacgccgagcccgagaccccgaacauggacgucaucggcgagcgcauccggcgcaucaaggaggagcacuccagcacguggcacuacgacgacgagaaccccuacaagaccugggccuaccacggguccuacgaggugaaggccaccggcagcgccagcuccaugaucaacggggucgugaagcugcugaccaagcccugggacguggucccgauggugacgcagauggcgaugaccgacaccacccccuucggccagcagcggguguucaaggagaaggucgacacgcgcacgccccggcccaugccggggacccgcaaggugauggagaucaccgccgaguggcucuggcggacgcugggccgcaacaagcggccccgccugugcacccgggaggaguucaucaagaaggugcgcaccaacgccgccaugggcgcggucuucaccgaggagaaccagugggacagcgcccgcgccgccguggaggacgaggaguucuggaagcucguggaccgggagcgcgagcugcacaagcuggggaagugcggcuccugcgucuacaacaugauggggaagcgggagaagaagcucggcgaguucgggaaggccaagggcagccgcgcgaucugguacauguggcugggcgcccgguaccuggaguucgaggcccucggguuccugaacgaggaccacugguucucccgcgagaacagccacuccggcguggagggggagggccugcacaagcucggguacauccugcgggacaucagcaagauccccggcggcgccauguacgccgacgacacggcggggugggacacccgcaucaccgaggacgaccugcacaacgaggagaagaucacccagcagauggaccccgagcaccggcagcucgccaacgccaucuucaagcugacguaccagaacaagguggucaaggugcagcgcccgacccccaagggcaccgugauggacaucaucucccggaaggaccagcgcgggagcggccaggucggcaccuacgggcugaacacguucaccaacauggaggcccagcucauccggcagauggagggcgagggggugcuguccaaggccgaccuggagaacccccaccuccuggagaagaaggugacccaguggcuggagaccaagggcgucgagcgccucaagcggauggcgaucagcggggacgacugcguggugaagcccaucgacgaccgcuucgccaacgcccugcuggcccucaacgacaugggcaagguccggaaggacaucccgcaguggcagcccuccaagggcuggcacgacuggcagcagguccccuucugcagccaccacuuccacgagcugaucaugaaggacgggcgcaagcuggugguccccugccggccgcaggacgagcucaucggccgcgcccggaucucccagggggcgggcuggagccugcgcgagaccgccugccuggggaaggccuacgcccagaugugggcgcucauguacuuccaccgccgggaccugcgccuggccuccaacgccaucugcagcgccgugcccgugcacuggguccccacgucccggaccaccuggagcauccacgcccaccaccaguggaugaccacggaggacaugcucaccguguggaaccgcguguggaucgaggacaaccccuggauggaggacaagaccccggucaccacgugggaggacgugcccuaccugggcaagcgggaggaccaguggugcggcagccugaucgggcucaccucccgcgcgaccugggcccagaacauccugaccgccauccagcagguccggagccugaucggcaacgaggaguuccucgacuacaugcccuccaugaagcgcuuccggaaggaggaggagagcgagggggccaucugguga

SEQ ID NO: 10362 - RNA, 9873 nt, Artificial Sequence
  derived and/or modified CDS sequence (opt1) from DENV-3__JQ920485__SS-prME
accagccucugccucaugaugaugcugcccgccacccuggccuuccaccucaccagccgggacggcgagccccggaugaucguggggaagaacgagcggggcaagagccugcuguucaagaccgccagcgggaucaacaugugcacccucaucgccauggaccugggcgagaugugcgacgacaccgugacguacaagugcccccugaucaccgagguggagcccgaggacaucgacugcuggugcaaccucaccagcaccugggugacguacgggaccugcaaccaggccggcgagcaccggcgcgacaagcgguccguggcccuggcgccccacgugggcauggggcuggacacccgcacccagacguggaugagcgcggagggcgccuggcgccagguggagaaggucgagaccugggccuuccgccaccccggguucaccauccucgcccuguuccuggcgcacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacaucaccacggacagccgcugccccacccagggcgaggcgauccugcccgaggagcaggaccagaacuacgugugcaagcacaccuacgucgaccggggguggggcaacgggugcggccucuucgggaagggcucccuggugaccugcgccaaguuccagugccuggagagcaucgagggcaaggccgugcagcacgagaaccucaaguacacggucaucaucaccgugcacaccggggaccagcaccaggugggcaacgagacccagggggucacggccgagaucacgccccaggccuccaccguggaggcgauccugcccgaguacggcacccuggggcucgagugcagcccccgcaccggccuggacuucaacgagaugauccugcucacgaugaagaacaaggccuggaugguccaccggcagugguucuucgaccugccgcugcccuggaccuccggcgccaccaccgagacgcccaccuggaacaagaaggagcuccuggugaccuucaagaacgcccacgccaagaagcaggagguggucgugcuggggagccaggagggcgcgaugcacaccgcccucacgggggccaccgagauccagaccuccggcgggaccagcaucuucgccggccaccugaagugccgccugaagauggacaagcucgagcugaagggcauguccuacgccaugugccugaacgcguucgugcucaagaaggaggucagcgagacgcagcacgggaccauccugaucaagguggaguacaagggcgaggacgcccccugcaagauccccuucagcaccgaggacgggcagggcaaggcccacaacggccggcugaucaccgccaaccccaucgugacgaagaaggaggagcccgucaacaucgaggcggagccgcccuucggggaguccaacaucgugaucggcaucggggacaaggcccugaagaucaacugguacaagaagggcagcuccaucgggaagauguucgaggccaccgcccgcggcgcccggcgcauggcgauccucggcgacaccgccugggacuucgggagcgugggcgggguccugaacucccugggcaagauggugcaccagaucuucgggagcgccuacaccgcccucuucuccggcgugagcuggaucaugaagaucggcaucgggguccugcugacguggaucggccucaacuccaagaacaccagcauguccuucagcugcaucgugaucgggaucaucacccuguaccugggcgccgugguccaggcggacauggggugcgugaucaacuggaagggcaaggagcucaagugcggcuccgggaucuucgugaccaacgagguccacacguggaccgagcaguacaaguuccaggccgacagccccaagcggcuggccaccgccaucgccggcgcgugggagaacggggugugcggcauccgcuccaccacgcgcauggagaaccugcucuggaagcagaucgccaacgagcugaacuacauccugugggagaacaacaucaagcucaccaucguggucggggacgugaucggcgugcuggagcagggcaagcggacccugacgccccagcccauggagcucaaguacagcuggaagacgugggggaaggccaagaucgucaccgccgagacccagaacuccagcuucaucaucgacggccccaacacccccgagugccccuccgcgagccgcgccuggaacgugugggagguggaggacuacggguucggcgucuucacgaccaacaucuggcugaagcugcgggagaagcacacccagcucugcgaccaccgccugaugagcgccgccgugaaggacgagcgggccgugcacgcggacaugggcuacuggaucgagucccagaagaacgggagcuggaagcuggagaaggccucccucaucgaggucaagaccugcaccuggcccaagagccacacgcugugguccaacggcgugcuggagagcgacaugaucaucccgaagucccucgccgggcccaucagccagcacaacuaccgccccggcuaccacacccagaccgccgggccguggcaccugggcaagcuggagcucgacuucaacuacugcgagggcaccacgguggucaucaccgagaacugcgggauccggggccccucccugcgcaccaccacggugagcgggaagcugauccacgaguggugcugccgguccugcacccugccgccccuccgcuacaugggcgaggacgggugcugguacggcauggagauccggccgaucaacgagaaggaggagaacauggucaagagccuggucuccgccggcagcgggaagaccgacaacuucaccaugggcgugcucugccuggcgauccuguucgaggaggugaugcgcgggaaguucggcaagaagcacaugaucgccggggcccucuucacguucguccugcugcucuccggccagaucaccuggcgggacauggcccacacccugaucaugaucggcagcaacgccuccgaccgcauggggaugggcgugaccuaccuggcgcucaucgccacguucaagauccagcccuuccuggcccugggguucuuccuccggaagcugaccagccgcgagaaccugcuccugggcgugggccuggccauggcgaccacccuccagcugcccgaggacaucgagcagauggccaacgggaucgcccugggccucauggcccugaagcugaucacgcaguucgagaccuaccagcucuggaccgcccugaucagccugaugugcuccaacaccaucuucacgcucaccgucgcguggcggaccgccacccugauccuggccgugaucagccuccugcccgugugccaguccagcuccaugcgcaagacggacuggcugccgaugaccgucgccgccaugggggugccgccccucccccuguucaucuucagccugaaggacacccucaagcggcgcuccuggccgcugaacgagggcgugauggcggucgggcuggugagcauccucgccuccagcuuccugcgcaacgacguccccauggccggcccccugguggccggcgggcuccugaucgccugcuacgugaucaccggcacguccgcggaccugaccgucgagaaggccgccgacgugaccugggaggaggaggccgagcagaccggggugagccacaaccucaugaucacggucgacgacgacggcaccaugcggaucaaggacgacgagaccgagaacauccugaccgugcugcucaagaccgcccugcugaucguguccgggaucuuccccuacagcaucccggcgacgcuccuggucuggcacaccuggcagaagcagacccagcgcuccggcgugcugugggacgugcccuccccgcccgagacccagaaggccgagcucgaggagggcgucuaccggaucaagcagcaggggaucuucggcaagacccaggugggggugggcguccagaaggaggggguguuccacaccauguggcacgugacccgcggcgccguccugacccacaacggcaagcggcuggagccgaacugggccaacgugaagaaggaccucaucuccuacgggggcggguggaagcugagcgcgcaguggcagaagggcgaggaggugcaggucaucgccguggagcccgggaagaaccccaagaacuuccagacgaugcccggcaucuuccagaccaccaccggcgagaucggggccaucgcccuggacuucaagccgggcacguccgggagccccaucaucaaccgcgagggcaagguggucggccuguacgggaacggcguggugaccaagaacgggggcuacgucagcgggaucgcccagaccaacgcggagcccgacggcccgauccccgagcucgaggaggagauguucaagaagcggaaccugaccaucauggaccugcaccccggcuccgggaagacgcgcaaguaccuccccgccaucgugcgggaggccaucaagcgccggcugcgcacccugauccucgccccgacccggguggucgccgcggagauggaggaggcccugaagggccugcccauccgcuaccagaccacggccaccaagagcgagcacaccgggcgggagaucguggaccucaugugccacgccaccuucacgaugcgccugcugucccccgugcggguccccaacuacaaccucaucgugauggacgaggcccacuucaccgacccggcgagcaucgccgcccgcggcuacaucuccacccggguggggaugggcgaggccgcggccaucuucaugaccgccacgccgcccggcaccgccgacgccuucccccagagcaacgcgccgauccaggacgaggagcgcgacauccccgagcgguccuggaacagcgggaacgaguggaucaccgacuucgccggcaagaccgucugguucgugcccuccaucaaggccgggaacgacaucgccaacugccugcgcaagaacggcaagaaggugauccagcugagccgcaagacguucgacaccgaguaccagaagaccaagcucaacgacugggacuucgucgugaccacggacaucuccgagaugggggccaacuucaaggcggaccgggugaucgacccccgccggugccugaagccggucauccugaccgacggccccgagcgcgugauccucgccggccccaugcccgugaccgucgccagcgccgcccagcggcgcgggcgggugggccgcaacucccagaaggagaacgaccaguacaucuucaccgggcagccgcugaacaacgacgaggaccacgcgcacuggacggaggccaagaugcugcucgacaacaucaacacccccgagggcaucauccccgcccuguucgagcccgagcgggagaaguccgccgcgaucgacggggaguaccgccugaagggcgagucccggaagaccuucguggagcucaugcgccggggcgaccugccggucuggcuggcccacaagguggccagcgaggggaucaaguacaccgaccgcaaguggugcuucgacggcgagcggaacaaccagauccucgaggagaacauggacguggagaucuggaccaaggagggggagaagaagaagcugcgcccccgguggcuggacgcccgcacguacuccgacccccucgcccugaaggaguucaaggacuucgcggccggccgcaagagcaucgcccuggaccucgucaccgagaucggccgcgugcccucccaccuggcccaccgcacccggaacgcccuggacaaccucgucaugcugcacaccagcgagcacgggggccgcgcguaccggcacgccguggaggagcugccggagacgauggagacccuccugcugcucgggcugaugauccugcucaccggcggggccaugcuguuccugaucagcggcaagggcaucgggaagaccuccaucggccucaucugcguggucgccagcuccgggaugcuguggauggccgacgugccccugcaguggaucgcgagcgccaucgugcucgaguucuucaugaugguccugcugauccccgagccggagaagcagcgcacgccccaggacaaccagcucgccuacguggugaucggcauccugacccuggccgccaucgucgcggccaacgagauggggcuccuggagaccaccaagcgggaccugggcauguccaaggagcccggcguggugagccccacguccuaccucgacgucgaccugcacccggccagcgccuggacccuguacgcgguggccaccaccgugaucacgcccaugcuccgccacaccaucgagaacuccaccgccaacgucagccuggccgccaucgcgaaccaggccguggugcugauggggcucgacaagggcuggcccaucuccaagauggaccugggggucccccugcucgcccugggcugcuacagccaggugaacccgcugacccucacggccgccgugcugcugcucgucacccacuacgcgaucaucgggcccggccugcaggccaaggccacccgggaggcccagaagcgcaccgccgcgggcaucaugaagaaccccacgguggacgggaucaugaccaucgaccuggaccccgugaucuacgacuccaaguucgagaagcagcucggccaggucaugcugcuggugcucugcgccgugcagcugcugcucaugcggaccagcugggccuucugcgaggcccugacccuggcgacggggccgaucaccacccucugggagggcucccccggcaaguucuggaacaccacgaucgccgucagcauggccaacaucuuccgcggguccuaccuggccggcgccgggcuggcguucagcaucaugaaguccgugggcaccgggaagcggggcaccggcagccagggggagacccucggcgagaaguggaagaagaagcugaaccagcugagccgcaaggaguucgaccucuacaagaaguccgggaucacggagguggaccggaucgaggccaaggagggccugaagcgcggggagaucacccaccacgccgucagccggggcuccgccaagcugcagugguucguggagcgcaacauggugauccccgagggccgggucaucgaccucgggugcggccgcgggggcuggagcuacuacugcgccgggcugaagaaggugaccgaggugcggggcuacaccaagggcgggcccggccacgaggagccgguccccauguccaccuacggguggaacaucgugaagcugaugagcggcaaggacguguucuaccugccgcccgagaagugcgacacgcugcugugcgacaucggggaguccagcccgucccccaccgucgaggagagccgcaccauccgggugcugaagaugguggagcccuggcucaagaacaaccaguucugcaucaagguccugaaccccuacaugccgaccgugaucgagcaccuggagcgccuccagcgcaagcacggcggcaugcuggugcggaacccccugucccgcaacagcacgcacgagauguacuggaucuccaacgggaccggcaacaucgucagcuccgugaacauggugagccggcuccugcugaaccgcuucaccaugacccaccggcgccccacgaucgagaaggacgucgaccucggggcgggcacccggcacgugaacgccgagcccgagaccccgaacaugaacgugaucggcgagcgcauccggcgcaucaaggaggagcacuccagcaccuggcacuacgacgacgagaaccccuacaagacgugggccuaccacggguccuacgaggucaaggccaccggcagcgccagcuccaugaucaacgggguggucaagcugcugaccaagcccugggacguggugccgauggucacccagauggcgaugacggacaccacccccuucggccagcagcggguguucaaggagaagguggacacccgcacgccccggcccaugccggggacccgcaaggucauggagaucaccgccgaguggcucuggcggacccugggccgcaacaagcggccccgccugugcacgcgggaggaguucaucaagaaggugcgcaccaacgccgccaugggcgcgguguucaccgaggagaaccagugggacagcgcccgcgccgccgucgaggacgaggaguucuggaagcucguggaccgggagcgcgagcugcacaagcuggggaagugcggcuccugcguguacaacaugauggggaagcgggagaagaagcucggcgaguucgggaaggccaagggcagccgcgcgaucugguacauguggcugggcgcccgguaccuggaguucgaggcccucggguuccugaacgaggaccacugguucucccgcgagaacagccacuccggcgucgagggggagggccugcacaagcucggguacauccugcgggacaucagcaagauccccggcggcgccauguacgccgacgacaccgcggggugggacacgcgcaucaccgaggacgaccugcacaacgaggagaagaucacccagcagauggaccccgagcaccggcagcucgccaacgccaucuucaagcugaccuaccagaacaagguggugaagguccagcgcccgacgcccaagggcaccgugauggacaucaucucccggaaggaccagcgcgggagcggccaggugggcaccuacgggcugaacaccuucacgaacauggaggcccagcucauccggcagauggagggcgaggggguccuguccaaggccgaccuggagaacccccaccuccuggagaagaaggugacccaguggcuggagaccaagggcguggagcgccucaagcggauggcgaucagcggggacgacugcgucgugaagcccaucgacgaccgcuucgccaacgcccugcuggcccucaacgacaugggcaaggugcggaaggacaucccgcaguggcagcccuccaagggcuggcacgacuggcagcagguccccuucugcagccaccacuuccacgagcugaucaugaaggacgggcgcaagcugguggugcccugccggccgcaggacgagcucaucggccgcgcccggaucucccagggggcgggcuggagccugcgcgagaccgccugccuggggaaggccuacgcccagaugugggcgcucauguacuuccaccgccgggaccugcgccuggccuccaacgccaucugcagcgccguccccgugcacugggugcccaccucccggacgaccuggagcauccacgcccaccaccaguggaugaccaccgaggacaugcucacggucuggaaccgcguguggaucgaggacaaccccuggauggaggacaagaccccggugaccaccugggaggacguccccuaccugggcaagcgggaggaccaguggugcggcagccugaucgggcucacgucccgcgcgaccugggcccagaacauccugaccgccauccagcagguccggagccugaucggcaacgaggaguuccucgacuacaugcccuccaugaagcgcuuccggaaggaggaggagcccgagggggccaucugguga

SEQ ID NO: 10363 - RNA, 9873 nt, Artificial Sequence
  derived and/or modified CDS sequence (opt1) from DENV-3__FJ644564__SS-prME
accagccugugccucaugaugauccugcccgccgcccuggcguuccaccucaccagccgcgacggcgagccccggaugaucguggggaagaacgagcgcggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcggcaggucgagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgccaucgccggcgcgugggagaacggggucugcggcauccgcagcacgacccggauggagaaccugcuguggaagcagaucgccaacgagcucaacuacauccugugggagaacaacaucaagcugaccgugguggucggggacaccaucggcgugcucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgcgucccgggccuggaacgucugggagguggaggacuacggguucggcguguucaccaccaacaucuggcucaagcugcgcgaggucuacacccagaugugcgaccaccggcugaugagcgccgccgugaaggacgagcgcgccgugcacgcggacaugggcuacuggaucgagagccagaagaacggguccuggaagcucgagaaggccagccugaucgaggucaagacgugcaccuggccgaagucccacacccuguggagcaacggcgugcucgaguccgacaugaucauccccaagagccuggccgggcccaucucccagcacaaccaccggccgggcuaccacacccagacggccgggcccuggcaccuggagaaccucgagcuggacuucaccuacugcgagggcaccaccguggucaucacggagaacugcggcacccgcgggcccagccugcggaccaccacgguguccggcaagcucauccacgaguggugcugccgcagcugcacccugcccccgcugcgguacaugggggaggacggcugcugguacgggauggagauccgccccaucuccgagaaggaggagaacauggucaagagccucgucuccgccggcagcggcaagguggacaacuucaccauggggauccugugccuggcgauccucuucgaggaggugaugcggggcaaguucgggaagaagcacaugaucgccggcgucuucuucaccuucgugcugcugcucuccgggcagaucacguggcgcgacauggcccacacccugaucaugaucggcagcaacgccuccgaccggaugggcaugggggugaccuaccuggcccucaucgcgaccuucaagauccagcccuuccuggcccugggcuucuuccuccgcaagcugacgagccgggagaaccugcuccugggggucggccuggccauggccaccacccuccagcugcccgaggacaucgagcagauggcgaacggcaucgcccuggggcucauggcccugaagcugaucacccaguucgagacguaccagcucuggaccgcccugaucagccugaccugcuccaacaccaucuucacgcucaccguggccuggcgcaccgcgacccugauccuggccggcgugagccuccugccggucugccaguccagcuccaugcggaagacggacuggcugcccaugaccguggccgccaugggggugccgccccucccgcuguucaucuucagccugaaggacacccucaagcgccgcuccuggccccugaacgagggcgugauggccguggggcuggucagcauccucgcguccagccugcugcggaacgacgugcccauggccggcccccucguggccggcgggcugcugaucgccugcuacgucaucaccggcacguccgccgaccucaccguggagaaggcggccgacgugaccugggaggaggaggccgagcagaccggggucagccacaaccugaugaucaccguggacgacgacggcacgaugcgcaucaaggacgacgagaccgagaacauccugaccgugcuccugaagaccgcccugcucaucgucuccgggaucuucccguacagcauccccgccacgcugcugguguggcacaccuggcagaagcagacccagcgguccggcgugcucugggacguccccagcccgcccgagacccagaaggcggagcuggaggagggcguguaccgcaucaagcagcaggggauccugggcaagacccaggugggggucggcgugcagaaggaggggguguuccacaccauguggcacgucacccggggcgccgugcucacccacaacggcaagcgccuggagcccaacugggccuccgugaagaaggaccugaucagcuacgggggcggguggcggcucuccgcccaguggcagaagggcgaggagguccaggugaucgcgguggagcccgggaagaaccccaagaacuuccagacgaugcccggcaccuuccagaccaccacgggcgagaucggggccaucgcccuggacuucaagcccggcaccagcgggagccccaucaucaaccgcgagggcaaggucgugggccuguacgggaacggcguggucaccaagaacgggggcuacguguccgggaucgcccagaccaacgccgagccggacggccccacgcccgagcuggaggaggagauguucaagaagcggaaccucaccaucauggaccugcaccccggcagcgggaagacccgcaaguaccugccggcgaucgugcgggaggccaucaagcgccggcuccgcacccugauccuggcccccacgcgggucguggccgccgagauggaggaggcgcucaagggccugcccauccgcuaccagaccaccgccaccaaguccgagcacacggggcgggagaucguggaccugaugugccacgccaccuucaccaugcgccuccugagccccguccgggugccgaacuacaaccugaucaucauggacgaggcccacuucaccgaccccgccuccaucgcggcccgcggcuacaucagcacgcggguggggaugggcgaggccgccgcgaucuucauguccgccacgccgcccggcaccgccgacgccuucccgcagagcaacgcccccauccaggacgaggagcgcgacauccccgagcgcuccuggaacagcgggaacgaguggaucaccgacuucgcgggcaagacggucugguucgugcccuccaucaaggccgggaacgacaucgccaacugccuccggaagaacggcaagaaggugauccagcugagccgcaagaccuucgacaccgaguaccagaagaccaagcugaacgacugggacuucgucgugacgaccgacaucuccgagaugggggccaacuucaaggccgaccgggugaucgacccgcgccggugccucaagcccgucauccugaccgacggccccgagcgcgugauccuggcgggccccaugccggugaccgccgccagcgccgcccagcggcgcgggcgggucggccgcaacccccagaaggagaacgaccaguacaucuucaccgggcagccccucaacaacgacgaggaccacgcgcacuggacggaggccaagaugcugcuggacaacaucaacacccccgagggcaucaucccggcccucuucgagcccgagcgggagaaguccgccgcgaucgacggggaguaccgccugaagggcgagagccggaagaccuucguggagcugaugcgccggggcgaccuccccguguggcuggcccacaaggucgccuccgaggggaucaaguacaccgaccgcaaguggugcuucgacggccagcggaacaaccagauccuggaggagaacauggacguggagaucuggacgaaggagggggagaagaagaagcuccgcccccgguggcuggacgcccgcaccuacagcgacccgcuggcccucaaggaguucaaggacuucgcggccggccgcaaguccaucgcccuggaccuggucaccgagaucggccgggugcccagccaccucgcccaccgcacccggaacgcccuggacaaccuggugaugcuccacacgagcgagcacgggggccgcgcguaccggcacgccgucgaggagcugcccgagaccauggagacccugcuccugcuggggcucaugauccugcugaccggcggggccaugcuguuccugaucuccggcaagggcaucgggaagacgagcaucggccugaucugcgugaucgccuccagcgggaugcucuggauggccgagaucccgcugcaguggaucgcguccgccaucgugcuggaguucuucaugaugguccuccugauccccgagcccgagaagcagcgcacgccccaggacaaccagcuggccuacguggugaucggcauccucacccuggccgccaucaucgcggccaacgagauggggcugcucgagaccacgaagcgggaccugggcaugagcaaggagccgggcgucgugucccccaccagcuaccuggacguggaccuccaccccgccuccgccuggacccuguacgcggucgccaccacggugaucacccccaugcugcgccacaccaucgagaacagcaccgccaacgugucccucgccgccaucgcgaaccaggccgucgugcugauggggcuggacaagggcuggccgaucagcaagauggaccucggggugccccugcuggcccucggcugcuacucccaggucaacccccugacgcugaccgccgccgugcuccugcugaucacccacuacgcgaucaucgggcccggccuccaggccaaggccacccgggaggcccagaagcgcacggccgcgggcaucaugaagaacccgaccguggacgggaucaucaccaucgaccuggaccccgucaucuacgacagcaaguucgagaagcagcugggccaggugaugcuccuggugcugugcgccguccagcuccugcugaugcggaccuccugggcccucugcgaggcccugacgcuggcgaccgggcccaucaccacccucugggagggcagccccggcaaguucuggaacacgaccaucgccguguccauggccaacaucuuccgcgggagcuaccuggccggcgccgggcuggcguucuccaucaugaaguccgugggcaccgggaagcggggcaccggcagccagggggagacccucggcgagaaguggaagaagaagcugaaccagcugucccgcaaggaguucgaccucuacaagaaguccgggaucacggaggucgaccggaccgaggccaaggagggccugaagcgcggggagaccacccaccacgccgugucccggggcagcgccaagcugcaguggcucguggagcgcaacauggucaucccggagggccgggugaucgaccuggggugcggccgcgggggcugguccuacuacugcgccgggcugaagaaggugacggagguccggggcuacaccaagggcgggcccggccacgaggagcccgugcccaugagcaccuacggguggaacaucgugaagcucauguccggcaaggacgucuucuaccugccgcccgagaagugcgacacccugcugugcgacaucggggagagcucccccagccccacgguggaggagucccgcaccauccgcgugcucaagauggucgagccguggcugaagaacaaccaguucugcaucaaggugcugaaccccuacaugcccgcggugaucgagcaccucgagcggcugcagcgcaagcacggcggcaugcugguccggaacccccucagccgcaacuccacccacgagauguacuggaucagcaacgggaccggcaacaucguguccagcgugaacauggucucccggcugcugcucaaccgcuucacgaugacccaccggcgcccgaccaucgagaaggacguggaccugggggccggcacccggcacgugaacgccgagcccgagacgcccaacauggacgucaucggcgagcgcaucaagcggaucaaggaggagcacaacagcaccuggcacuacgacgacgagaacccguacaagaccugggccuaccacggguccuacgaggugaaggccaccggcagcgcgagcuccaugaucaacgggguggucaagcugcucacgaagcccugggacgugguccccauggugacccagauggccaugaccgacaccacgcccuucggccagcagcgcguguucaaggagaaggucgacacccggaccccgcgccccaugcccgggacccggaaggugauggagaucacggccgaguggcuguggcgcacccugggccggaacaagcgcccccggcucugcacccgcgaggaguucaccaagaaggugcgcacgaacgccgcgaugggcgccgucuucaccgaggagaaccagugggacagcgccaaggccgccguggaggacgaggaguucuggaagcugguggaccgggagcgcgagcugcacaagcucgggaagugcggcuccugcgucuacaacaugauggggaagcgggagaagaagcugggcgaguucgggaaggcgaagggcagccgcgccaucugguacauguggcugggcucccgguaccucgaguucgaggcccugggguuccugaacgaggaccacugguucagccgcgagaacuccuacagcggcguggagggggagggccuccacaagcugggguacauccugcgggacaucuccaagaucccgggcggcgccauguacgccgacgacaccgcggggugggacacccgcaucacggaggacgaccuccacaacgaggagaagaucacccagcagauggaccccgagcaccggcugcuggccaacgccaucuucaagcucaccuaccagaacaagguggucaaggugcagcgccccacccccaccggcacggugauggacaucaucagccggaaggaccagcgcggguccggccaggucggcaccuacgggcugaacaccuucaccaacauggaggcccagcuggugcggcagauggagggcgagggggugcucagcaaggccgaccuggagaacccgcaccuccccgagaagaagaucacgcaguggcucgagaccaagggcgucgagcgccugaagcggauggcgaucuccggggacgacugcguggugaagcccaucgacgaccgcuucgccaacgcccugcucgcccugaacgacaugggcaagguccggaaggacaucccccaguggcagccgagcaagggcuggcacgacuggcagcagguccccuucugcucccaccacuuccacgagcugaucaugaaggacgggcgcaagcucgugguccccugccggccccaggacgagcugaucggccgcgcccggaucagccagggggcgggcuggucccugcgcgagaccgccugccucgggaaggccuacgcccagauguggagccugauguacuuccaccgccgggaccugcgccucgcguccaacgccaucugcagcgccgugccggugcacuggguccccaccagccggacgaccugguccauccacgcccaccaccaguggaugaccaccgaggacaugcugacgguguggaaccgcguguggaucgaggacaaccccuggauggaggacaagacccccgucaccaccugggagaacgugccguaccugggcaagcgggaggaccaguggugcggcagccucaucgggcugacgucccgcgccaccugggcgcagaacauccccaccgccauccagcagguccggagccugaucggcaacgaggaguuccucgacuacaugcccuccaugaagcgcuuccggaaggaggaggagagcgagggggccaucugguga

SEQ ID NO: 10364 - RNA, 9873 nt, Artificial Sequence
  derived and/or modified CDS sequence (opt1) from DENV-3__HQ235027__SS-prME
accagccugugccucaugaugauccugcccgccgcccuggcguuccaccucaccagccgggacggcgagccgcggaugaucguggggaagaacgagcggggcaagagccugcuguucaagaccgccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaucgagauccagaacagcggcgggaccuccaucuucgccggccaccugaagugccggcugaagauggacaagcucgagcugaagggcaugagcuacgccaugugcaccaagaccuucguccugaagaaggagguguccgagacgcagcacgggaccauccucaucaagguggaguacaagggcgaggacgcgccgugcaagauccccuucagcaccgaggacgggcagggcaaggccuacaacggccgccugaucaccgccaaccccgucgugacgaagaaggacgagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacaccgcccuguucagcggcguguccugggugaugaagaucggcaucgggguccuccugacguggaucggccugaacagcaagaacaucuccaugagcuucuccugcaucgccaucgggaucaucacccucuaccugggcgccguggugcaggcggacauggggugcgucaucaacuggaagggcaaggagcugaagugcggcagcgggaucuucgugaccaacgaggugcacaccuggacggagcaguacaaguuccaggccgacucccccaagcgccucgccaccgccaucgccggcgcgugggagaacggggucugcggcauccgcagcaccacccggauggagaaccugcuguggaagcagaucgccaacgagcucaacuacauccugugggagaacaacaucaagcugacggugguggucggggacaccaucggcgugcucgagcagggcaagcgcacccugacgccccagccgauggagcugaaguacuccuggaagacgugggggaaggccaagaucgugaccgccgagacccagaacagcuccuucaucaucgacggccccaacacccccgagugccccagcgcgucccgggccuggaacgucugggagguggaggacuacggguucggcguguucacgaccaacaucuggcucaagcugcgcgaggucuacacccagcugugcgaccaccggcucaugagcgccgccgugaaggacgagcgcgccgugcacgcggacaugggcuacuggaucgagagccagaagaacggguccuggaagcuggagaaggccagccugaucgaggucaagaccugcaccuggccgaagucccacacgcucuggagcaacggcgugcuggaguccgacaugaucauccccaagagccuggccgggcccaucucccagcacaaccaccggccgggcuaccacacccagaccgccgggcccuggcaccucggcaagcuggagcuggacuucaacuacugcgagggcaccacgguggucaucaccgagaacugcgggacccgcggccccagccuccggaccacgaccguguccgggaagcugauccacgaguggugcugccgcagcugcacccugcccccgcuccgguacaugggcgaggacgggugcugguacggcauggagauccgccccaucuccgagaaggaggagaacauggucaagagccuggucuccgccggcagcgggaagguggacaacuucaccaugggcgugcugugccucgcgauccuguucgaggaggucaugcgggggaaguucggcaagaagcacaugaucgccgggguguucuucacguucgugcugcuccuguccggccagaucaccuggcgcgacauggcccacacccugaucaugaucggcagcaacgccuccgaccggauggggaugggcgucaccuaccucgcccugaucgcgacguucaagauccagcccuuccuggcccucggguucuuccugcgcaagcugaccagccgggagaaccuccugcugggcgugggccucgccauggccaccacccugcagcugcccgaggacaucgagcagauggcgaacgggaucgcccucggccugauggcccugaagcucaucacgcaguucgagaccuaccagcuguggaccgcccugaucagccugaccugcuccaacacgauguucacccugaccguggccuggcgcaccgcgacgcugauccucgccggggucagccugcugccggugugccaguccagcuccaugcggaagaccgacuggcuccccauggccgucgccgccaugggcgugccgccccucccgcuguucaucuucagccucaaggacacccugaagcgccgcuccuggccccugaacgagggggugauggcggucggccucgugagcauccuggccuccagccugcuccggaacgacgugcccauggccggcccccuggucgccgggggccugcucaucgccugcuacgugaucaccgggacguccgcggaccugaccguggagaaggccgccgacaucaccugggaggaggaggccgagcagaccggcgucagccacaaccugaugaucacgguggacgacgacgggaccaugcgcaucaaggacgacgagaccgagaacauccucaccgugcugcugaagaccgcccuccuggucguguccggcguguucccguacagcauccccgcgacgcugcucgucuggcacaccuggcagaagcagacccagcgguccggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacccggggcgccguccucaccuacaacgggaagcgccuggagcccaacugggccuccgugaagaaggaccugaucagcuacggcgggggcuggcggcucuccgcgcaguggcagaagggggaggaggugcaggucaucgccguggagcccggcaagaaccccaagaacuuccagacgaugcccggcaccuuccagaccaccacgggggagaucggcgccaucgcccuggacuucaagcccgggaccagcggcagccccaucaucaaccgcgagggcaagguggucgggcuguacggcaacgggguggugaccaagaacggcggguacgucuccggcaucgcccagaccaacgcggagccggacggccccacgcccgagcuggaggaggagauguucaagaagcggaaccucaccaucauggaccugcaccccgggagcggcaagacccgcaaguaccugccggccaucgugcgggaggccaucaagcgccggcuccgcacccugauccuggcccccacgcggguggucgccgcggagauggaggaggcccucaaggggcugcccauccgcuaccagaccaccgccaccaaguccgagcacacgggccgggagaucguggaccugaugugccacgccaccuucaccaugcgccuccugagccccgugcgggucccgaacuacaaccugaucaucauggacgaggcccacuucaccgaccccgcguccaucgccgcccgcggguacaucagcacgcgggugggcaugggcgaggccgcggccaucuucaugaccgccacgccgcccgggaccgccgacgccuucccgcaguccaacgcgcccauccaggacgaggagcgcgacauccccgagcgcagcuggaacuccggcaacgaguggaucacggacuucgccgggaagaccgugugguucguccccagcaucaaggccggcaacgacaucgccaacugccuccggaagaacgggaagaaggugauccagcugucccgcaagaccuucgacaccgaguaccagaagacgaagcugaacgacugggacuucguggucaccaccgacaucagcgagaugggcgccaacuucaaggcggaccgggugaucgacccgcgccggugccucaagcccgugauccugaccgacggccccgagcgcgucauccuggccgggcccaugccggugacggccgccuccgccgcgcagcggcgcggccggguggggcgcaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgggagaaguccgcggccaucgacggcgaguaccgccugaagggcgagucccggaagaccuucgucgagcugaugcgccgcggggaccuccccguguggcuggcccacaaggucgccagcgagggcaucaaguacacggaccgcaaguggugcuucgacgggcagcggaacaaccagauccuggaggagaacauggacguggagaucuggaccaaggagggcgagaagaagaagcuccgcccccgguggcuggacgcccgcaccuacuccgacccgcuggcgcucaaggaguucaaggacuucgccgccggccgcaagagcaucgcccuggaccuggugaccgagaucgggcggguccccucccaccucgcccaccgcacgcggaacgcgcuggacaaccuggugaugcuccacaccagcgagcacggcgggcgcgccuaccggcacgccguggaggagcugcccgagaccauggagacccugcuccugcugggccucaugauccugcugaccggcggggccaugcuguuccugaucagcgggaaggggaucggcaagaccuccaucgggcugaucugcgucaucgccagcuccggcaugcucuggauggcggagaucccgcugcaguggaucgccagcgccaucgugcuggaguucuucaugauggugcuccugauccccgagcccgagaagcagcgcacgccccaggacaaccagcuggccuacgucgugaucgggauccucacccuggccgcgaucaucgccgccaacgagaugggccugcucgagacgaccaagcgggaccugggcauguccaaggagccggggguggucagccccaccuccuaccuggacguggaccuccaccccgccagcgcguggacccuguacgccguggccacgaccgucaucacccccaugcugcgccacaccaucgagaacuccacggccaacgugagccucgccgcgaucgccaaccaggccgugguccugaugggccuggacaagggguggccgaucuccaagauggaccucggcgugccccugcuggcccucgggugcuacagccaggugaacccccugacccugaccgccgcgguccuccugcugaucacccacuacgccaucaucggccccggccuccaggccaaggccacgcgggaggcccagaagcgcaccgcggccgggaucaugaagaacccgaccguggacggcaucaugaccaucgaccuggaccccgugaucuacgacuccaaguucgagaagcagcuggggcaggucaugcuccuggugcugugcgccgugcagcuccugcugaugcggacgagcugggcccucugcgaggcgcugacccuggccaccggccccaucaccacgcucugggagggcucccccgggaaguucuggaacaccaccaucgccgucagcauggccaacaucuuccgcggcuccuaccuggccggggcgggccuggccuucagcaucaugaaguccguggggaccggcaagcggggcacggggagccagggcgagacccucggggagaaguggaagaagaagcugaaccagcugagccgcaaggaguucgaccgguacaagaaguccggcaucaccgagguggaccgcaccgaggccaaggaggggcucaagcggggcgagaccacgcaccacgccgucagccgcggcuccgccaagcugcagugguucguggagcggaacauggugaucccggaggggcgcgucaucgaccugggcugcgggcggggcggguggagcuacuacugcgcgggccucaagaaggugaccgaggugcgcggcuacaccaagggcgggcccgggcacgaggagcccguccccauguccaccuacggcuggaacaucgugaagcugaugagcgggaaggacguguucuaccugccgcccgagaagugcgacacgcuccugugcgacaucggcgaguccagccccucccccaccgucgaggagagccgcaccauccgggugcugaagaugguggagccguggcugaagaacaaccaguucugcaucaagauccucaaccccuacaugcccaccgucaucgagcaccuggagcgccugcagcggaagcacggcgggaugcucgugcgcaacccccugucccggaacagcacgcacgagauguacuggaucuccaacggcaccgggaacaucguggccagcgucaacauggugucccgccugcuccugaaccgguucaccaugacccaccgccggccgacgaucgagaaggacguggaccugggcgccggcacccgccacgucaacgccgagcccgagacccccaacauggacgugaucggggagcggaucaagcgcaucaaggaggagcacaacagcaccuggcacuacgacgacgagaacccguacaagacgugggccuaccacggcuccuacgaggugaaggcgaccgggagcgccuccagcaugaucaacggcgucgugaagcuccugaccaagcccugggacgucgugcccauggugacccagauggccaugacggacaccacccccuucgggcagcagcgggucuucaaggagaagguggacacccgcacgccgcggagcaugcccggcacccgccgggugaugggcaucaccgccgaguggcuguggcgcacccucgggcggaacaagaagccccgccugugcacgcgcgaggaguucaccaagaagguccggaccaacgcggccaugggcgccguguucaccgaggagaaccagugggacuccgccaaggccgcgguggaggacgaggacuucuggaagcuggucgaccgcgagcgggagcuccacaagcuggggaagugcggcagcugcguguacaacaugauggggaagcgcgagaagaagcugggcgaguucggcaaggccaaggggucccgggccaucugguacauguggcucggcgcccgcuaccuggaguucgaggcccugggguuccucaacgaggaccacugguucagccgggagaacuccuacagcggcguggagggggagggccugcacaagcugggcuacauccuccgcgacaucuccaagauccccgggggcgcgauguacgccgacgacacggccgggugggacacccggaucaccgaggacgaccugcacaacgaggagaagaucacccagcagauggacccggagcaccgccagcuggccaacgccaucuucaagcucacguaccagaacaaggucgugaaggugcagcggcccacccccaccggcaccgucauggacaucaucagccgcaaggaccagcggggcuccggccaggugggcaccuacgggcugaacacguucaccaacauggaggcgcagcugauccgccagauggagggcgagggggugcucagcaaggccgaccuggagaacccccaccuccccgagaagaagaucacccaguggcucgagaccaagggcgucgagcggcugaagcgcauggccaucuccggcgacgacugcguggugaagcccaucgacgaccgguucgccaacgcccugcucgcgcugaacgacauggggaagguccgcaaggacaucccccaguggcagcccagcaagggcuggcacgacuggcagcaggucccguucugcucccaccacuuccacgagcugaucaugaaggacgggcggaagcucgugguccccugccgcccccaggacgagcugaucggccgggcccgcaucagccagggggccggcuggucccugcgcgagacggccugccucggcaaggcguacgcccagauguggagccugauguacuuccaccggcgcgaccugcggcucgccuccaacgccaucugcagcgccgugcccgugcacugggucccgaccucccgcaccaccuggagcauccacgcgcaccaccaguggaugacgaccgaggacaugcugaccguguggaaccggguguggaucgaggacaaccccuggauggaggacaagacccccgucacgaccugggaggacgugcccuaccuggggaagcgcgaggaccaguggugcggcagccucaucgggcugaccucccgggccaccugggcccagaacaucccgacggccauccagcagguccgcagccugaucggcaacgaggaguuccucgacuacaugcccuccaugaagcgguuccgcaaggaggaggagagcgagggggccaucugguga

SEQ ID NO: 10365 - RNA, 9873 nt, Artificial Sequence
  derived and/or modified CDS sequence (opt1) from DENV-3__JQ920476__SS-prME
accagccucugccucaugaugaugcugcccgccacccuggccuuccaccucaccagccgggacggcgagccccggaugaucguggggaagaacgagcgcggcaagagccugcuguucaagaccgccagcgggaucaacaugugcacccucaucgccauggaccugggcgagaugugcgacgacaccgugaccuacaagugcccccugaucaccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgcggagggcgccuggcggcaggucgagaaggucgagaccugggccuuccgccaccccggguucaccauccucgcccuguuccuggcgcacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacgugaccacggacagccgcugccccacccagggcgaggcgauccugcccgaggagcaggaccagaacuacgucugcaagcacaccuacguggaccggggguggggcaacgggugcggccucuucgggaagggcucccuggugaccugcgccaaguuccagugccuggagagcaucgagggcaaggccguccagcacgagaaccucaaguacacggugaucaucaccgugcacaccggggaccagcaccaggucggcaacgagacccagggggugacggccgagaucacgccccaggccuccaccgucgaggcgauccugcccgaguacggcacccuggggcucgagugcagcccccgcaccggccuggacuucaacgagaugauccugcucacgaugaagaacaaggccuggauggugcaccggcagugguucuucgaccugccgcugcccuggaccuccggcgccaccaccgagacgcccaccuggaacaagaaggagcuccuggugaccuucaagaacgcccacgccaagaagcaggaggucguggugcuggggagccaggagggcgcgaugcacaccgcccucacgggggccaccgagauccagaccuccggcgggaccagcaucuucgccggccaccugaagugccgccugaagauggacaagcucgagcugaagggcauguccuacgccaugugccugaacgcguucguccucaagaaggaggugagcgagacgcagcacgggaccauccugaucaagguggaguacaagggcgaggacgcccccugcaagauccccuucagcaccgaggacgggcagggcaaggcccacaacggccggcugaucaccgccaaccccaucgucacgaagaaggaggagcccgugaacaucgaggcggagcccccguucggggaguccaacaucgugaucggcaucggggacaaggcccugaagaucaacugguacaagaagggcagcuccaucgggaagauguucgaggccaccgcccgcggcgcccggcgcauggcgauccucggcgacaccgccugggacuucgggagcgucggcggggugcugaacucccugggcaagauggugcaccagaucuucgggagcgccuacaccgcccucuucuccggcgucagcuggaucaugaagaucggcaucggggugcugcugacguggaucggccucaacuccaagaacaccagcauguccuucagcugcaucgugaucgggaucaucacccuguaccugggcgccgucgugcaggcggacauggggugcgugaucaacuggaagggcaaggagcucaagugcggcuccgggaucuucgucaccaacgaggugcacacguggaccgagcaguacaaguuccaggccgacagccccaagcggcuggccaccgccaucgccggcgcgugggagaacggggugugcggcauccgcuccaccacgcgcauggagaaccugcucuggaagcagaucgccaacgagcugaacuacauccugugggagaacaacaucaagcucaccaucgucgugggggacgugaucggcguccuggagcagggcaagcggacccugacgccccagcccauggagcucaaguacagcuggaagacgugggggaaggccaagaucgugaccgccgagacccagaacuccagcuucaucaucgacggcccgaacacccccgagugccccaacgcgucccgcgccuggaacgugugggaggucgaggacuacggguucggcguguucacgaccaacaucuggcugaagcugcgggagauguacacccagcucugcgaccaccgccugaugagcgccgccgugaaggacgagcgggccguccacgcggacaugggcuacuggaucgagagccagaagaacggguccuggaagcuggagaaggccagccucaucgaggugaagaccugcaccuggcccaagucccacacgcuguggagcaacggcgugcuggaguccgacaugaucauccccaagagccucgccgggcccaucucccagcacaacuaccgccccggcuaccacacccagaccgccgggccguggcaccugggcaagcuggagcucgacuucaacuacugcgagggcaccacggucgugaucaccgagaacugcgggacccggggccccagccugcgcaccacgaccguguccgggaagcugauccacgaguggugcugccggagcugcacccugccgccccuccgcuacaugggcgaggacgggugcugguacggcauggagauccggccgaucaacgagaaggaggagaacauggucaagucccuggugagcgccggcuccgggaaggcggacaacuucaccaugggcgugcucugccuggccauccuguucgaggaggucaugcgcgggaaguucggcaagaagcacaugaucgccggggcccucuucacguucgugcugcugcucagcggccagaucaccuggcgggacauggcccacacccugaucaugaucggcuccaacgcgagcgaccgcauggggaugggcgugaccuaccuggcccucaucgccacguucaagauccagcccuuccuggcccugggguucuuccuccggaagcugaccucccgcgagaaccugcuccugggcgucggccuggcgauggccaccacccuccagcugcccgaggacaucgagcagauggccaacgggaucgcccugggccucauggcccugaagcugaucacgcaguucgagaccuaccagcucuggaccgcgcuggugagccugaugugcagcaacaccaucuucacgcucaccguggccuggcggaccgccacccugauccuggccgucaucucccuccugcccgugugccagagcuccagcaugcgcaagacggacuggcugccgaugaccguggccgcgaugggggugccgccccucccccuguucaucuucucccugaaggacacccucaagcggcgcagcuggccgcugaacgagggcgugauggccgucgggcugguguccauccucgccagcuccuuccugcgcaacgacgugcccauggccggcccccuggucgccggcgggcuccugaucgcgugcuacgugaucaccggcacgagcgccgaccugaccguggagaaggccgccgacgucaccugggaggaggaggccgagcagaccggggugucccacaaccucaugaucacgguggacgacgacggcaccaugcggaucaaggacgacgagaccgagaacauccugaccguccugcucaagaccgcgcugcugaucgugagcgggaucuuccccuacuccaucccggccacgcuccugguguggcacaccuggcagaagcagacccagcgcagcggcguccugugggacgugcccagcccgcccgagacccagaaggccgagcucgaggagggcguguaccggaucaagcagcaggggaucuucggcaagacgcaggucggggugggcgugcagaaggagggggucuuccacaccauguggcacgugacccgcggcgccgugcugacccacaacggcaagcggcuggagccgaacugggcgaacgucaagaaggaccucaucagcuacgggggcggguggaagcuguccgcccaguggcagaagggcgaggagguccaggugaucgccgucgagcccgggaagaaccccaagaacuuccagacgaugcccggcaucuuccagaccaccaccggcgagaucggggccaucgcccuggacuucaagccgggcacgagcgggucccccaucaucaaccgcgagggcaagguggugggccuguacgggaacggcgucgugaccaagaacgggggcuacgugagcgggaucgcgcagaccaacgccgagcccgacggcccgacccccgagcucgaggaggagauguucaagaagcggaaccugacgaucauggaccugcaccccggcagcgggaagacccgcaaguaccuccccgccaucguccgggaggccaucaagcgccggcugcgcacccugauccucgccccgacccgggugguggcggccgagauggaggaggcccugaagggccugcccauccgcuaccagacgaccgccaccaaguccgagcacaccgggcgggagaucgucgaccucaugugccacgccacguucaccaugcgccugcugagccccgugcgggugcccaacuacaaccucaucgucauggacgaggcgcacuucaccgacccggccuccaucgccgcccgcggcuacaucagcacccggguggggaugggcgaggcggccgccaucuucaugacggccacgccgcccggcaccgccgacgcguucccccaguccaacgccccgauccaggacgaggagcgcgacauccccgagcggagcuggaacuccgggaacgaguggaucaccgacuucgccggcaagacggugugguucguccccagcaucaaggccgggaacgacaucgccaacugccugcgcaagaacggcaagaaggugauccagcugucccgcaagaccuucgacaccgaguaccagaagaccaagcucaacgacugggacuucguggucacgaccgacaucagcgagaugggggcgaacuucaaggccgaccgggugaucgacccccgccggugccugaagccggugauccugaccgacggccccgagcgcgucauccucgccggccccaugcccgugaccguggccuccgccgcgcagcggcgcgggcgggucggccgcaacccgcagaaggagaacgaccaguacaucuucacggggcagccccugaacaacgacgaggaccacgcccacuggaccgaggccaagaugcugcucgacaacaucaacacccccgagggcaucauccccgcccuguucgagccggagcgggagaaguccgcggccaucgacggggaguaccgccugaagggcgagucccggaagaccuucguggagcucaugcgccggggcgaccugcccguguggcuggcccacaaggucgccagcgaggggaucaaguacaccgaccgcaaguggugcuucgacggcgagcggaacaaccagauccucgaggagaacauggacguggagaucuggacgaaggagggggagaagaagaagcugcgcccccgguggcuggacgcccgcaccuacuccgacccccucgcgcugaaggaguucaaggacuucgccgccggccgcaagagcaucgcccuggaccucgucaccgagaucggccgcgugccgucccaccuggcccaccgcacccggaacgcgcuggacaaccucgugaugcugcacacgagcgagcacgggggccgcgccuaccggcacgccgucgaggagcugcccgagaccauggagacccuccugcugcucgggcugaugauccugcucaccggcggggccaugcuguuccugaucuccggcaagggcaucgggaagacgagcaucggccucaucugcgugguggccagcuccgggaugcuguggauggcggacgucccccugcaguggaucgccagcgccaucgugcucgaguucuucaugauggugcugcugaucccggagcccgagaagcagcgcacgccccaggacaaccagcucgccuacgucgugaucggcauccugacccuggccgcgaucguggccgccaacgagauggggcuccuggagaccacgaagcgggaccugggcauguccaaggagagcggcgucgugucccccaccagcuaccucgacguggaccugcacccggccuccgcguggacccuguacgccgucgccaccacggugaucacccccaugcuccgccacaccaucgagaacagcaccgccaacgugucccuggccgcgaucgccaaccaggccgucgugcugauggggcucgacaagggcuggcccaucagcaagauggaccugggggugccccugcucgcccugggcugcuacucccaggucaacccgcugacgcucaccgccgcggugcugcugcucgugacccacuacgccaucaucgggcccggccugcaggccaaggccacccgggaggcccagaagcgcacggcggccggcaucaugaagaaccccaccgucgacgggaucaugaccaucgaccuggaccccgugaucuacgacagcaaguucgagaagcagcucggccaggugaugcugcugguccucugcgccgugcagcugcugcucaugcggaccuccugggccuucugcgaggcgcugacgcuggccaccgggccgaucaccacccucugggagggcagccccggcaaguucuggaacacgaccaucgccguguccauggccaacaucuuccgcgggagcuaccuggccggcgcggggcuggccuucuccaucaugaaguccgucggcaccgggaagcggggcaccggcucccagggggagacgcucggcgagaaguggaagaagaagcugaaccagcugagccgcaaggaguucgaccucuacaagaaguccgggaucaccgagguggaccggaccgaggccaaggagggccugaagcgcggggagaucacccaccacgccgugucccggggcagcgccaagcugcagugguucgucgagcgcaacauggugauccccgagggccgggugaucgaccucgggugcggccgcgggggcugguccuacuacugcgcggggcugaagaaggucaccgaggugcggggcuacacgaagggcgggcccggccacgaggagccggugcccaugagcaccuacggguggaacaucgucaagcugauguccggcaaggacguguucuaccugccgcccgagaagugcgacacccugcugugcgacaucggggagagcuccccgagccccaccguggaggagucccgcacgauccggguccugaagaugguggagcccuggcucaagaacaaccaguucugcaucaaggugcugaaccccuacaugccgaccgucaucgagcaccuggagcgccuccagcgcaagcacggcggcaugcuggugcggaacccccugagccgcaacuccacccacgagauguacuggaucagcaacgggaccggcaacaucguguccagcgucaacauggugucccggcuccugcugaaccgcuucacgaugacccaccggcgccccaccaucgagaaggacguggaccucggggccggcacccggcacgucaacgccgagcccgagacgccgaacauggacgugaucggcgagcgcauccggcgcaucaaggaggagcacagcuccaccuggcacuacgacgacgagaaccccuacaagaccugggccuaccacgggagcuacgaggucaaggccaccggcuccgcgagcagcaugaucaacgggguggugaagcugcugacgaagcccugggacgucgugccgauggugacccagauggccaugaccgacaccacgcccuucggccagcagcgggucuucaaggagaagguggacacccgcacgccccggcccaugccggggacccgcaaggugauggagaucaccgccgaguggcucuggcggacccugggccgcaacaagcggccccgccugugcacccgggaggaguucaucaagaagguccgcaccaacgccgcgaugggcgccguguucacggaggagaaccagugggacuccgcccgcgccgccguggaggacgaggaguucuggaagcucgucgaccgggagcgcgagcugcacaagcuggggaagugcggcagcugcguguacaacaugauggggaagcgggagaagaagcucggcgaguucgggaaggcgaagggcucccgcgccaucugguacauguggcugggcgcccgguaccuggaguucgaggcccucggguuccugaacgaggaccacugguucagccgcgagaacucccacagcggcguggagggggagggccugcacaagcucggguacauccugcgggacaucuccaagauccccggcggcgccauguacgcggacgacaccgccgggugggacacccgcaucaccgaggacgaccugcacaacgaggagaagaucacgcagcagauggaccccgagcaccggcagcucgccaacgccaucuucaagcugaccuaccagaacaaggucgugaaggugcagcgcccgacccccaagggcaccgucauggacaucaucagccggaaggaccagcgcggguccggccaggugggcacguacgggcugaacaccuucaccaacauggaggcccagcucauccggcagauggagggcgagggggugcugagcaaggcggaccuggagaacccccaccuccuggagaagaaggucacccaguggcuggagaccaagggcguggagcgccucaagcggauggccaucuccggggacgacugcguggucaagcccaucgacgaccgcuucgccaacgcccugcuggcccucaacgacaugggcaaggugcggaaggacaucccgcaguggcagcccagcaagggcuggcacgacuggcagcagguccccuucugcucccaccacuuccacgagcugaucaugaaggacgggcgcaagcuggucgugcccugccggccgcaggacgagcucaucggccgcgcgcggaucagccagggggccggcuggucccugcgcgagacggccugccuggggaaggccuacgcgcagaugugggcccucauguacuuccaccgccgggaccugcgccuggccagcaacgccaucugcuccgccgugcccguccacugggugcccaccagccggaccaccugguccauccacgcgcaccaccaguggaugacgaccgaggacaugcucaccguguggaaccgcgucuggaucgaggacaaccccuggauggaggacaagaccccggugacgaccugggaggacgugcccuaccugggcaagcgggaggaccaguggugcggcagccugaucgggcucaccagccgcgccaccugggcccagaacauccugacggccauccagcagguccggucccugaucggcaacgaggaguuccucgacuacaugcccagcaugaagcgcuuccggaaggaggaggaguccgagggggccaucugguga

SEQ ID NO: 10366 - RNA, 9873 nt, Artificial Sequence
  derived and/or modified CDS sequence (opt1) from DENV-3__JQ920477__SS-prME
accagccugugccugaugaugaugcugcccgccacccuggccuuccaccucaccucccgggacggcgagccccggaugaucguggggaagaacgagcgcggcaagagccugcuguucaagaccgccuccgggaucaacaugugcacccucaucgccauggaccugggcgagaugugcgacgacaccgugaccuacaagugcccccugaucaccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgcggagggcgccuggcggcaggucgagaaggucgagaccugggccuuccgccaccccggguucaccauccucgcccuguuccuggcgcacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacgugaccacggacagccgcugccccacccagggcgaggcgauccugcccgaggagcaggaccagaacuacgucugcaagcacaccuacguggaccggggguggggcaacgggugcggccucuucgggaagggcucccuggugaccugcgccaaguuccagugccuggagagcaucgagggcaaggccguccagcacgagaaccucaaguacacggugaucaucaccgugcacaccggggaccagcaccaggucggcaacgagacccagggggugacggccgagaucacgccccaggccuccaccgucgaggcgauccugcccgaguacggcacccuggggcucgagugcagcccccgcaccggccuggacuucaacgagaugauccugcucacgaugaagaacaaggccuggauggugcaccggcagugguucuucgaccugccgcugcccuggaccuccggcgccaccaccgagacgcccaccuggaacaagaaggagcuccuggugaccuucaagaacgcccacgccaagaagcaggaggucguggugcuggggagccaggagggcgcgaugcacaccgcccucacgggggccaccgagauccagaccuccggcgggaccagcaucuucgccggccaccugaagugccgccugaagauggacaagcucgagcugaagggcauguccuacgccaugugccugaacgcguucguccucaagaaggaggugagcgagacgcagcacgggaccauccugaucaagguggaguacaagggcgaggacgcccccugcaagauccccuucagcaccgaggacgggcagggcaaggcccacaacggccggcugaucaccgccaaccccaucgucacgaagaaggaggagcccgugaacaucgaggcggagcccccguucggggaguccaacaucgugaucggcaucggggacaaggcccugaagaucaacugguacaagaagggcagcuccaucgggaagauguucgaggccaccgcccgcggcgcccggcgcauggcgauccucggcgacaccgccugggacuucgggagcgucggcggggugcugaacucccugggcaagauggugcaccagaucuucgggagcgccuacaccgcccucuucuccggcgucagcuggaucaugaagaucggcaucggggugcugcugacguggaucggccucaacuccaagaacaccagcauguccuucagcugcaucgugaucgggaucaucacccuguaccugggcgccgucgugcaggcggacauggggugcgugaucaacuggaagggcaaggagcucaagugcggcuccgggaucuucgucaccaacgaggugcacacguggaccgagcaguacaaguuccaggccgacagccccaagcggcuggccaccgccaucgccggcgcgugggagaacggggugugcggcauccgcuccaccacgcgcauggagaaccugcucuggaagcagaucgccaacgagcugaacuacauccugugggagaacaacaucaagcucaccaucgucgugggggacgugaucggcguccuggagcagggcaagcggacccugacgccccagcccauggagcucaaguacagcuggaagacgugggggaaggccaagaucgugaccgccgagacccagaacuccagcuucaucaucgacggcccgaacacccccgagugccccuccgcgcugcgcgccuggaacgugugggaggucgaggacuacggguucggcguguucacgaccaacaucuggcugaagcuccgggagaaguacacccagcugugcgaccaccgccugaugagcgccgccgugaaggacgagcgggccguccacgcggacaugggcuacuggaucgagagccagaagaacggguccuggaagcucgagaaggccagccugaucgaggugaagaccugcaccuggcccaagucccacacgcuguggagcaacggcgugcucgaguccgacaugaucauccccaagagccuggccgggcccaucucccagcacaacuaccgccccggcuaccacacccagaccgccgggccguggcaccugggcaagcucgagcuggacuucaacuacugcgagggcaccacggucgugaucaccgagaacugcgggacccggggccccagccugcgcaccacgaccguguccgggaagcucauccacgaguggugcugccggagcugcacccugccgccccugcgcuacaugggcgaggacgggugcugguacggcauggagauccggccgaucaacgagaaggaggagaacauggucaagucccucgugagcgccggcuccgggaagaccgacaacuucacgaugggcgugcugugccuggcgauccucuucgaggaggucaugcgcgggaaguucggcaagaagcacaugaucgccggggcccuguucaccuucgugcugcuccugagcggccagaucaccuggcgggacauggcccacacccugaucaugaucggcuccaacgccagcgaccgcauggggaugggcgugacguaccucgcgcugaucgccaccuucaagauccagcccuuccuggcccucggguucuuccugcggaagcugaccucccgcgagaaccuccugcugggcgucggccucgccauggcgaccacgcugcagcugcccgaggacaucgagcagauggccaacgggaucgcccucggccugauggcccugaagcucaucacccaguucgagaccuaccagcuguggaccgcccuggugagccucaugugcagcaacacgaucuucacccugaccguggcguggcggaccgccacgcugauccucgccgucaucucccugcugcccgugugccagagcuccagcaugcgcaagaccgacuggcucccgaugaccguggccgccaugggggugccgccccugccccuguucaucuucucccucaaggacacccugaagcggcgcagcuggccgcugaacgagggcgugauggcggucgggcucguguccauccuggccagcuccuuccugcgcaacgacgugcccauggccggcccccucgucgccggcgggcugcugaucgccugcuacgugaucacgggcaccagcgcggaccucaccguggagaaggccgccgacgucaccugggaggaggaggccgagcagacgggggugucccacaaccugaugaucaccguggacgacgacggcaccaugcggaucaaggacgacgagaccgagaacauccugaccguccuccugaagacggcccugcucaucgugagcgggaucuuccccuacuccaucccggcgacccugcugguguggcacaccuggcagaagcagacccagcgcagcggcguccucugggacgugcccagcccgcccgagacgcagaaggccgagcuggaggagggcguguaccggaucaagcagcaggggaucuucggcaagacccaggucggggugggcgugcagaaggagggggucuuccacaccauguggcacgugacccgcggcgccgugcugacgcacaacggcaagcggcucgagccgaacugggccaacgucaagaaggaccugaucagcuacgggggcggguggaagcuguccgcgcaguggcagaagggcgaggagguccaggugaucgccgucgagcccgggaagaaccccaagaacuuccagaccaugcccggcaucuuccagaccaccacgggcgagaucggggccaucgcccuggacuucaagccgggcaccagcgggucccccaucaucaaccgcgagggcaagguggugggccucuacgggaacggcgucgugaccaagaacgggggcuacgugagcgggaucgcccagaccaacgcggagcccgacggcccgacgcccgagcuggaggaggagauguucaagaagcggaaccugaccaucauggaccuccaccccggcagcgggaagacccgcaaguaccugcccgccaucguccgggaggccaucaagcgccggcugcgcacccucauccuggccccgacgcgggugguggccgcggagauggaggaggcccugaagggccuccccauccgcuaccagaccaccgccaccaaguccgagcacacggggcgggagaucgucgaccugaugugccacgccaccuucaccaugcgccugcucagccccgugcgggugcccaacuacaaccugaucgucauggacgaggcccacuucaccgacccggcguccaucgccgcccgcggcuacaucagcacgcggguggggaugggcgaggccgcggccaucuccaugaccgccacgccgcccggcaccgccgacgccuucccccagagcaacgcgccgauccaggacgaggagcgcgacauccccgagcgguccuggaacagcgggaacgaguggaucacggacuucgccggcaagaccgugugguucguccccuccaucaaggccgggaacgacaucgccaacugccugcgcaagaacggcaagaaggugauccagcucagccgcaagaccuucgacaccgaguaccagaagacgaagcugaacgacugggacuucguggucaccaccgacaucuccgagaugggggccaacuucaaggcggaccgggugaucgacccccgccggugccugaagccggugauccucaccgacggccccgagcgcgucauccuggccggccccaugcccgugacgguggccagcgccgcccagcggcgcgggcgggucggccgcaacucccagaaggagaacgaccaguacaucuucaccgggcagccgcugaacaacgacgaggaccacgcgcacuggaccgaggccaagaugcuccuggacaacaucaacacccccgagggcaucauccccgcccuguucgagcccgagcgggagaaguccgccgcgaucgacggggaguaccgccucaagggcgagucccggaagaccuucguggagcugaugcgccggggcgaccugccgguguggcucgcccacaaggucgccagcgaggggaucaaguacacggaccgcaaguggugcuucgacggcgagcggaacaaccagauccuggaggagaacauggacguggagaucuggaccaaggagggggagaagaagaagcugcgcccccgguggcucgacgcccgcaccuacuccgacccccuggcccugaaggaguucaaggacuucgcggccggccgcaagagcaucgcccucgaccuggucaccgagaucggccgcgugcccucccaccuggcccaccgcacgcggaacgcccucgacaaccuggugaugcugcacaccagcgagcacgggggccgcgcguaccggcacgccgucgaggagcucccggagaccauggagacccugcugcuccuggggcugaugauccuccugacgggcggggccaugcuguuccucaucagcggcaagggcaucgggaagaccuccaucggccugaucugcgugguggccagcuccgggaugcuguggauggccgacgucccccuccaguggaucgcgagcgccaucgugcuggaguucuucaugauggugcugcucauccccgagccggagaagcagcgcacgccccaggacaaccagcuggccuacgucgugaucggcauccugacccucgccgccaucguggcggccaacgagauggggcugcuggagacgaccaagcgggaccucggcauguccaaggagcccggcgucgugagccccaccuccuaccuggacguggaccugcacccggccagcgccuggacccucuacgcggucgccacgaccgugaucacccccaugcugcgccacaccaucgagaacuccacggccaacgugagccuggccgccaucgcgaaccaggccgucgugcucauggggcuggacaagggcuggcccaucuccaagauggaccugggggugccccuccuggcccugggcugcuacagccaggucaacccgcucacccugaccgccgccgugcugcuccuggugacccacuacgcgaucaucgggcccggccugcaggccaaggccacgcgggaggcccagaagcgcaccgccgcgggcaucaugaagaaccccaccgucgacgggaucaugaccaucgaccucgaccccgugaucuacgacuccaaguucgagaagcagcugggccaggugaugcugcucguccugugcgccgugcagcugcuccugaugcggacgagcugggccuucugcgaggcccugacccucgcgaccgggccgaucaccacgcugugggagggcucccccggcaaguucuggaacaccaccaucgccgugagcauggccaacaucuuccgcggguccuaccuggccggcgccgggcucgcguucagcaucaugaaguccgucggcaccgggaagcggggcacgggcagccagggggagacccugggcgagaaguggaagaagaagcugaaccagcucagccgcaaggaguucgaccuguacaagaaguccgggaucaccgagguggaccggaccgaggccaaggagggccugaagcgcggggagaucacccaccacgccgugagccggggcuccgccaagcuccagugguucgucgagcgcaacauggugauccccgagggccgggugaucgaccuggggugcggccgcgggggcuggagcuacuacugcgccgggcugaagaaggucacggaggugcggggcuacaccaagggcgggcccggccacgaggagccggugcccauguccaccuacggguggaacaucgucaagcucaugagcggcaaggacguguucuaccugccgcccgagaagugcgacacccugcugugcgacaucggggaguccagcccgucccccacgguggaggagagccgcaccauccggguccucaagaugguggagcccuggcugaagaacaaccaguucugcaucaaggugcugaaccccuacaugccgaccgucaucgagcaccucgagcgccugcagcgcaagcacggcggcaugcuggugcggaacccccucucccgcaacagcacccacgagauguacuggaucuccaacgggacgggcaacaucgugagcuccgucaacauggugagccggcugcugcucaaccgcuucaccaugacccaccggcgccccaccaucgagaaggacguggaccugggggcgggcacgcggcacgucaacgccgagcccgagaccccgaacauggacgugaucggcgagcgcauccggcgcaucaaggaggagcacuccagcaccuggcacuacgacgacgagaaccccuacaagaccugggccuaccacggguccuacgaggucaaggccacgggcagcgccagcuccaugaucaacgggguggugaagcugcucaccaagcccugggacgucgugccgauggugacccagauggcgaugaccgacacgacccccuucggccagcagcgggucuucaaggagaagguggacacccgcacgccccggcccaugccggggacccgcaaggugauggagaucaccgccgaguggcuguggcggacccugggccgcaacaagcggccccgccucugcacccgggaggaguucaucaagaagguccgcacgaacgccgccaugggcgcgguguucaccgaggagaaccagugggacagcgcccgcgccgccguggaggacgaggaguucuggaagcuggucgaccgggagcgcgagcugcacaagcucgggaagugcggcuccugcguguacaacaugauggggaagcgggagaagaagcugggcgaguucgggaaggccaagggcagccgcgcgaucugguacauguggcugggcgcccgguaccucgaguucgaggcccugggguuccugaacgaggaccacugguucucccgcgagaacagccacuccggcguggagggggagggccuccacaagcugggguacauccugcgggacaucagcaagauccccggcggcgccauguacgccgacgacaccgcggggugggacacccgcaucacggaggacgaccuccacaacgaggagaagaucacccagcagauggaccccgagcaccggcagcuggccaacgccaucuucaagcugaccuaccagaacaaggucgugaaggugcagcgcccgacccccaagggcacggucauggacaucaucucccggaaggaccagcgcgggagcggccaggugggcaccuacgggcucaacaccuucaccaacauggaggcccagcugauccggcagauggagggcgagggggugcuguccaaggccgaccucgagaacccccaccuccuggagaagaaggucacccaguggcucgagacgaagggcguggagcgccugaagcggauggcgaucagcggggacgacugcguggucaagcccaucgacgaccgcuucgccaacgcccugcucgcccugaacgacaugggcaaggugcggaaggacaucccgcaguggcagcccuccaagggcuggcacgacuggcagcagguccccuucugcagccaccacuuccacgagcugaucaugaaggacgggcgcaagcucgucgugcccugccggccgcaggacgagcugaucggccgcgcccggaucucccagggggcgggcuggagccugcgcgagaccgccugccucgggaaggccuacgcccagaugugggcgcugauguacuuccaccgccgggaccugcgccucgccuccaacgccaucugcagcgccgugcccguccacugggugcccaccucccggaccacguggagcauccacgcccaccaccaguggaugaccaccgaggacaugcugaccguguggaaccgcgucuggaucgaggacaaccccuggauggaggacaagacgccggugaccaccugggaggacgugcccuaccugggcaagcgggaggaccaguggugcggcagccucaucgggcugaccucccgcgcgacgugggcccagaacauccugaccgccauccagcagguccggagccucaucggcaacgaggaguuccuggacuacaugcccuccaugaagcgcuuccggaaggaggaggagagcgagggggccaucugguga

SEQ ID NO: 10367 - RNA, 9873 nt, Artificial Sequence
  derived and/or modified CDS sequence (opt1) from DENV-3__JQ920478__SS-prME
accagccugugccucaugaugaugcugcccgccacccuggccuuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccugaucaccgagguggagcccgaggacaucgacugcuggugcaaccucaccagcaccugggugaccuacgggaccugcaaccaggccggcgagcaccggcgggacaagcgguccgucgcccuggcgccccacgugggcauggggcuggacacccgcacccagacguggaugagcgcggagggcgccuggcgccagguggagaaggucgagaccugggccuuccgccaccccggguucaccauccucgcccuguuccuggcgcacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacgugaccacggacagccgcugccccacccagggcgaggcgauccugcccgaggagcaggaccagaacuacgucugcaagcacaccuacguggaccggggguggggcaacgggugcggccucuucgggaagggcucccuggugaccugcgccaaguuccagugccuggagagcaucgagggcaaggccguccagcacgagaaccucaaguacacggugaucaucaccgugcacaccggggaccagcaccaggucggcaacgagacccagggggugacggccgagaucacgccccaggccuccaccgucgaggcgauccugcccgaguacggcacccuggggcucgagugcagcccccgcaccggccuggacuucaacgagaugauccugcucacgaugaagaacaaggccuggauggugcaccggcagugguucuucgaccugccgcugcccuggaccuccggcgccaccaccgagacgcccaccuggaacaagaaggagcuccuggugaccuucaagaacgcccacgccaagaagcaggaggucguggugcuggggagccaggagggcgcgaugcacaccgcccucacgggggccaccgagauccagaccucccgcggcaccagcaucuucgccgggcaccugaagugccggcugaagauggacaagcucgagcugaagggcauguccuacgccaugugccugaacgcguucguccucaagaaggaggugagcgagacgcagcacggcaccauccugaucaagguggaguacaagggggaggacgcccccugcaagauccccuucagcaccgaggacggccaggggaaggcccacaacggccgccugaucaccgccaaccccaucgucacgaagaaggaggagcccgugaacaucgaggcggagcccccguucggcgaguccaacaucgugaucgggaucggcgacaaggcccugaagaucaacugguacaagaaggggagcuccaucggcaagauguucgaggccaccgcccgcggggcccgccggauggcgauccucggcgacaccgccugggacuucggcagcgucgggggcgugcugaacucccuggggaagauggugcaccagaucuucggcagcgccuacaccgcccucuucuccggggucagcuggaucaugaagaucggcaucggcgugcugcugacguggaucgggcucaacuccaagaacaccagcauguccuucagcugcaucgugaucggcaucaucacccuguaccugggggccgucgugcaggcggacaugggcugcgugaucaacuggaaggggaaggagcucaagugcggcuccggcaucuucgucaccaacgaggugcacacguggaccgagcaguacaaguuccaggccgacagccccaagcgccuggccaccgccaucgccggggcgugggagaacggcgugugcgggauccgcuccaccacgcggauggagaaccugcucuggaagcagaucgccaacgagcugaacuacauccugugggagaacaacaucaagcucaccaucgucgugggcgacgugaucgggguccuggagcagggcaagcgcacccugacgccccagcccauggagcucaaguacagcuggaagacguggggcaaggccaagaucgugaccgccgagacccagaacuccagcuucaucaucgacgggccgaacacccccgagugccccuccgcgcugcgggccuggaacgugugggaggucgaggacuacggcuucgggguguucacgaccaacaucuggcugaagcuccgcgagaaguacacccagcugugcgaccaccggcugaugagcgccgccgugaaggacgagcgcgccguccacgcggacaugggcuacuggaucgagagccagaagaacggcuccuggaagcucgagaaggccagccugaucgaggugaagaccugcaccuggcccaagucccacacgcuguggagcaacggggugcucgaguccgacaugaucauccccaagagccuggccggccccaucucccagcacaacuaccggcccggguaccacacccagaccgccggcccguggcaccuggggaagcucgagcuggacuucaacuacugcgagggcaccacggucgugaucaccgagaacugcggcacccgcgggcccagccugcggaccacgaccguguccggcaagcucauccacgaguggugcugccgcagcugcacccugccgccccugcgguacaugggggaggacggcugcugguacgggauggagauccgcccgaucaacgagaaggaggagaacauggucaagucccucgugagcgccggcuccggcaagaccgacaacuucacgaugggggugcugugccuggcgauccucuucgaggaggucaugcggggcaaguucgggaagaagcacaugaucgccggcgcccuguucaccuucgugcugcuccugagcgggcagaucaccuggcgcgacauggcccacacccugaucaugaucggcuccaacgccagcgaccggaugggcaugggggugacguaccucgcgcugaucgccaccuucaagauccagcccuuccuggcccucggcuucuuccugcgcaagcugaccucccgggagaaccuccugcugggggucggccucgccauggcgaccacgcugcagcugcccgaggacaucgagcagauggccaacggcaucgcccucgggcugauggcccugaagcucaucacccaguucgagaccuaccagcuguggaccgcccugaucagccucaugugcagcaacacgaucuucacccugaccguggcguggcgcaccgccacgcugauccucgccgugaucucccugcugcccgucugccagagcuccagcaugcggaagaccgacuggcucccgaugaccguggccgccaugggcgugccgccccugccccuguucaucuucucccucaaggacacccugaagcgccgcagcuggccgcugaacgagggggucauggcggugggccucgucuccauccuggccagcuccuuccugcggaacgacgugcccauggccgggccccucguggccggcggccugcugaucgccugcuacgucaucacggggaccagcgcggaccucaccguggagaaggccgccgacgugaccugggaggaggaggccgagcagacgggcgucucccacaaccugaugaucaccguggacgacgacgggaccaugcgcaucaaggacgacgagaccgagaacauccugaccgugcuccugaagacggcccugcucaucgucagcggcaucuuccccuacuccaucccggcgacccugcugguguggcacaccuggcagaagcagacccagcggagcggggugcucugggacguccccagcccgcccgagacgcagaaggccgagcuggaggagggcguguaccgcaucaagcagcagggcaucuucgggaagacccaggugggcgucggggugcagaaggagggcguguuccacaccauguggcacgucacccgcggggccgugcugacgcacaacggcaagcgccucgagccgaacugggccaacgugaagaaggaccugaucagcuacggcgggggcuggaagcuguccgcgcaguggcagaagggggaggagguccaggugaucgccguggagcccggcaagaaccccaagaacuuccagaccaugcccgggaucuuccagaccaccacgggcgagaucggcgccaucgcccuggacuucaagccggggaccagcggcucccccaucaucaaccgggaggggaaggucgugggccucuacggcaacgggguggucaccaagaacggcggguacgugagcggcaucgcccagaccaacgcggagcccgacgggccgacgcccgagcuggaggaggagauguucaagaagcgcaaccugaccaucauggaccuccaccccggcagcggcaagacccggaaguaccugcccgccaucgugcgcgaggccaucaagcggcgccugcggacccucauccuggccccgacgcgcgucguggccgcggagauggaggaggcccugaaggggcuccccauccgguaccagaccaccgccaccaaguccgagcacacgggccgcgagaucguggaccugaugugccacgccaccuucaccaugcggcugcucagccccguccgcgugcccaacuacaaccugaucgugauggacgaggcccacuucaccgacccggcguccaucgccgcccggggguacaucagcacgcgcgucggcaugggggaggccgcggccaucuucaugaccgccacgccgcccggcaccgccgacgccuucccccaguccaacgcgccgauccaggacgaggagcgggacauccccgagcgcagcuggaacuccggcaacgaguggaucacggacuucgccgggaagaccgugugguucgugcccagcaucaaggccggcaacgacaucgccaacugccugcgcaagaacgggaagaaggucauccagcucucccggaagaccuucgacaccgaguaccagaagacgaagcugaacgacugggacuucguggugaccaccgacaucagcgagaugggcgccaacuucaaggcggaccgcgucaucgacccccggcgcugccugaagccggugauccucaccgacgggcccgagcgggugauccuggccggccccaugcccgucacgguggccuccgccgcccagcgccggggccgcguggggcggaacagccagaaggagaacgaccaguacaucuucaccggccagccgcugaacaacgacgaggaccacgcgcacuggaccgaggccaagaugcuccuggacaacaucaacacccccgaggggaucauccccgcccuguucgagcccgagcgcgagaaguccgccgcgaucgacggcgaguaccggcucaagggggagagccgcaagaccuucgucgagcugaugcggcgcggcgaccugccgguguggcucgcccacaagguggccuccgagggcaucaaguacacggaccggaaguggugcuucgacggggagcgcaacaaccagauccuggaggagaacauggacgucgagaucuggaccaaggagggcgagaagaagaagcugcggccccgcuggcucgacgcccggaccuacagcgacccccuggcccugaaggaguucaaggacuucgcggccgggcgcaaguccaucgcccucgaccuggugaccgagaucggccgcguccccagccaccuggcccaccggacgcgcaacgcccucgacaaccuggugaugcugcacaccuccgagcacggcgggcgggcguaccgccacgccguggaggagcucccggagaccauggagacccugcugcuccugggccugaugauccuccugaccggcggggccaugcuguuccucaucagcgggaaggggaucggcaagaccagcaucgggcugaucugcgucguggccuccagcggcaugcuguggauggccgacgugccccuccaguggaucgcguccgccaucguccuggaguucuucaugauggugcugcucauccccgagccggagaagcagcggacgccccaggacaaccagcuggccuacguggucaucgggauccugacccucgccgccaucguggcggccaacgagaugggccugcuggagacgaccaagcgcgaccucgggaugagcaaggagcccggcguggucucccccaccagcuaccuggacguggaccugcacccggccuccgccuggacccucuacgcgguggccacgaccgucaucacccccaugcugcggcacaccaucgagaacagcacggccaacgugucccuggccgccaucgcgaaccaggccgugguccucaugggccuggacaagggguggcccaucagcaagauggaccugggcgugccccuccuggcccuggggugcuacucccaggugaacccgcucacccugaccgccgccguccugcuccuggugacccacuacgcgaucaucggccccgggcugcaggccaaggccacgcgcgaggcccagaagcggaccgccgcgggcaucaugaagaaccccaccguggacggcaucaugaccaucgaccucgaccccgucaucuacgacagcaaguucgagaagcagcugggccaggugaugcugcucgugcugugcgccguccagcugcuccugaugcgcacguccugggccuucugcgaggcccugacccucgcgaccggcccgaucaccacgcugugggaggggagccccggcaaguucuggaacaccaccaucgccguguccauggccaacaucuuccggggcagcuaccuggccggggccggccucgcguucuccaucaugaaguccguggggaccggcaagcgcgggacgggcucccagggcgagacccugggggagaaguggaagaagaagcugaaccagcucagccggaaggaguucgaccuguacaagaaguccggcaucaccgaggucgaccgcaccgaggccaaggaggggcugaagcggggcgagaucacccaccacgccgugucccgcgggagcgccaagcuccagugguucguggagcggaacauggucauccccgagggccgcgugaucgaccugggcugcgggcggggcgggugguccuacuacugcgccggccugaagaaggugacggagguccgcggguacaccaagggcggccccgggcacgaggagccggugcccaugagcaccuacggcuggaacaucgugaagcucauguccgggaaggacgucuucuaccugccgcccgagaagugcgacacccugcugugcgacaucggcgagagcuccccgagccccacgguggaggagucccggaccauccgcgugcucaagauggucgagcccuggcugaagaacaaccaguucugcaucaaggugcugaaccccuacaugccgaccgugaucgagcaccucgagcgccugcagcggaagcacgggggcaugcugguccgcaacccccucagccggaacuccacccacgagauguacuggaucagcaacggcacggggaacaucguguccagcgugaacauggucucccgccugcugcucaaccgguucaccaugacccaccgccggcccaccaucgagaaggacguggaccugggcgcggggacgcgccacgugaacgccgagcccgagaccccgaacauggacgucaucggcgagcggauccgccggaucaaggaggagcacagcuccaccuggcacuacgacgacgagaaccccuacaagaccugggccuaccacggcagcuacgaggugaaggccacgggguccgccagcagcaugaucaacggcgucgugaagcugcucaccaagcccugggaccuggugccgauggucacccagauggcgaugaccgacacgacccccuucgggcagcagcgcguguucaaggagaagguggacacccggacgccccgccccaugccgggcacccggaaggucauggagaucaccgccgaguggcuguggcgcacccucgggcggaacaagcgcccccggcugugcacccgcgaggaguucaucaagaaggugcgcacgaacgccgccaugggcgcgguguucaccgaggagaaccagugggacuccgcccgggccgccgucgaggacgaggaguucuggaagcugguggaccgcgagcgggagcuccacaagcugggcaagugcgggagcugcguguacaacaugaugggcaagcgcgagaagaagcugggggaguucggcaaggccaaggggucccgggcgaucugguacauguggcucggcgcccgcuaccuggaguucgaggcccugggcuuccucaacgaggaccacugguucagccgggagaacucccacagcggggucgagggcgaggggcugcacaagcugggcuacauccuccgcgacaucuccaagauccccgggggcgccauguacgccgacgacaccgcgggcugggacacccggaucacggaggacgaccugcacaacgaggagaagaucacccagcagauggaccccgagcaccgccagcuggccaacgccaucuucaagcucaccuaccagaacaagguggugaagguccagcggccgacccccaaggggacggugauggacaucaucagccgcaaggaccagcggggcuccggccaggugggcaccuacggccugaacaccuucaccaacauggaggcccagcugauccgccagauggagggggagggcguccucagcaaggccgaccuggagaacccccaccuccuggagaagaaggugacccaguggcuggagacgaaggggguggagcggcugaagcgcauggcgaucuccggcgacgacugcgucgugaagcccaucgacgaccgguucgccaacgcccuccuggcccugaacgacauggggaaggugcgcaaggacaucccgcaguggcagcccagcaagggcuggcacgacuggcagcagguccccuucugcucccaccacuuccacgagcucaucaugaaggacggccggaagcugguggugcccugccgcccgcaggacgagcugaucgggcgggcccgcaucagccagggcgcgggguggucccuccgcgagaccgccugccugggcaaggccuacgcccagaugugggcgcugauguacuuccaccggcgcgaccuccggcuggccagcaacgccaucugcuccgccguccccgugcacugggugcccaccagccgcaccacgugguccauccacgcccaccaccaguggaugaccaccgaggacaugcugaccgucuggaaccggguguggaucgaggacaaccccuggauggaggacaagacgccggugaccaccugggaggacguccccuaccucgggaagcgcgaggaccaguggugcggcagccugaucggccugaccagccgggcgacgugggcccagaacauccucaccgccauccagcagguccgcucccugaucgggaacgaggaguuccuggacuacaugcccagcaugaagcgguuccgcaaggaggaggaguccgagggcgccaucugguga

SEQ ID NO: 10368 - RNA, 9873 nt, Artificial Sequence
  derived and/or modified CDS sequence (opt1) from DENV-3__JQ920480__SS-prME
accagccugugccucaugaugaugcugcccgccacccuggccuuccaccucaccagccgcgacggggagccccggaugaucguggggaagaacgagcgcggcaagagccugcuguucaagaccgccuccgggaucaacaugugcacccucaucgccauggaccugggggagaugugcgacgacaccgugaccuacaagugcccccugaucaccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgcggagggcgccuggcggcaggucgagaaggucgagaccugggccuuccgccaccccggguucaccauccucgcccuguuccuggcgcacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacgugaccacggacagccgcugccccacccagggcgaggcgauccugcccgaggagcaggaccagaacuacgucugcaagcacaccuacguggaccggggguggggcaacgggugcggccucuucgggaagggcucccuggugaccugcgccaaguuccagugccuggagagcaucgagggcaaggccguccagcacgagaaccucaaguacacggugaucaucaccgugcacaccggggaccagcaccaggucggcaacgagacccagggggugacggccgagaucacgccccaggccuccaccgucgaggcgauccugcccgacuacggcacccuggggcucgagugcagcccccgcaccggccuggacuucaacgagaugauccugcucacgaugaagaacaaggccuggauggugcaccggcagugguuccuggaccugccgcuccccuggaccuccggcgccaccaccgagacgcccaccuggaacaagaaggagcugcuggugaccuucaagaacgcccacgccaagaagcaggaggucguggugcucgggagccaggagggcgcgaugcacaccgcccugacgggggccaccgagauccagaccuccggcgggaccagcaucuucgccggccaccugaagugccgccucaagauggacaagcuggagcugaagggcauguccuacgccaugugccucaacgcguucguccugaagaaggaggugagcgagacgcagcacgggaccauccugaucaagguggaguacaagggcgaggacgcccccugcaagauccccuucagcaccgaggacgggcagggcaaggcccacaacggccggcugaucaccgccaaccccaucgucacgaagaaggaggagcccgugaacaucgaggcggagcccccguucggggaguccaacaucgugaucggcaucggggacaaggcccucaagaucaacugguacaagaagggcagcuccaucgggaagauguucgaggccaccgcccgcggcgcccggcgcauggcgauccugggcgacaccgccugggacuucgggagcgucggcggggugcugaacucccucggcaagauggugcaccagaucuucgggagcgccuacaccgcccuguucuccggcgucagcuggaucaugaagaucggcaucggggugcugcucacguggaucggccugaacuccaagaacaccagcauguccuucagcugcaucgugaucgggaucaucacccuguaccucggcgccgucgugcaggcggacauggggugcgugaucaacuggaagggcaaggagcugaagugcggcuccgggaucuucgucaccaacgaggugcacacguggaccgagcaguacaaguuccaggccgacagccccaagcggcuggccaccgccaucgccggcgcgugggagaacggggugugcggcauccgcuccaccacgcgcauggagaaccuccuguggaagcagaucgccaacgagcugaacuacauccucugggagaacaacaucaagcugaccaucgucgugggggacgugaucggcguccuggagcagggcaagcggacccucacgccccagcccauggagcugaaguacagcuggaagacgugggggaaggccaagaucgugaccgccgagacccagaacuccagcuucaucaucgacggcccgaacacccccgagugccccuccgcgcugcgcgccuggaacgugugggaggucgaggacuacggguucggcguguucacgaccaacaucuggcucaagcugcgggagaaguacacccagcugugcgaccaccgccucaugagcgccgccgugaaggacgagcgggccguccacgcggacaugggcuacuggaucgagagccagaagaacgaguccuggaagcuggagaaggccagccugaucgaggugaagaccugcaccuggcccaagucccacacgcucuggagcaacggggugcuggaguccgacaugaucauccccaagagccuggccggccccaucucccagcacaacuaccgccccggguaccacacccagaccgccggcccguggcaccucgggaagcuggagcuggacuucaacuacugcgagggcaccacggucgugaucaccgagaacugcggcacccgggggcccagccuccgcaccacgaccguguccggcaagcugauccacgaguggugcugccggagcugcacccugccgccccugcgcuacaugggggaggacggcugcugguacgggauggagauccggccgaucaacgagaaggaggagaacauggucaagucccuggugagcgccggcuccggcaagaccgacaacuucacgaugggggugcugugccucgcgauccuguucgaggaggucaugcgcggcaaguucgggaagaagcacaugaucgccggcgcccuguucauguucgugcuccugcugagcgggcagaucaccuggcgggacauggugcacacccucaucaugaucggcuccaacgccagcgaccgcaugggcaugggggucaccuaccuggcccugaucgcgacguucaagauccagcccuuccucgcccugggcuucuuccugcggaagcucaccucccgcgagaaccugcugcucggggugggccuggccauggccaccacccugcagcuccccgaggacaucgagcagauggcgaacggcaucgcccuggggcugauggcccucaagcugaucacgcaguucgagaccuaccagcuguggaccgcccucaucagccugaugugcagcaacaccaucuucacgcugaccguggccuggcggaccgcgacccucauccuggccgucaucucccugcuccccgugugccagagcuccagcaugcgcaagacggacuggcugccgaugaccguggccgccaugggcgugccgccccucccccucuucaucuucucccugaaggacacccugaagcggcgcagcuggccgcucaacgagggggugauggccgucggccugguguccauccuggcgagcuccuuccuccgcaacgacgugcccauggccgggccccuggucgccggcggccugcucaucgccugcuacgugaucaccgggacgagcgccgaccugaccguggagaaggcggccgacgucaccugggaggaggaggccgagcagaccggcgugucccacaaccugaugaucacgguggacgacgacgggaccaugcggaucaaggacgacgagaccgagaacauccucaccguccugcugaagaccgcccuccugaucgugagcggcaucuuccccuacuccaucccggccacgcugcucguguggcacaccuggcagaagcagacccagcgcagcgggguccugugggacgugcccagcccgcccgagacccagaaggcggagcuggaggagggcguguaccggaucaagcagcagggcaucuucgggaagacgcaggucggcgugggggugcagaaggagggcgucuuccacaccauguggcacgugacccgcggggccgugcucacccacaacggcaagcggcuggagccgaacugggccaacgucaagaaggaccugaucagcuacggcgggggcuggaagcuguccgcccaguggcagaagggggaggagguccaggugaucgcggucgagcccggcaagaaccccaagaacuuccagacgaugcccgggaucuuccagaccaccaccggcgagaucggcgccaucgcccucgacuucaagccggggacgagcggcucccccaucaucaaccgcgaggggaagguggugggccuguacggcaacggggucgugaccaagaacggcggguacgugagcggcaucgcccagaccaacgccgagcccgacgggccgacccccgagcuggaggaggagauguucaagaagcggaaccucacgaucauggaccugcaccccggcagcggcaagacccgcaaguaccugcccgcgaucguccgggaggccaucaagcgccggcuccgcacccugauccuggccccgacccgggugguggccgccgagauggaggaggcgcucaaggggcugcccauccgcuaccagacgaccgccaccaaguccgagcacaccggccgggagaucgucgaccugaugugccacgccacguucaccaugcgccuccugagccccgugcgggugcccaacuacaaccugaucgucauggacgaggcccacuucaccgacccggccuccaucgcggcccgcggguacaucagcacccgggugggcaugggggaggccgccgcgaucuucaugacggccacgccgcccggcaccgccgacgccuucccccaguccaacgccccgauccaggacgaggagcgcgacauccccgagcggagcuggaacuccggcaacgaguggaucaccgacuucgcggggaagacggugugguucguccccagcaucaaggccggcaacgacaucgccaacugccuccgcaagaacgggaagaaggugauccagcugucccgcaagaccuucgacaccgaguaccagaagaccaagcugaacgacugggacuucguggucacgaccgacaucagcgagaugggcgccaacuucaaggccgaccgggugaucgacccccgccggugccucaagccggugauccugaccgacgggcccgagcgcgucauccuggcgggccccaugcccgugaccguggccuccgccgcccagcggcgcggccgggucgggcgcaacagccagaaggagaacgaccaguacaucuucacgggccagccgcucaacaacgacgaggaccacgcccacuggaccgaggcgaagaugcugcuggacaacaucaacacccccgaggggaucauccccgcccucuucgagcccgagcgggagaaguccgccgccaucgacggcgaguaccgccugaagggggagagccggaagaccuucguggagcugaugcgccggggcgaccucccgguguggcuggcgcacaaggucgccuccgagggcaucaaguacaccgaccgcaaguggugcuucgacggggagcggaacaaccagauccuggaggagaacauggacguggagaucuggacgaaggagggcgagaagaagaagcuccgcccccgguggcuggacgcccgcaccuacagcgacccccuggcccucaaggaguucaaggacuucgccgcggggcggaaguccaucgcccuggaccuggucaccgagaucggccgcgugcccagccaccucgcccaccgcacccggaacgcccuggacaaccuggugaugcuccacacguccgagcacggcgggcgcgccuaccggcacgcggucgaggagcugccggagaccauggagacccugcuccugcugggccucaugauccugcugaccgggggcgccaugcuguuccugaucagcgggaagggcaucggcaagacgagcaucgggcugaucugcgugguggccuccagcggcaugcucuggauggccgacgucccccugcaguggaucgccuccgcgaucgugcuggaguucuucaugauggugcuccugauccccgagccggagaagcagcgcacgccccaggacaaccagcuggccuacgucgugaucgggauccucacccuggccgccaucguggccgcgaacgagaugggccugcucgagaccacgaagcgggaccuggggaugagcaaggagcccggcgucgugucccccaccagcuaccuggacguggaccuccacccggccuccgccuggacccuguacgccgucgcgaccacggugaucacccccaugcugcgccacaccaucgagaacagcaccgccaacgugucccucgccgccaucgccaaccaggcggucgugcugaugggccuggacaagggguggcccaucagcaagauggaccucggcgugccccugcuggcccucgggugcuacucccaggucaacccgcugacgcugaccgccgccgugcuccugcuggugacccacuacgccaucaucggccccgggcuccaggcgaaggccacccgggaggcccagaagcgcacggccgccggcaucaugaagaaccccaccgucgacggcaucaugaccaucgaccuggaccccgugaucuacgacagcaaguucgagaagcagcugggccaggugaugcuccugguccugugcgcggugcagcuccugcugaugcggaccuccugggccuucugcgaggcccucacgcuggccaccggcccgaucaccacccugugggaggggagccccggcaaguucuggaacacgaccaucgcgguguccauggccaacaucuuccgcggcagcuaccucgccggggccggccuggccuucuccaucaugaaguccgucgggaccggcaagcgggggaccggcucccagggcgagacgcugggggagaaguggaagaagaagcucaaccagcugagccgcaaggaguucgaccuguacaagaaguccggcaucaccgagguggaccggaccgaggcgaaggaggggcucaagcgcggcgagaucacccaccacgccgugucccgggggagcgccaagcugcagugguucgucgagcgcaacauggugauccccgagggccgggugaucgaccugggcugcgggcgcggcgggugguccuacuacugcgccggccucaagaaggucaccgaggugcggggguacacgaagggcggccccgggcacgaggagccggugcccaugagcaccuacggcuggaacaucgucaagcugauguccgggaaggacguguucuaccugccgcccgagaagugcgacacccugcucugcgacaucggcgagagcuccccgagccccaccguggaggagucccgcacgauccggguccugaagaugguggagcccuggcugaagaacaaccaguucugcaucaaggugcucaaccccuacaugccgaccgucaucgagcaccuggagcgccugcagcgcaagcacgggggcaugcucgugcggaacccccugagccgcaacuccacccacgagauguacuggaucagcaacggcaccgggaacaucguguccagcgucaacauggugucccggcugcuccugaaccgcuucacgaugacccaccggcgccccaccaucgagaaggacguggaccugggcgccgggacccggcacgucaacgcggagcccgagacgccgaacauggacgugaucggcgagcgcauccggcgcaucaaggaggagcacagcuccaccuggcacuacgacgacgagaaccccuacaagaccugggccuaccacggcagcuacgaggucaaggccaccggguccgccagcagcaugaucaacggcguggugaagcuccugacgaagcccugggacgucgugccgauggugacccagauggccaugaccgacaccacgcccuucgggcagcagcgggucuucaaggagaagguggacacccgcacgccccggcccaugccgggcacccgcaaggugauggagaucaccgcggaguggcuguggcggacccucgggcgcaacaagcggccccgccugugcacccgggaggaguucaucaagaagguccgcaccaacgccgccaugggcgccguguucacggaggagaaccagugggacuccgcgcgcgccgccguggaggacgaggaguucuggaagcuggucgaccgggagcgcgagcuccacaagcugggcaagugcgggagcugcguguacaacaugaugggcaagcgggagaagaagcugggggaguucggcaaggccaaggggucccgcgccaucugguacauguggcucggcgcgcgguaccuggaguucgaggcccugggcuuccucaacgaggaccacugguucagccgcgagaacucccacagcgggguggagggcgaggggcugcacaagcugggcuacauccuccgggacaucuccaagauccccgggggcgccauguacgccgacgacaccgccggcugggacacccgcaucaccgaggacgaccugcacaacgaggagaagaucacgcagcagauggaccccgagcaccggcagcuggcgaacgccaucuucaagcucaccuaccagaacaaggucgugaaggugcagcgcccgacccccaaggggaccgucauggacaucaucagccggaaggaccagcgcggcuccggccaggugggcacguacggccugaacaccuucaccaacauggaggcccagcugauccggcagauggagggggagggcgugcucagcaaggccgaccuggagaacccccaccuccucgagaagaaggucacccaguggcuggagaccaaggggguggagcgccugaagcggauggccaucuccggcgacgacugcguggucaagcccaucgacgaccgcuucgcgaacgcccuccuggcccugaacgacauggggaaggugcggaaggacaucccgcaguggcagcccagcaagggcuggcacgacuggcagcagguccccuucugcucccaccacuuccacgagcucaucaugaaggacggccgcaagcuggucgugcccugccggccgcaggacgagcugaucgggcgcgcccggaucagccagggcgccggguggucccuccgcgagacggcgugccugggcaaggccuacgcccagaugugggcccugauguacuuccaccgccgggaccuccgccuggcgagcaacgccaucugcuccgccgugcccguccacugggugcccaccagccggaccaccugguccauccacgcccaccaccaguggaugacgaccgaggacaugcugaccguguggaaccgcgucuggaucgaggacaaccccuggauggaggacaagaccccggugacgaccugggaggacgugcccuaccucgggaagcgggaggaccaguggugcggcagccugaucggccugaccagccgcgccaccugggcgcagaacauccucacggccauccagcagguccggucccugaucgggaacgaggaguuccuggacuacaugcccagcaugaagcgcuuccggaaggaggaggaguccgagggcgccaucugguga

SEQ ID NO: 10369 - RNA, 9873 nt, Artificial Sequence
  derived and/or modified CDS sequence (opt1) from DENV-3__JQ920479__SS-prME
accagccugugccucaugaugaugcugcccgccacccuggccuuccaccucaccagccgcgacggggagccccggaugaucguggggaagaacgagcgcggcaagagccugcuguucaagaccgccuccgggaucaacaugugcacccucaucgccauggaccugggggagaugugcgacgacaccgugaccuacaagugcccccugaucaccgagguggagcccgaggacaucgacugcuggugcaaccucaccagcaccugggugacguacgggaccugcaaccaggccggcgagcaccggcgcgacaagcgguccguggcccuggcgccccacgugggcauggggcuggacacccgcacccagacguggaugagcgcggagggcgccuggcggcaggucgagaaggucgagaccugggccuuccgccaccccggguucaccauccucgcccuguuccuggcgcacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacgugaccacggacagccgcugccccacccagggcgaggcgauccugcccgaggagcaggaccagaacuacgucugcaagcacaccuacguggaccggggguggggcaacgggugcggccucuucgggaagggcucccuggugaccugcgccaaguuccagugccuggagagcaucgagggcaaggccguccagcacgagaaccucaaguacacggugaucaucaccgugcacaccggggaccagcaccaggucggcaacgagacccagggggugacggccgagaucacgccccaggccuccaccgucgaggcgauccugcccgaguacggcacccuggggcucgagugcagcccccgcaccggccuggacuucaacgagaugauccugcucacgaugaagaacaaggccuggauggugcaccggcagugguuccuggaccugccgcuccccuggaccuccggcgccaccaccgagacgcccaccuggaacaagaaggagcugcuggugaccuucaagaacgcccacgccaagaagcaggaggucguggugcucgggagccaggagggcgcgaugcacaccgcccugacgggggccaccgagauccagaccuccggcgggaccagcaucuucgccggccaccugaagugccgccucaagauggacaagcuggagcugaagggcauguccuacgccaugugccucaacgcguucguccugaagaaggaggugagcgagacgcagcacgggaccauccugaucaagguggaguacaagggcgaggacgcccccugcaagauccccuucagcaccgaggacgggcagggcaaggcccacaacggccggcugaucaccgccaaccccaucgucacgaagaaggaggagcccgugaacaucgaggcggagcccccguucggggaguccaacaucgugaucggcaucggggacaaggcccucaagaucaacugguacaagaagggcagcuccaucgggaagauguucgaggccaccgcccgcggcgcccggcgcauggcgauccugggcgacaccgccugggacuucgggagcgucggcggggugcugaacucccucggcaagauggugcaccagaucuucgggagcgccuacaccgcccuguucuccggcgucagcuggaucaugaagaucggcaucggggugcugcucacguggaucggccugaacuccaagaacaccagcauguccuucagcugcaucgugaucgggaucaucacccuguaccucggcgccgucgugcaggcggacauggggugcgugaucaacuggaagggcaaggagcugaagugcggcuccgggaucuucgucaccaacgaggugcacacguggaccgagcaguacaaguuccaggccgacagccccaagcggcuggccaccgccaucgccggcgcgugggagaacggggugugcggcauccgcuccaccacgcgcauggagaaccuccuguggaagcagaucgccaacgagcugaacuacauccucugggagaacaacaucaagcugaccaucgucgugggggacgugaucggcguccuggagcagggcaagcggacccucacgccccagcccauggagcugaaguacagcuggaagacgugggggaaggccaagaucgugaccgccgagacccagaacuccagcuucaucaucgacggcccgaacacccccgagugccccuccgcgcugcgcgccuggaacgugugggaggucgaggacuacggguucggcguguucacgaccaacaucuggcucaagcugcgggagaaguacacccagcugugcgaccaccgccucaugagcgccgccgugaaggacgagcgggccguccacgcggacaugggcuacuggaucgagagccagaagaacgaguccuggaagcuggagaaggccagccugaucgaggugaagaccugcaccuggcccaagucccacacgcucuggagcaacggggugcuggaguccgacaugaucauccccaagagccuggccggccccaucucccagcacaacuaccgccccggguaccacacccagaccgccggcccguggcaccucgggaagcuggagcuggacuucaacuacugcgagggcaccacggucgugaucaccgagaacugcggcauccgggggcccagccuccgcaccaccacgguguccggcaagcugauccacgaguggugcugccggagcugcacccugccgccccugcgcuacaugggggaggacggcugcugguacgggauggagauccggccgaucaacgagaaggaggagaacauggucaagucccuggugagcgccggcuccggcaagaccgacaacuucaccaugggggugcugugccucgcgauccuguucgaggaggucaugcgcggcaaguucgggaagaagcacaugaucgccggcgcccuguucauguucgugcuccugcugagcgggcagaucacguggcgggacauggugcacacccucaucaugaucggcuccaacgccagcgaccgcaugggcaugggggucaccuaccuggcccugaucgcgaccuucaagauccagcccuuccucgcccugggcuucuuccugcggaagcucacgucccgcgagaaccugcugcucggggugggccuggccauggccaccacccugcagcuccccgaggacaucgagcagauggcgaacggcaucgcccuggggcugauggcccucaagcugaucacccaguucgagacguaccagcuguggaccgcccucaucagccugaugugcagcaacaccaucuucacccugacgguggccuggcggaccgcgacccucauccuggccgucaucucccugcuccccgugugccagagcuccagcaugcgcaagaccgacuggcugccgaugacgguggccgccaugggcgugccgccccucccccucuucaucuucucccugaaggacacccugaagcggcgcagcuggccgcucaacgagggggugauggccgucggccugguguccauccuggcgagcuccuuccuccgcaacgacgugcccauggccgggccccuggucgccggcggccugcucaucgccugcuacgugaucaccgggaccagcgccgaccugacgguggagaaggcggccgacgucaccugggaggaggaggccgagcagaccggcgugucccacaaccugaugaucaccguggacgacgacgggacgaugcggaucaaggacgacgagaccgagaacauccucaccguccugcugaagaccgcccuccugaucgugagcggcaucuuccccuacuccaucccggccacccugcucguguggcacacguggcagaagcagacccagcgcagcgggguccugugggacgugcccagcccgcccgagacccagaaggcggagcuggaggagggcguguaccggaucaagcagcagggcaucuucgggaagacccaggucggcgugggggugcagaaggagggcgucuuccacacgauguggcacgugacccgcggggccgugcucacccacaacggcaagcggcuggagccgaacugggccaacgucaagaaggaccugaucagcuacggcgggggcuggaagcuguccgcccaguggcagaagggggaggagguccaggugaucgcggucgagcccggcaagaaccccaagaacuuccagaccaugcccgggaucuuccagacgaccaccggcgagaucggcgccaucgcccucgacuucaagccggggaccagcggcucccccaucaucaaccgcgaggggaagguggugggccuguacggcaacggggucgugacgaagaacggcggguacgugagcggcaucgcccagaccaacgccgagcccgacgggccgacccccgagcuggaggaggagauguucaagaagcggaaccucaccaucauggaccugcaccccggcagcggcaagacgcgcaaguaccugcccgcgaucguccgggaggccaucaagcgccggcuccgcacccugauccuggccccgacccgggugguggccgccgagauggaggaggcgcucaaggggcugcccauccgcuaccagaccacggccaccaaguccgagcacaccggccgggagaucgucgaccugaugugccacgccaccuucacgaugcgccuccugagccccgugcgggugcccaacuacaaccugaucgucauggacgaggcccacuucaccgacccggccuccaucgcggcccgcggguacaucagcacccgggugggcaugggggaggccgccgcgaucuucaugaccgccacgccgcccggcaccgccgacgccuucccccaguccaacgccccgauccaggacgaggagcgcgacauccccgagcggagcuggaacuccggcaacgaguggaucaccgacuucgcggggaagaccgugugguucguccccagcaucaaggccggcaacgacaucgccaacugccuccgcaagaacgggaagaaggugauccagcugucccgcaagacguucgacaccgaguaccagaagaccaagcugaacgacugggacuucguggucaccacggacaucagcgagaugggcgccaacuucaaggccgaccgggugaucgacccccgccggugccucaagccggugauccugaccgacgggcccgagcgcgucauccuggcgggccccaugcccgugaccguggccuccgccgcccagcggcgcggccgggucgggcgcaacagccagaaggagaacgaccaguacaucuucaccggccagccgcucaacaacgacgaggaccacgcccacuggacggaggcgaagaugcugcuggacaacaucaacacccccgaggggaucauccccgcccucuucgagcccgagcgggagaaguccgccgccaucgacggcgaguaccgccugaagggggagagccggaagaccuucguggagcugaugcgccggggcgaccucccgguguggcuggcgcacaaggucgccuccgagggcaucaaguacaccgaccgcaaguggugcuucgacggggagcggaacaaccagauccuggaggagaacauggacguggagaucuggaccaaggagggcgagaagaagaagcuccgcccccgguggcuggacgcccgcacguacagcgacccccuggcccucaaggaguucaaggacuucgccgcggggcggaaguccaucgcccuggaccuggucaccgagaucggccgcgugcccagccaccucgcccaccgcacccggaacgcccuggacaaccuggugaugcuccacaccuccgagcacggcgggcgcgccuaccggcacgcggucgaggagcugccggagacgauggagacccugcuccugcugggccucaugauccugcugaccgggggcgccaugcuguuccugaucagcgggaagggcaucggcaagaccagcaucgggcugaucugcgugguggccuccagcggcaugcucuggauggccgacgucccccugcaguggaucgccuccgcgaucgugcuggaguucuucaugauggugcuccugauccccgagccggagaagcagcgcacgccccaggacaaccagcuggccuacgucgugaucgggauccucacccuggccgccaucguggccgcgaacgagaugggccugcucgagaccaccaagcgggaccuggggaugagcaaggagcccggcgucgugucccccacgagcuaccuggacguggaccuccacccggccuccgccuggacccuguacgccgucgcgaccaccgugaucacgcccaugcugcgccacaccaucgagaacagcaccgccaacgugucccucgccgccaucgccaaccaggcggucgugcugaugggccuggacaagggguggcccaucagcaagauggaccucggcgugccccugcuggcccucgggugcuacucccaggucaacccgcugacccugacggccgccgugcuccugcuggugacccacuacgccaucaucggccccgggcuccaggcgaaggccacccgggaggcccagaagcgcaccgccgccggcaucaugaagaaccccacggucgacggcaucaugaccaucgaccuggaccccgugaucuacgacagcaaguucgagaagcagcugggccaggugaugcuccugguccugugcgcggugcagcuccugcugaugcggaccuccugggccuucugcgaggcccucacccuggccacgggcccgaucaccacccugugggaggggagccccggcaaguucuggaacaccacgaucgcgguguccauggccaacaucuuccgcggcagcuaccucgccggggccggccuggccuucuccaucaugaaguccgucgggaccggcaagcgggggaccggcucccagggcgagacccugggggagaaguggaagaagaagcucaaccagcugagccgcaaggaguucgaccuguacaagaaguccggcaucacggagguggaccggaccgaggcgaaggaggggcucaagcgcggcgagaucacccaccacgccgugucccgggggagcgccaagcugcagugguucgucgagcgcaacauggugauccccgagggccgggugaucgaccugggcugcgggcgcggcgggugguccuacuacagcgccggccucaagaaggucaccgaggugcggggguacaccaagggcggccccgggcacgaggagccggugcccauguccacguacggcuggaacaucgucaagcugaugagcgggaaggacguguucuaccugccgcccgagaagugcgacacccugcucugcgacaucggcgaguccagcccgucccccaccguggaggagagccgcaccauccggguccugaagaugguggagcccuggcugaagaacaaccaguucugcaucaaggugcucaaccccuacaugccgacggucaucgagcaccuggagcgccugcagcgcaagcacgggggcaugcucgugcggaacccccugucccgcaacagcacccacgagauguacuggaucuccaacggcaccgggaacaucgugagcuccgucaacauggugagccggcugcuccugaaccgcuucaccaugacgcaccggcgccccaccaucgagaaggacguggaccugggcgccgggacccggcacgucaacgcggagcccgagaccccgaacauggacgugaucggcgagcgcauccggcgcaucaaggaggagcacuccagcacguggcacuacgacgacgagaaccccuacaagaccugggccuaccacggcuccuacgaggucaaggccaccgggagcgccagcuccaugaucaacggcguggugaagcuccugaccaagcccugggacgucgugccgauggugacgcagauggccaugaccgacaccacccccuucgggcagcagcgggucuucaaggagaagguggacacgcgcacgccccggcccaugccgggcacccgcaaggugauggagaucaccgcggaguggcuguggcggacccucgggcgcaacaagcggccccgccugugcacccgggaggaguucaucaagaagguccgcaccaacgccgccaugggcgccguguucaccgaggagaaccagugggacagcgcgcgcgccgccguggaggacgaggaguucuggaagcuggucgaccgggagcgcgagcuccacaagcugggcaagugcggguccugcguguacaacaugaugggcaagcgggagaagaagcugggggaguucggcaaggccaaggggagccgcgccaucugguacauguggcucggcgcgcgguaccuggaguucgaggcccugggcuuccucaacgaggaccacugguucucccgcgagaacagccacuccgggguggagggcgaggggcugcacaagcugggcuacauccuccgggacaucagcaagauccccgggggcgccauguacgccgacgacacggccggcugggacacccgcaucaccgaggacgaccugcacaacgaggagaagaucacccagcagauggaccccgagcaccggcagcuggcgaacgccaucuucaagcucacguaccagaacaaggucgugaaggugcagcgcccgacccccaaggggaccgucauggacaucaucucccggaaggaccagcgcggcagcggccaggugggcaccuacggccugaacacguucaccaacauggaggcccagcugauccggcagauggagggggagggcgugcucuccaaggccgaccuggagaacccccaccuccucgagaagaaggucacccaguggcuggagaccaaggggguggagcgccugaagcggauggccaucagcggcgacgacugcguggucaagcccaucgacgaccgcuucgcgaacgcccuccuggcccugaacgacauggggaaggugcggaaggacaucccgcaguggcagcccuccaagggcuggcacgacuggcagcagguccccuucugcagccaccacuuccacgagcucaucaugaaggacggccgcaagcuggucgugcccugccggccgcaggacgagcugaucgggcgcgcccggaucucccagggcgccggguggagccuccgcgagaccgcgugccugggcaaggccuacgcccagaugugggcccugauguacuuccaccgccgggaccuccgccuggcguccaacgccaucugcagcgccgugcccguccacugggugcccacgucccggaccaccuggagcauccacgcccaccaccaguggaugaccacggaggacaugcugaccguguggaaccgcgucuggaucgaggacaaccccuggauggaggacaagaccccggugaccacgugggaggacgugcccuaccucgggaagcgggaggaccaguggugcggcagccugaucggccugaccucccgcgccaccugggcgcagaacauccucaccgccauccagcagguccggagccugaucgggaacgaggaguuccuggacuacaugcccuccaugaagcgcuuccggaaggaggaggagagcgagggcgccaucugguga

SEQ ID NO: 10370 - RNA, 9873 nt, Artificial Sequence
  derived and/or modified CDS sequence (opt1) from DENV-3__KU216208__SS-prME
accagccugugccucaugaugauccugcccgccgcccuggcguuccaccucaccagccgggacggggagccccggaugaucguggggaagaacgagcggggcaagagccugcuguucaagaccgccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggaucgacguggugcuggagcacggcgggugcgucaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgugugcaagcacgccuacgucgaccggggguggggcaacgggugcggccucuucgggaagggcucccuggugaccugcgccaaguuccagugccuggagcccaucgagggcaaggugguccaguacgagaaccucaaguacaccgugaucaucaccgugcacacgggggaccagcaccaggucggcaacgagacccagggggugaccgccgagaucacgccccaggcgagcacgaccgaggccauccugcccgaguacggcacccuggggcucgagugcuccccgcgcaccggccuggacuucaacgagaugauccugcucaccaugaagaacaaggccuggaugguccaccggcagugguucuucgaccugccccugcccuggacgagcggcgccaccaccgagacccccacguggaaccgcaaggagcuccuggugaccuucaagaacgcccacgcgaagaagcaggagguggucgugcuggggucccaggagggcgccaugcacaccgcccucaccggggccacggagauccagaacagcggcgggaccuccaucuucgccggccaccugaagugccggcugaagauggacaagcucgagcugaagggcaugagcuacgcgaugugcaccaacaccuucgugcugaagaaggaggucuccgagacgcagcacgggaccauccucaucaagguggaguacaagggcgaggacgccccgugcaagauccccuucagcaccgaggacgggcagggcaaggcccacaacggccgccugaucaccgccaaccccguggucacgaagaaggaggagcccgugaacaucgaggcggagccgcccuucggggagagcaacaucgugaucggcaucggggacaacgcccugaagaucaacugguacaagaagggcuccagcaucgggaagauguucgaggccaccgcccggggcgcccgccggauggcgauccugggcgacaccgccugggacuucggguccgucggcggggugcucaacagccugggcaagauggugcaccagaucuucggguccgccuacaccgcccuguucagcggcgucuccugggugaugaagaucggcaucggggugcuccugacguggaucggccugaacagcaagaacaccuccaugagcuucuccugcaucgccaucgggaucaucacccucuaccugggcgcggucgugcaggccgacauggggugcguggucaacuggaagggcaaggagcugaagugcggcagcgggaucuucgugaccaacgaggugcacacguggaccgagcaguacaaguuccaggccgacucccccaagcgccucgccaccgccaucgcgggcgccugggagaacggggucugcggcauccgcagcaccacgcggauggagaaccugcuguggaagcagaucgccaacgagcucaacuacauccugugggagaacaacaucaagcugaccgugguggucggggacaccaucggcgugcucgagcagggcaagcgcacccugacgccccagccgauggagcugaaguacuccuggaagaccugggggaaggccaagaucgugaccgcggagacccagaacagcuccuucaucaucgacggccccaacacgcccgagugccccagcgccucccgggccuggaacgucugggagguggaggacuacggguucggcguguucaccaccaacaucuggcucaagcugcgcgaggucuacacccagaugugcgaccaccggcugaugagcgccgccgugaaggacgagcgcgcggugcacgccgacaugggcuacuggaucgagagccagaagaacggguccuggaagcucgagaaggccagccugaucgaggucaagaccugcacguggccgaagucccacacccuguggagcaacggcgugcucgaguccgacaugaucauccccaagagccuggccgggcccaucucccagcacaacuaccggccgggcuaccacacccagaccgccgggcccuggcaccugggcaagcucgagcuggacuucaacuacugcgagggcacgaccguggucaucaccgagaacugcgggacccgcggccccagccugcggacgaccaccguguccgggaagcucauccacgaguggugcugccgcagcugcacccugcccccgcugcgguacaugggcgaggacgggugcugguacggcauggagauccgccccaucuccgagaaggaggagaacauggucaagagccucgucuccgcgggcagcgggaagguggacaacuucacgaugggcgugcugugccuggccauccucuucgaggaggucaugcgggggaaguucggcaagaagcacaugaucgccgggguguucuucaccuucgugcugcugcucuccggccagaucaccuggcgcgacauggcccacacccugaucaugaucggcagcaacgccuccgaccggauggggaugggcgucacguaccuggcgcucaucgccaccuucaagauccagcccuuccuggcccugggguucuuccuccgcaagcugaccagccgggagaaccugcuccugggcgugggccuggccauggcgaccacgcuccagcugcccgaggacaucgagcagauggccaacgggaucgcccugggccucauggcccugaagcugaucacccaguucgagaccuaccagcucuggaccgcccugaucagccugacgugcuccaacaccaucuucacccucaccguggcguggcgcacggccacccugauccuggccggggucagccuccugccggugugccaguccagcuccaugcggaagaccgacuggcugcccaugaccgucgccgccaugggcgugccgccccucccgcuguucaucuucagccugaaggacacgcucaagcgccgcuccuggccccugaacgagggggugauggcggucggccuggugagcauccucgccuccagccugcugcggaacgacgugcccauggccggcccccucgucgccgggggccugcugaucgccugcuacgugaucaccgggaccuccgcggaccucaccguggagaaggccgccgacgucacgugggaggaggaggccgagcagaccggcgugagccacaaccugaugaucaccguggacgacgacgggaccaugcgcaucaaggacgacgagaccgagaacauccugacgguccuccugaagaccgcccugcucaucguguccggcaucuucccguacagcauccccgcgacccugcugguguggcacaccuggcagaagcagacgcagcgguccggcguccucugggacgugcccagcccgcccgagacccagaaggccgagcuggaggaggggguguaccgcaucaagcagcagggcauccuggggaagacccaggucggcgugggggugcagaaggagggcgucuuccacaccauguggcacgugacgcggggcgccgugcucacccacaacgggaagcgccuggagcccaacugggccuccgucaagaaggaccugaucagcuacggcgggggcuggcggcucuccgcgcaguggcagaagggggaggagguccaggugaucgccgucgagcccggcaagaaccccaagaacuuccagaccaugcccggcaccuuccagacgaccaccggggagaucggcgccaucgcccuggacuucaagcccgggaccagcggcagccccaucaucaaccgcgagggcaaggugguggggcuguacggcaacggggucgugacgaagaacggcggguacguguccggcaucgcccagaccaacgcggagccggacggccccacccccgagcuggaggaggagauguucaagaagcggaaccucaccaucauggaccugcaccccgggagcggcaagacgcgcaaguaccugccggccaucguccgggaggccaucaagcgccggcuccgcacccugauccuggcccccacccgggugguggccgcggagauggaggaggcccucaaggggcugcccauccgcuaccagaccacggccaccaaguccgagcacaccggccgggagaucgucgaccugaugugccacgccaccuucacgaugcgccuccugagccccgugcgggugccgaacuacaaccugaucaucauggacgaggcccacuucaccgaccccgcguccaucgccgcccgcggguacaucagcacccgggucggcaugggcgaggccgcggccaucuucaugaccgccacgccgcccgggaccgccgacgccuucccgcaguccaacgcgcccauccaggacgaggagcgcgacauccccgagcgcagcuggaacuccggcaacgaguggaucaccgacuucgccgggaagaccgugugguucgugcccagcaucaaggccggcaacgacaucgccaacugccuccggaagaacgggaagaaggucauccagcugucccgcaagacguucgagaccgaguaccagaagaccaagcugaacgacugggacuucguggugaccacggacaucagcgagaugggcgccaacuucaaggcggaccgggucaucgacccgcgccggugccucaagcccgugauccugaccgacggccccgagcgcgugauccuggccgggcccaugccggucaccgccgccuccgccgcgcagcggcgcggccggguggggcgcaacccccagaaggagaacgaccaguacaucuucaccggccagccccucaacaacgacgaggaccacgcccacuggaccgaggccaagaugcugcuggacaacaucaacacgcccgaggggaucaucccggcccucuucgagcccgagcgggagaaguccgcggccaucgacggcgaguaccgccugaagggcgagucccggaagaccuucguggagcugaugcgccgcggggaccuccccgucuggcuggccuacaagguggccagcgagggcaucaaguacaccgaccgcaaguggugcuucgacgggcagcggaacaaccagauccuggaggagaacauggacgucgagaucuggaccaaggagggcgagaagaagaagcuccgcccccgguggcuggacgcccgcacguacuccgacccgcuggcgcucaaggaguucaaggacuucgccgccggccgcaagagcaucgcccuggaccuggugaccgagaucgggcgggugcccucccaccucgcccaccgcacccggaacgcgcuggacaaccuggucaugcuccacaccagcgagcacggcgggcgcgccuaccggcacgccguggaggagcugcccgagacgauggagacccugcuccugcugggccucaugauccugcugaccgggggcgccaugcuguuccugaucagcggcaaggggaucggcaagaccuccaucgggcugaucugcgugaucgccagcuccggcaugcucuggauggcggagaucccgcugcaguggaucgccagcgccaucguccuggaguucuucaugauggugcuccugauccccgagcccgagaagcagcgcacgccccaggacaaccagcuggccuacguggucaucgggauccucacccuggccgcgaucaucgccgccaacgagaugggccugcucgagaccaccaagcgggaccugggcauguccaaggagccggggguggugagccccacguccuaccuggacgucgaccuccaccccgccagcgcguggacccuguacgccguggccaccaccgugaucacgcccaugcugcgccacaccaucgagaacuccaccgccaacgucagccucgccgcgaucgccaaccaggccguggugcugaugggccuggacaagggguggccgaucuccaagauggaccucggcgucccccugcuggcccucgggugcuacagccaggugaacccccugacccugacggccgcggugcuccugcugaucacccacuacgccaucaucggccccggccuccaggccaaggccacccgggaggcccagaagcgcaccgcggccgggaucaugaagaacccgacggucgacggcaucaucaccaucgaccuggaccccgugaucuacgacuccaaguucgagaagcagcugggccaggugaugcuccugguccugugcgccgugcagcuccugcugaugcggaccagcugggcccucugcgaggcgcugacccuggccacgggccccaucaccacccucugggagggcucccccgggaaguucuggaacaccacgaucgccgugagcauggccaacaucuuccgcggcuccuaccuggccggggcgggccuggccuucagcaucaugaaguccgucgggaccggcaagcggggcaccgggagccagggcgagacccucggggagaaguggaagaagaagcugaaccagcugagccgcaaggaguucgaccucuacaagaaguccggcaucaccgagguggaccggacggaggccaaggaggggcugaagcgcggcgagaccacccaccacgccgugagccggggcuccgccaagcugcagugguucgucgagcgcaacauggugaucccggaggggcgggugaucgaccucggcugcgggcgcggcggguggagcuacuacugcgcgggccugaagaaggucaccgaggugcggggcuacacgaagggcgggcccgggcacgaggagcccgugcccauggccaccuacggcuggaacaucgucaagcugauguccgggaaggacguguucuaccucccgcccgagaagugcgacacccugcugugcgacaucggcgagagcucccccagccccaccguggaggagucccgcacgauccgcguccugaagaugguggagccguggcucaagaacaaccaguucugcaucaaggugcugaaccccuacaugcccgccgucaucgagcaccuggagcggcuccagcgcaagcacggcgggaugcuggugcggaacccccugagccgcaacuccacccacgagauguacuggaucagcaacggcaccgggaacaucguguccagcgucaacauggugucccggcuccugcugaaccgcuucaccaugacgcaccggcgcccgaccaucgagaaggacguggaccucggcgccggcacccggcacgucaacgccgagcccgagacccccaacauggacgugaucggggagcgcaucaagcggaucaaggaggagcacaacagcacguggcacuacgacgacgagaacccguacaagaccugggcguaccacggcuccuacgaggugaaggccaccgggagcgccuccagcaugaucaacggcgucgugaagcugcugaccaagcccugggacgucgugcccauggugacgcagauggccaugaccgacaccacccccuucgggcagcagcgcgucuucaaggagaagguggacacgcggaccccgcgccccaugcccggcacccggaaggugauggagaucaccgcggaguggcucuggcgcacgcugggccggaacaagcgcccccggcugugcacccgcgaggaguucaccaagaagguccgcaccaacgccgccaugggggccguguucacggaggagaaccagugggacagcgccaaggcggccguggaggacgaggaguucuggaagcucgucgaccgggagcgcgagcugcacaagcugggcaagugcggguccugcguguacaacaugaugggcaagcgggagaagaagcucggggaguucggcaaggccaagggcagccgcgccaucugguacauguggcugggggcccgguaccuggaguucgaggcgcucggcuuccugaacgaggaccacugguucucccgcgagaacagcuacuccgggguggagggcgaggggcugcacaagcucggcuacauccugcgggacaucagcaagaucccgggcggggccauguacgccgacgacaccgccggcugggacacccgcaucaccgaggacgaccugcacaacgaggagaagaucacgcagcagauggaccccgagcaccggcuccuggccaacgcgaucuucaagcugaccuaccagaacaaggucgugaaggugcagcgccccacccccaccgggaccgucauggacaucaucucccggaaggaccagcgcggcagcggccagguggggacguacggccucaacaccuucaccaacauggaggcccagcuggugcggcagauggagggggagggcguccuguccaaggccgaccucgagaacccgcaccuccccgagaagaagaucacccaguggcuggagacgaaggggguggagcgccucaagcggauggccaucagcggcgacgacugcguggucaagcccaucgacgaccgcuucgccaacgcgcugcuggcccucaacgacaugggcaaggugcggaaggacaucccccaguggcagccguccaagggguggcacgacuggcagcagguccccuucugcagccaccacuuccacgagcugaucaugaaggacggccgcaagcuggucgugcccugccggccccaggacgagcucaucgggcgcgcccggaucucccagggcgccggguggagccugcgcgagaccgcgugccugggcaaggccuacgcccagauguggucccucauguacuuccaccgccgggaccugcgccuggccagcaacgccaucugcuccgcggugccgguccacugggugcccaccagccggaccacgugguccauccacgcccaccaccaguggaugaccaccgaggacaugcucaccguguggaaccgcgucuggaucgaggacaaccccuggauggaggacaagacgcccgugaccaccugggagaacgugccguaccugggcaagcgggaggaccaguggugcgggagccugaucggccucaccagccgcgccacgugggcccagaacauccccaccgccauccagcagguccggucccugaucgggaacgaggaguuccuggacuacaugcccagcaugaagcgcuuccggaaggaggaggaguccgagggcgcgaucugguga

SEQ ID NO: 10371 - RNA, 9873 nt, Artificial Sequence
  derived and/or modified CDS sequence (opt1) from DENV-3__GU370053__SS-prME
accagccucugccucaugaugauccugcccgcggcccuggcguuccaccucaccagccgggacggcgagccccggaugaucguggggaagaacgagcggggcaagagccugcuguucaagacggccuccgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccugggccagcggcgccaccaccgagacccccacguggaaccgcaaggagcuccuggugaccuucaagaacgcccacgcgaagaagcaggaggucguggugcuggggucccaggagggcgccaugcacaccgcccucaccggggccacggagauccagaacagcggcgggaccuccaucuucgccggccaccugaagugccggcugaagauggacaagcucgagcugaagggcaugagcuacgcgaugugcaccaacaccuucguccugaagaaggagguguccgagacgcagcacgggaccauccucaucaagguggaguacaagggcgaggacgccccgugcaagauccccuucagcaccgaggacgggcagggcaaggcccacaacggccgccugaucaccgccaaccccgucgugacgaagaaggaggagcccgugaacaucgaggcggagccgcccuucggggagagcaacaucgucaucggcaucggggacaacgcccugaagaucaacugguacaagaagggcuccagcaucgggaagauguucgaggccaccgcccggggcgcccgccggauggcgauccugggcgacaccgccugggacuucggguccgugggcggggugcucaacagccugggcaagaugguccaccagaucuucggguccgccuacaccgcccuguucagcggcguguccugggugaugaagaucggcaucgggguccuccugacguggaucggccugaacagcaagaacaccuccaugagcuucuccugcaucgccaucgggaucaucacccucuaccugggcgcgguggugcaggccgacauggggugcgucaucaacuggaagggcaaggagcugaagugcggcagcgggaucuucgugaccaacgaggugcacacguggaccgagcaguacaaguuccaggccgacucccccaagcgccucgccaccgccaucgcgggcgccugggagaacggggucugcggcauccgcagcaccacgcggauggagaaccugcuguggaagcagaucgccaacgagcucaacuacauccugugggagaacaacaucaagcugaccgugguggucggggacaccaucggcgugcucgagcagggcaagcgcacccugacgccccagccgauggagcugaaguacuccuggaagaccugggggaaggccaagaucgugaccgcggagauccagaacagcuccuucaucaucgacggccccaacacccccgagugccccagcgccucccgggccuggaacgucugggagguggaggacuacggguucggcguguucacgaccaacaucuggcucaagcugcgcgaggucuacacccagcugugcgaccaccggcucaugagcgccgccgugaaggacgagcgcgcggugcacgccgacaugggcuacuggaucgagagccagaagaacggguccuggaagcuggagaaggccagccugaucgaggucaagaccugcaccuggccgaagucccacacgcucuggagcaacggcgugcuggaguccgacaugaucauccccaagagccuggccgggcccaucucccagcacaacuaccggccgggcuaccacacccagaccgccgggcccuggcaccucggcaagcuggagcuggacuucaacuacugcgagggcaccacgguggucaucaccgagagcugcgggacccgcggccccucccuccggaccacgaccgugagcgggaagcugauccacgaguggugcugccgcuccugcacccugcccccgcuccgguacaugggcgaggacgggugcugguacggcauggagauccgccccaucagcgagaaggaggagaacauggugaagucccuggucagcgcgggcuccgggaagguggacaacuucaccaugggcgugcugugccucgccauccuguacgaggaggucaugcgggggaaguucggcaagaagcacaugaucgccgggguguucuucacguucgugcugcuccugagcggccagaucaccuggcgcgacauggcccacacccugaucaugaucggcuccaacgccagcgaccggauggggaugggcgucaccuaccucgcgcugaucgccacguucaagauccagcccuuccuggcccucggguucuuccugcgcaagcugaccagccgggagaaccuccugcugggcgugggccucgccauggcgaccacccugcagcugcccgaggacaucgagcagauggccaacgggaucgcccucggccugauggcccugaagcucaucacgcaguucgagaccuaccagcuguggaccgcccuggugucccugaccugcagcaacacgaucuucacccugaccgucgcguggcgcaccgccacgcugauccucgccggggugucccugcugccggucugccagagcuccagcaugcggaagaccgacuggcuccccauggccguggccgcgaugggcgugccgccccucccgcuguucaucuucucccucaaggacacccugaagcgccgcagcuggccccugaacgagggggucauggccgugggccucguguccauccuggccagcucccugcuccggaacgacguccccauggccggcccccugguggccgggggccugcucaucgcgugcuacgugaucaccgggacgagcgccgaccugaccgucgagaaggccgccgacgugaccugggaggaggaggccgagcagaccggcgugucccacaaccugaugaucacggucgacgacgacgggaccaugcgcaucaaggacgacgagaccgagaacauccucaccgugcugcugaagaccgcgcuccugaucgugagcggcaucuucccguacuccauccccgccacgcugcucgucuggcacaccuggcagaagcagacccagcggagcggcgugcugugggacgugcccagcccgcccgagacccagaaggccgagcuggaggagggggucuaccgcaucaagcagcagggcaucuucgggaagacccaggugggcguggggguccagaaggagggcguguuccacaccauguggcacgugacccggggcgccguccucacccacaacgggaagcgccuggagcccaacugggcgagcgugaagaaggaccugaucuccuacggcgggggcuggcggcucagcgcccaguggcagaagggggaggaggugcaggucaucgccguggagcccggcaagaaccccaagaacuuccagacgaugcccggcaccuuccagaccaccacgggggagaucggcgccaucgcccuggacuucaagcccgggaccagcggcucccccaucaucaaccgcgagggcaagguggucgggcuguacggcaacgggguggugaccaagaacggcggguacgucagcggcaucgcgcagaccaacgccgagccggacggccccacgcccgagcuggaggaggagauguucaagaagcggaaccucaccaucauggaccugcaccccggguccggcaagacccgcaaguaccugccggccaucgugcgggaggccaucaagcgccggcuccgcacccugauccuggcccccacgcggguggucgcggccgagauggaggaggcccucaaggggcugcccauccgcuaccagaccaccgccaccaagagcgagcacacgggccgggagaucguggaccugaugugccacgccaccuucaccaugcgccuccugucccccgugcgggucccgaacuacaaccugaucgugauggacgaggcgcacuucaccgaccccgccagcaucgccgcccgcggguacaucuccacgcgggugggcaugggcgaggcggccgccaucuucaugaccgccacgccgcccgggaccgccgacgcguucccgcagagcaacgcccccauccaggacgaggagcgcgacauccccgagcgcuccuggaacagcggcaacgaguggaucacggacuucgccgggaagaccgucugguucgugcccuccaucaaggccggcaacgacaucgccaacugccuccggaagaacgggaagaaggugauccagcugagccgcaagaccuucgacaccgaguaccagaagacgaagcugaacgacugggacuucgucgugaccaccgacaucuccgagaugggcgcgaacuucaaggccgaccgggugaucgacccgcgccggugccucaagcccgucauccugaccgacggccccgagcgcgugauccuggccgggcccaugccggugacggccgccagcgcggcccagcggcgcggccgggucgggcgcaacccccagaaggagaacgaccaguacaucuucaccggccagccccucaacaacgacgaggaccacgcccacuggaccgaggccaagaugcugcuggacaacaucaacacccccgaggggaucaucccggcccucuucgagcccgagcgggagaaguccgccgccaucgacggcgaguaccgccugaagggcgagagccggaagaccuucguggagcugaugcgccgcggggaccuccccgucuggcuggcccacaagguggccuccgagggcaucaaguacacggaccgcaaguggugcuucgacgggcagcggaacaaccagauccuggaggagaacauggacguggagaucuggaccaaggagggcgagaagaagaagcuccgcccccgguggcuggacgcgcgcaccuacagcgacccgcuggcccucaaggaguucaaggacuucgccgccggccgcaaguccaucgcccuggaccuggucaccgagaucgggcgggugcccagccaccucgcgcaccgcacgcggaacgcccuggacaaccuggugaugcuccacaccagcgagcacggcgggcgcgccuaccggcacgccgucgaggagcugcccgagaccauggagacccugcuccugcugggccucaugauccugcugaccggcggggccaugcuguuccugaucuccgggaaggggaucggcaagaccagcaucgggcugaucugcgugaucgcguccagcggcaugcucuggauggccgaggugccgcugcaguggaucgccuccgccaucguccuggaguucuucaugauggugcuccugauccccgagcccgagaagcagcgcacgccccaggacaaccagcuggccuacguggucaucgggauccucacccuggcggccaucaucgccgccaacgagaugggccugcucgagacgaccaagcgggaccugggcaugagcaaggagccggggguggugucccccaccagcuaccuggacgucgaccuccaccccgcguccgccuggacccuguacgccguggccacgaccgugaucacccccaugcugcgccacaccaucgagaacagcacggccaacgucucccucgcggccaucgccaaccaggccguggugcugaugggccuggacaagggguggccgaucagcaagauggaccucggcgucccccugcuggcccucgggugcuacucccaggugaacccccugacccugaccgcggccgugcuccugcugaucacccacuacgccaucaucggccccggccuccaggccaaggccacgcgggaggcgcagaagcgcaccgccgccgggaucaugaagaacccgaccgucgacggcaucaugaccaucgaccuggaccccgugaucuacgacagcaaguucgagaagcagcugggccaggugaugcuccugguccugugcgccgugcagcuccugcugaugcggacguccugggcgcucugcgaggcccugacccuggccaccggccccaucaccacgcucugggagggcagccccgggaaguucuggaacaccaccaucgccguguccauggccaacaucuuccgcggcagcuaccuggcgggggccggccuggccuucuccaucaugaaguccgucgggaccggcaagcggggcacggggagccagggcgagacccucggggagaaguggaagaagaagcugaaccagcugucccgcaaggaguucgaccucuacaagaaguccggcaucaccgagguggaccggaccgaggccaaggaggggcugaagcgcggcgagaccacgcaccacgccgugucccggggcagcgcgaagcugcagugguucgucgagcgcaacaugguggugccggaggggcgggucaucgaccucggcugcgggcgcggcgggugguccuacuacugcgccggccugaagaaggugaccgaggugcggggcuacaccaagggcgggcccgggcacgaggagcccguccccaugagcaccuacggcuggaacaucgugaagcugauguccgggaaggacguguucuaccucccgcccgagaagugcgacacgcugcugugcgacaucggcgagagcucccccagccccaccgucgaggagucccgcaccauccgcgugcugaagaugguggagccguggcucaagaacaaccaguucugcaucaagguccugaaccccuacaugcccaccgugaucgagcaccuggagcggcuccagcgcaagcacggcgggaugcuggugcggaacccccugagccgcaacuccacgcacgagauguacuggaucagcaacggcaccgggaacaucgucuccagcgugaacauggugucccggcuccugcugaaccgcuucaccaugacccaccggcgcccgacgaucgagaaggacgucgaccucggcgccggcacccggcacgugaacgccgagcccgagacccccaacauggacgucaucggggagcgcaucaagcggaucaaggaggagcacaacagcaccuggcacuacgacgacgagaacccguacaagacgugggccuaccacggcuccuacgaggugaaggcgaccgggagcgccagcuccaugaucaacggcguggucaagcugcugaccaagcccugggacguggugcccauggucacccagauggccaugacggacaccacccccuucgggcagcagcgcguguucaaggagaagguggacacccggacgccgcgccccaugcccggcacccggaaggucauggagaucaccgccgaguggcucuggcgcacccugggccggaacaagcgcccccggcugugcacgcgcgaggaguucaccaagaaggugcgcaccaacgcggccaugggggccguguucaccgaggagaaccagugggacagcgccaaggccgcggucgaggacgaggaguucuggaagcucguggaccgggagcgcgagcugcacaagcugggcaagugcggguccugcguguacaacaugaugggcaagcgggagaagaagcucggggaguucggcaaggccaagggcagccgcgccaucugguacauguggcugggggcccgguaccuggaguucgaggcccucggcuuccugaacgaggaccacugguucucccgcgagaacagcuacuccggggucgagggcgaggggcugcacaagcucggcuacauccugcgggacaucagcaagaucccgggcggggcgauguacgccgacgacacggccggcugggacacccgcaucaccgaggacgaccugcacaacgaggagaagaucauccagcagauggaccccgagcaccggcagcucgccaacgccaucuucaagcugaccuaccagaacaagguggugaagguccagcgccccacgcccaccgggaccgugauggacaucaucucccggaaggaccagcgcggcagcggccagguggggaccuacggccugaacaccuucacgaacauggaggcgcagcucguccggcagauggagggggagggcgugcugaccaaggccgaccuggagaacccgcaccuccccgagaagaagaucacccaguggcuggagaccaaggggguggagcgccugaagcggauggccaucuccggcgacgacugcgucgugaagcccaucgacgaccgcuucgccaacgcccuccuggcgcugaacgacaugggcaaggugcggaaggacaucccccaguggcagccgagccgcggguggcacgacuggcagcagguccccuucugcucccaccacuuccacgagcucaucaugaaggacggccggaagcugguggugcccugccgcccccaggacgagcugaucgggcgggcccgcaucagccagggcgccggguggucccuccgcgagacggccugccugggcaaggcguacgcccagauguggagccugauguacuuccaccggcgcgaccuccggcuggccuccaacgccaucugcagcgccgucccggugcacugggugcccaccucccgcaccaccuggagcauccacgcgcaccaccaguggaugacgaccgaggacaugcugaccgucuggaaccggguguggaucgaggagaaccccuggauggaggacaagacccccgugacgaccugggagaacgucccguaccucggcaagcgcgaggaccaguggugcgggagccugaucggccugaccucccgggccaccugggcccagaacauccucacggccauccagcagguccgcagccugaucgggaacgaggaguuccuggacuacaugcccuccaugaagcgguuccgcaaggaggaggagagcgagggcgccaucugguga

SEQ ID NO: 10372 - RNA, 9873 nt, Artificial Sequence
  derived and/or modified CDS sequence (opt1) from DENV-3__JQ411814__SS-prME
accagccucugccucaugaugauccugcccgccgcccuggcguuccaccucaccagccgggacggggagccgcggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcguggggaucggcaaccgcgacuucguggagggccuguccggggccaccugggucgacguggugcuggagcacggcgggugcgucaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacaccgugaucaucacggugcacaccggggaccagcaccaggucggcaacgagacccagggggugaccgccgagaucacgccccaggccagcaccaccgaggcgauccugcccgaguacggcacccuggggcucgagugcuccccgcgcaccggccuggacuucaacgagaugauccugcucacgaugaagaacaaggccuggaugguccaccggcagugguucuucgaccugccccugcccuggaccagcggcgccaccaccgagacgcccaccuggaaccgcaaggagcuccuggugaccuucaagaacgcccacgccaagaagcaggagguggucgugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucgugcugaagaaggaggucuccgagacccagcacgggaccauccucaucaagguggaguacaagggcgaggacgcgccgugcaagauccccuucagcaccgaggacgggcagggcaaggcccacaacggccgccugaucacggccaaccccguggucaccaagaaggaggagcccgugaacaucgaggccgagccgcccuucggggagagcaacaucgugaucggcaucggggacaacgcgcugaagaucaacugguacaagaagggcuccagcaucgggaagauguucgaggccaccgcccggggcgcccgccggauggccauccugggcgacaccgcgugggacuucggguccgucggcggggugcucaacagccugggcaagauggugcaccagaucuucggguccgccuacacggcccuguucagcggcgucuccugggugaugaagaucggcaucggggugcuccugaccuggaucggccugaacagcaagaacaccuccaugagcuucuccugcaucgccaucgggaucaucacccucuaccugggcgccgucgugcaggcggacauggggugcgugaucaacuggaagggcaaggagcugaagugcggcagcgggaucuucgucacgaacgaggugcacaccuggaccgagcaguacaaguuccaggccgacucccccaagcgccucgccaccgccaucgccggcgcgugggagaacggggugugcggcauccgcagcacgacccggauggagaaccugcuguggaagcagaucgccaacgagcucaacuacauccugugggagaacaacaucaagcugaccgucguggugggggacaccaucggcguccucgagcagggcaagcgcacgcugacgccccagccgauggagcugaaguacuccuggaagaccugggggaaggccaagaucgugaccgccgagacgcagaacagcuccuucaucaucgacggccccaacacccccgagugccccagcgcgucccgggccuggaacgugugggaggucgaggacuacggguucggcguguucaccaccaacaucuggcucaagcugcgcgacguguacacccagcugugcgaccaccggcucaugagcgccgccgucaaggacgagcgcgccgugcacgcggacaugggcuacuggaucgagagccagaagaacggguccuggaagcuggagaaggccagccugaucgaggugaagacgugcaccuggccgaagucccacacccucuggagcaacggcguccuggaguccgacaugaucauccccaagagccuggccgggcccaucucccagcacaacuaccggccgggcuaccacacccagacggccgggcccuggcaccucggcaagcuggagcuggacuucaacuacugcgagggcaccaccguggugaucaccgagaacugcgggacgcgcggccccagccuccggaccaccaccgucuccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccggcagcgggaaggucgacaacuucaccaugggcgugcugugccucgcgauccuguucgaggaggugaugcgggggaaguucggcaagaagcacaugaucgccgggguccuguucaccuucgugcuccugcuguccggccagaucaccuggcgcgacauggcccacacgcucaucaugaucggcagcaacgccuccgaccggauggggaugggcgugaccuaccuggcccugaucgcgaccuucaagauccagcccuuccucgcccugggguucuuccugcgcaagcucaccagccgggagaaccugcugcucggcgucggccuggccauggccacgacccugcagcuccccgaggacaucgagcagauggcgaacgggaucgcccugggccugauggcccucaagcugaucacccaguucgagaccuaccagcuguggacggcccucgugagccugaccugcuccaacaccauccugacccucacgguggccuggcgcaccgcgacccugauccuggccggggucagccuccugccggugugccaguccagcuccaugcggaagaccgacuggcugcccaugacggucgccgccaugggcgugccgccccucccgcuguucaucuucagccugaaggacacccucaagcgccgcuccuggccccugaacgagggggugauggccgucggccuggugagcauccucgcguccagccugcugcggaacgacgugcccauggccggcccccucgucgccgggggccugcugaucgccugcuacgugaucaccgggaccuccgccgaccucacgguggagaaggcggccgacgucaccugggaggaggaggccgagcagaccggcgugagccacaaccugaugaucaccguggacgacgacgggaccaugcgcaucaaggacgacgagacggagaacauccugaccguccuccugaagaccgcccugcucaucguguccggcaucuucccguacagcauccccgccacccugcugguguggcacacguggcagaagcagacccagcgguccggcguccucugggacgugcccagcccgcccgagacccagaaggcggagcuggaggaggggguguaccgcaucaagcagcagggcauccuggggaagacccaggucggcgugggggugcagaaggagggcgucuuccacacgauguggcacgugacccggggcgccgugcucacccacaacgggaagcgccuggagcccaacugggccuccgucaagaaggaccugaucagcuacggcgggggcuggcggcuguccgcccaguggcagaagggggaggagguccaggugaucgcggucgagcccggcaagaaccccaagaacuuccagaccaugcccggcacguuccagaccaccaccggggagaucggcgccaucgcccucgacuucaagcccgggacgagcggcagccccaucaucaaccgcgagggcaaggugguggggcuguacggcaacggggucgugaccaagaacggcggguacguguccggcaucgcccagaccaacgccgagccggacggccccacccccgagcuggaggaggagauguucaagaagcggaaccucacgaucauggaccugcaccccgggagcggcaagacccgcaaguaccugccggcgaucguccgggaggccaucaagcgccggcuccgcacccugauccuggcccccacccgggugguggccgccgagauggaggaggcgcucaaggggcugcccauccgcuaccagacgaccgccaccaaguccgagcacaccggccgggagaucgucgaccugaugugccacgccacguucaccaugcgccuccugagccccgugcgggugccgaacuacaaccugaucaucauggacgaggcccacuucaccgaccccgccuccaucgcggcccgcggguacaucagcacccgggucggcaugggcgaggccgccgcgaucuucaugacggccacgccgcccgggaccgccgacgccuucccgcaguccaacgcccccauccaggacgaggagcgcgacauccccgagcgcagcuggaacuccggcaacgaguggaucaccgacuucgcggggaagacggugugguucgugcccagcaucaaggccggcaacgacaucgccaacugccuccggaagaacgggaagaaggucauccagcugucccgcaagaccuucgacaccgaguaccagaagaccaagcugaacgacugggacuucguggugacgaccgacaucagcgagaugggcgccaacuucaaggccgaccgggucaucgacccgcgccggugccucaagcccgugauccugaccgacggccccgagcgcgugauccuggcggggcccaugccggucaccgccgccuccgccgcccagcggcgcggccggguggggcgcaacccccagaaggagaacgaccaguacaucuucaccggccagccccucaacaacgacgaggaccacgcgcacuggacggaggccaagaugcugcuggacaacaucaacacccccgaggggaucaucccggcccucuucgagcccgagcgggagaaguccgccgcgaucgacggcgaguaccgccugaagggcgagucccggaagaccuucguggagcugaugcgccgcggggaccuccccgucuggcuggcccacaagguggccagcgagggcaucaaguacaccgaccgcaaguggugcuucgacgggcagcggaacaaccagauccuggaggagaacauggacgucgagaucuggacgaaggagggcgagaagaagaagcuccgcccccgguggcuggacgcccgcaccuacuccgacccgcuggcccucaaggaguucaaggacuucgcggccggccgcaagagcaucgcccuggaccuggugaccgagaucgggcgggugcccucccaccucgcccaccgcacccggaacgcccuggacaaccuggucaugcuccacacgagcgagcacggcgggcgcgcguaccggcacgccguggaggagcugcccgagaccauggagacccugcuccugcugggccucaugauccugcugaccgggggcgccaugcuguuccugaucagcggcaaggggaucggcaagacguccaucgggcugaucugcgugaucgccagcuccggcaugcucuggauggccgagaucccgcugcaguggaucgcgagcgccaucguccuggaguucuucaugauggugcuccugauccccgagcccgagaagcagcgcacgccccaggacaaccagcuggccuacguggucaucgggauccucacccuggccgccaucaucgcggccaacgagaugggccugcucgagaccacgaagcgggaccugggcauguccaaggagccggggguggugagccccaccuccuaccuggacgucgaccuccaccccgccagcgccuggacccuguacgcgguggccaccacggugaucacccccaugcugcgccacaccaucgagaacuccaccgccaacgucagccucgccgccaucgcgaaccaggccguggugcugaugggccuggacaagggguggccgaucuccaagauggaccucggcgucccccugcuggcccucgggugcuacagccaggugaacccccugacgcugaccgccgccgugcuccugcugaucacccacuacgcgaucaucggccccggccuccaggccaaggccacccgggaggcccagaagcgcacggccgcggggaucaugaagaacccgaccgucgacggcaucaugaccaucgaccuggaccccgugaucuacgacuccaaguucgagaagcagcugggccaggugaugcuccugguccugugcgccgugcagcuccugcugaugcggaccagcugggcccucugcgaggcccugacgcuggcgaccggccccaucaccacccucugggagggcucccccgggaaguucuggaacacgaccaucgccgugagcauggccaacaucuuccgcggcuccuaccuggccggggccggccuggcguucagcaucaugaaguccgucgggaccggcaagcggggcaccgggagccagggcgagacccucggggagaaguggaagaagaagcugaaccagcugagccgcaaggaguucgaccucuacaagaaguccggcaucacggagguggaccggaccgaggccaaggaggggcugaagcgcggcgagaucacccaccacgccgugagccggggcuccgccaagcugcagugguucgucgagcgcaacauggugaucccggaggggcgggugaucgaccucggcugcgggcgcggcggguggagcuacuacugcgccggccugaagaaggucaccgaggugcggggcuacacgaagggcgggcccgggcacgaggagcccgugcccauguccaccuacggcuggaacaucgucaagcugaugagcgggaaggacguguucuaccugccgcccgagaagugcgacacccuccugugcgacaucggcgaguccagccccucccccaccguggaggagagccgcacgauccgcguccugaagaugguggagccguggcucaagaacaaccaguucugcaucaaggugcugaaccccuacaugcccaccgucaucgagcaccuggagcggcuccagcgcaagcacggcgggaugcuggugcggaacccccugucccgcaacagcacccacgagauguacuggaucuccaacggcaccgggaacaucgugagcuccgucaacauggugagccggcuccugcugaaccgcuucacgaugacccaccggcgcccgaccaucgagaaggacguggaccucggcgcgggcacccggcacgucaacgccgagcccgagacgcccaacauggacgugaucggggagcgcaucaagcggaucaaggaggagcacaacuccaccuggcacuacgacgacgagaacccguacaagaccugggccuaccacggcagcuacgaggugaaggccaccggguccgccagcagcaugaucaacggcgucgugaagcugcugacgaagcccugggacgucgugcccauggugacccagauggcgaugaccgacaccacgcccuucgggcagcagcgcgucuucaaggagaagguggacacccggaccccgcgccccaugcccggcacccggaaggugaugggcaucacggccgaguggcucuggcgcacccuggggcggaacaagcgcccccggcugugcacccgcgaggaguucaccaagaagguccgcacgaacgccgccaugggcgcgguguucaccgaggagaaccagugggacuccgccaaggccgccguggaggacgaggaguucuggaagcucgucgaccgggagcgcgagcugcacaagcuggggaagugcggcagcugcguguacaacaugauggggaagcgggagaagaagcucggcgaguucggcaaggccaaggggucccgcgcgaucugguacauguggcugggcgcccgguaccuggaguucgaggcccucggguuccugaacgaggaccacugguucagccgcgacaacuccuacagcggcguggagggggagggccugcacaagcucggcuacauccugcgggacaucuccaagauccccggcggggccauguacgccgacgacaccgcggggugggacacccgcaucacggaggacgaccugcacaacgaggagaagaucacccagcagauggaccccgagcaccggcagcucgccaacgccaucuucaagcugaccuaccagaacaaggucgugaaggugcagcgccccacccccaccgggacggucauggacaucaucagccggaaggaccagcgcggcuccggccaggugggcaccuacgggcugaacaccuucaccaacauggaggugcagcucguccggcagauggagggcgagggggugcugagcaaggccgaccuggagaacccgcaccuccccgagaagaagaucacgcaguggcuggagaccaagggcguggagcgccugaagcggauggccaucuccggcgacgacugcgucgugaagcccaucgacgaccgcuucgcgaacgcccuccuggcccugaacgacauggggaaggugcggaaggacaucccccaguggcagccgagcaagggcuggcacgacuggcagcagguccccuucugcucccaccacuuccacgagcucaucaugaaggacgggcgcaagcugguggugcccugccggccccaggacgagcugaucggccgcgcccggaucagccagggggccggcuggucccuccgcgagaccgcgugccugggcaaggccuacgcccagauguggagccugauguacuuccaccgccgggaccuccgccuggccuccaacgcgaucugcagcgccgucccggugcacugggugcccaccucccggacgaccuggagcauccacgcccaccaccaguggaugaccaccgaggacaugcugacggucuggaaccgcguguggaucgaggacaaccccuggauggaggacaagacccccgugaccaccugggagaacgucccguaccucgggaagcgggaggaccaguggugcggcagccugaucgggcugacgucccgcgccaccugggcccagaacauccccaccgcgauccagcagguccggagccucaucggcaacgaggaguuccuggacuacaugcccuccaugaagcgcuuccggaaggaggaggagagcgagggggccaucugguga

SEQ ID NO: 10373 - RNA, 9873 nt, Artificial Sequence
  derived and/or modified CDS sequence (opt1) from DENV-3__KM190937__SS-prME
accagccugugccucaugaugaugcugcccgccacccuggccuuccaccucaccagccgggacggcgagccccggaugaucguggggaagaacgagcggggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugacguacgggaccugcaaccaggccggcgagcaccggcgcgacaagcggagcguggccaucgcgccccacgugggcauggggcucgacacccgcacccagacguggaugagcgcggagggcgccuggcgccagguggagaagguggagaccugggcccugcgccaccccggguucaccauccuggcccucuuccuggcgcacuacaucggcaccucccugacgcagaagguggugaucuucauccuccugaugcuggucacccccagcaugaccaugcggugcgugggggugggcaaccgcgacuucgucgagggccucuccggggccaccuggguggacgugguccuggagcacggcgggugcgugacgaccauggccaagaacaagcccacccuggacaucgagcuccagaagaccgaggccacgcagcuggccacccugcggaagcucugcaucgagggcaagaucaccaacaucaccacggacagccgcugccccacccagggcgaggcgauccugccggaggagcaggaccagaacuacgugugcaagcacaccuacgucgaccggggguggggcaacgggugcggccuguucgggaagggcucccucgugaccugcgccaaguuccagugccuggagagcaucgagggcaaggugguccagcacgagaaccugaaguacacggugaucaucaccgugcacaccggggaccagcaccaggucggcaacgagaugcagggggugaccgccgagaucacgccccaggccuccaccgccgaggucauccuccccgaguacggcacccuggggcuggagugcagcccccgcaccggccucgacuucaacgagaugaucucccugaccaugaagaacaaggcguggauggugcaccggcagugguucuucgaccugccgcuccccuggacgagcggcgccaccgccgagacccccaccuggaaccgcaaggagcugcuggugacguucaagaacgcccacgccaagaagcaggaggucguggugcucgggucccaggagggcgcgaugcacaccgcccugaccggggccaccgagauccagacgagcggcgggaccuccaucuucgccggccaccugaagugccggcucaagauggacaagcuggagcugaagggcaugagcuacgccaugugccucagcuccuucguccugaagaaggaggugagcgagacccagcacgggaccauccugaucaagguggaguacaagggcgaggacgcgcccugcaagaucccguucuccacggaggacgggcagggcaaggcccacaacggccgccucaucaccgccaaccccgucgugaccaagaaggaggagcccgugaacaucgaggccgagcccccguucggggagagcaacaucgucaucggcaucggggacaaggcgcugaagaucaacugguacaagaagggcuccagcaucgggaagauguucgaggccaccgcccggggcgcccgccggauggccauccugggcgacacggcgugggacuucggguccgugggcggggugcugaacagccucggcaagaugguccaccagaucuucggguccgccuacaccgcccuguucggcggcgugagcuggaugaugaagaucgggaucggcgugcugcucaccuggaucgggcugaacuccaagaacaccagcauguccuucagcugcaucgccaucggcaucaucacgcuguaccucggggccgucgugcaggcggacaugggcugcgugaucaacuggaagggcaaggagcugaagugcggguccggcaucuucgucaccaacgaggugcacaccuggaccgagcaguacaaguuccaggccgacagccccaagcgccuggccacggccaucgccggggcgugggagaacggcgugugcgggauccgcuccaccacccggauggagaaccuccuguggaagcagaucgccaacgagcugaacuacauccucugggagaacaacaucaagcugaccgucguggugggcgacaucacgggcguccuggagcaggggaagcgcacccucacgccccagcccauggagcugaaguacagcuggaagaccuggggcaaggccaagaucgugacggccgagacccagaacuccagcuucaucaucgacgggccgagcacccccgagugccccuccgcgagccgggccuggaacgugugggaggucgaggacuacggcuucggcguguucaccacgaacaucuggcugaagcuccgcgagguguacacccagcugugcgaccaccggcugauguccgccgccgucaaggacgagcgcgccgugcacgcggacaugggguacuggaucgagagccagaagaacggcuccuggaagcucgagaaggccagcuucaucgaggugaagaccugcaccuggcccaagucccacacccuguggagcaacgggguccuggaguccgacaugaucauccccaagagccucgccggccccaucucccagcacaaccaccggcccggguaccacacgcagaccgccggcccguggcaccugggcaagcuggagcucgacuucaacuacugcgaggggaccaccguggugaucagcgagaacugcggcacgcgcgggcccucccugcggaccaccaccgucagcggcaagcugauccacgaguggugcugccgcuccugcacgcugccgccccuccgguacaugggggaggacggcugcugguacggcauggagauccgcccgaucaacgagaaggaggagaacauggucaagagccuggccuccgcggggagcggcaagguggacaacuucaccauggggguccucugccuggccauccuguucgaggaggugaugcggggcaaguucgggaagauccacaugaucgccggcguccucuucaccuucguccugcugcucagcggccagaucaccuggcgcgacauggcccacacgcugaucaugaucggguccaacgccagcgaccggaugggcaugggggugaccuaccuggcgcucaucgccaccuucaagauccagcccuuccuggcccugggcuucuuccuccgcaagcugaccucccgggagaaccugcuccugggcguggggcuggccauggcggccacgcuccgccugcccgaggacaucgagcagauggccaacggcaucgcccuggggcucauggcccugaagcugaucacccaguucgagaccuaccagcucuggaccgcgcuggucagccugacgugcuccaacaccaucuucacccucaccguggccuggcggacggccacccugauccuggccggcaucagccuccugcccgugugccaguccagcuccaugcgcaagaccgacuggcugccgaugaccgucgccgcgaugggggcccagccccucccccuguucaucuucagccugaaggacacgcucaagcgccgguccuggccccugaacgagggcgugauggccgucggccuggugagcauccucgccuccagccugcugcgcaacgacgugccgauggccgggccccucgucgcgggcgggcugcugaucgccugcuacgugaucaccggcaccuccgccgaccucaccguggagaaggccgccgacgucacgugggaggaggaggcggagcagaccggggugagccacaaccugauggugaccgucgacgacgacggcaccaugcggaucaaggacgacgagacggagaacauccugaccgugcuccugaagaccgcccugcucaucguguccggcaucuuccccuacagcauccccgccacccugcuggucuggcacaccuggcagaagcagacgcagcgcuccggggugcucugggacgugccguccccgcccgagacccagaaggccgagcuggaggagggcgucuaccggaucaagcagcaggggaucuucggcaagacccaggugggggugggcguccagaaggagggcguguuccacaccauguggcacgugacgcgcggggcgguccugacccacaacggcaagcggcucgagcccaacugggccagcgugaagaaggaccugaucuccuacgggggcggguggcgccugagcgcccaguggcagaagggcgaggaggugcaggucaucgccguggagccgggcaagaaccccaagaacuuccagaccaugcccgggaucuuccagaccacgaccggcgagaucggggccaucgcgcucgacuucaagcccggcaccuccggcagcccgaucaucaaccgggaggggaagguggucggccuguacgggaacggcguggugaccaagaacgggggcuacgucuccggcaucgcccagacgaacgccgagcccgacgggcccaccccggagcuggaggaggagauguucaagaagcgcaaccugaccaucauggaccuccaccccggcagcgggaagacccggaaguaccugcccgccaucgugcgcgaggccaucaagcggcgccugcggacgcucauccuggcgcccacccgcguggucgccgccgagauggaggaggcccugaagggccucccgauccgguaccagaccaccgccacgaaguccgagcacaccgggcgcgagaucguggaccugaugugccacgcgaccuucaccaugcggcugcucagccccgugcgcguccccaacuacaaccugaucaucauggacgaggcccacuucacggaccccgccuccaucgccgcgcggggcuacaucagcacccgcgugggcaugggggaggccgccgccaucuucaugaccgccaccccgcccggcacggcggacgccuucccccaguccaacgcccccauccaggacgaggagcgcgacaucccggagcggagcuggaacuccgggaacgaguggaucaccgacuucgugggcaagaccgucugguucgugcccagcaucaaggccgggaacgacaucgccaacugccugcgcaagaacggcaagaaggugauccagcucucccggaagaccuucgacacggaguaccagaagaccaagcugaacgacugggacuucgucgugaccaccgacaucagcgagaugggcgcgaacuucaaggccgaccgcgugaucgacccccggcgcugccugaagcccgucauccucacggacgggccggagcgggugauccuggccggccccaugcccgugaccgucgccuccgccgcgcagcgccgggggcgcgugggccggaacccccagaaggagaacgaccaguacaucuucauggggcagccgcugaacaacgacgaggaccacgcccacuggaccgaggccaagaugcuccuggacaacaucaacacccccgagggcaucauccccgcccuguucgagcccgagcgcgagaaguccgcggccaucgacggcgaguaccggcucaagggggagucccgcaagacguucguggagcugaugcggcgcggcgaccugccggucuggcucgcccacaagguggccagcgaggggaucaaguacaccgaccggaaguggugcuucgacggcgagcgcaacaaccagauccuggaggagaacauggacgucgagaucuggaccaaggagggcgagaagaagaagcugcggccccgcuggcucgacgcccgcaccuacagcgacccccuggcgcugaaggaguucaaggacuucgccgccgggcggaaguccaucgcccucgaccuggugaccgagaucggccgcgugcccagccaccuggcccaccggacgcgcaacgcgcucgacaaccuggucaugcugcacaccuccgagcacgggggccgggccuaccgccacgccguggaggagcucccggagaccauggagacccugcugcuccuggggcugaugauccuccugacgggcggcgccaugcuguuccucaucagcgggaagggcaucgggaagaccuccaucggccugaucugcgugaucgccagcuccgggaugcuguggauggcggacgucccccuccaguggaucgccagcgccaucgugcuggaguucuucaugauggugcugcucauccccgagccggagaagcagcggacgccccaggacaaccagcuggccuacgucgugaucggcauccugacccucgccgcgaucguggccgccaacgagaugggccugcuggagacgaccaagcgcgaccucgggauguccaaggagcccggcgucgugagccccaccuccuaccuggacguggaccugcacccggccagcgcguggacccucuacgccgucgccacgaccgugaucacccccaugcugcggcacaccaucgagaacuccacggccaacgugagccuggccgcgaucgccaaccaggccgucgugcucauggggcuggacaagggcuggcccaucuccaagauggaccugggggugccccuccuggcccugggcugcuacagccaggucaacccgcucacccuggccgcggccgugcugcuccuggugacccacuacgccaucaucggccccgggcugcaggccaaggccacccgcgaggcgcagaagcggacggccgccggcaucaugaagaaccccaccgucgacgggaucaugaccaucgaccucgaccccgugaucuacgacuccaaguucgagaagcagcugggccaggugaugcugcucguccugugcgccgugcagcugcuccugaugcgcaccagcugggcgcugugcgaggugcucacgcuggccaccggcccgaucaccacccugugggaggggucccccggcaaguucuggaacacgaccaucgccgucagcauggccaacaucuuccgggggagcuaccucgccggcgcggggcuggccuucuccaucaugaaguccgugggcaccggcaagcgcgggaccggcucccagggggagacgcugggcgagaaguggaagaagaagcucaaccagcugagccggaaggaguucgaccuguacaagaaguccgggaucaccgagguggaccgcaccgaggccaaggagggccucaagcggggcgagaucacccaccacgccgucagccgcggguccgccaagcugcagugguucguggagcggaacauggugauccccgagggccgcgucaucgaccuggggugcggccgcggcggguggagcuacuacugcgcggggcucaagaaggugacggaggugcgcggguacaccaagggcgggcccggccacgaggagccgguccccauguccaccuacggguggaacaucgugaagcugaugagcggcaaggacguguucuaccugccgcccgagaagugcgacacccuccugugcgacaucggcgaguccagcccgucccccaccgucgaggagagccgcacgauccgggugcugaagaugguggagcccuggcugaagaacaaccaguucugcaucaagguccucaaccccuacaugccgaccgugaucgagcaccuggagcgccugcagcggaagcacgggggcaugcucgugcgcaacccccugucccggaacagcacccacgagauguacuggaucuccaacgggaccggcaacaucgucagcuccgugaacauggugagccgccugcuccugaaccgguucacgaugacccaccgccggcccaccaucgagaaggacgucgaccugggcgccgggacccgccacgugaacgccgagcccgagacgccgaacauggacgucaucggcgagcggaucaagcgcaucaaggaggagcacagcuccaccuggcacuacgacgacgagaaccccuacaagaccugggccuaccacgggagcuacgaggugaaggccaccggcuccgcgagcuccaugaucaacgggguggucaagcuccugacgaagcccugggacguggugccgauggucacccagauggccaugaccgacaccacgcccuucggccagcagcggguguucaaggagaagguggacacccgcacgccccggcccaugccgggcacccgcaaggucauggagaucaccgccgaguggcuguggcggacccucgggcgcaacaagcggccccgccugugcacccgcgaggaguucaccaagaaggugcggacgaacgccgcgaugggcgccguguucaccgaggagaaccagugggacagcgcccgcgccgccgucgaggacgaggaguucuggaagcugguggaccgggagcgcgagcuccacaagcuggggaagugcggcuccugcguguacaacaugauggggaagcgggagaagaagcugggcgaguucggcaaggcgaaggggagccgcgccaucugguacauguggcucggcgcccgguaccuggaguucgaggcccugggguuccucaacgaggaccacugguucucccgcgagaacagcuacuccggcgucgagggggagggccugcacaagcugggcuacauccuccgggacaucagcaagauccccgggggcgccauguacgcggacgacaccgccgggugggacacccgcaucacggaggacgaccugcacaacgaggagaagaucacccagcagauggaccccgagcaccggcagcuggccaacgccaucuucaagcucaccuaccagaacaagguggugaagguccagcgcccgacccccaagggcacggugauggacaucaucucccggaaggaccagcgcggcagcggccaggugggcaccuacgggcugaacaccuucaccaacauggaggcccagcugauccggcagauggagggcgaggggguccucuccaaggcggaccuggagaacccccacccccuggagaagaagaucacgcaguggcucgagaccaagggcguggagcgccugaagcggauggccaucagcggcgacgacugcguggucaagccgaucgacgaccgcuucgccaacgcccugcucgcccugaacgacauggggaaggugcggaaggacaucccccaguggcagcccuccaagggcuggcacgacuggcagcagguccccuucugcagccaccacuuccacgagcugaucaugaaggacgggcgcaagcucgucgugccgugccggccccaggacgagcugaucggccgcgcgcgcaucucccagggggccggcuggagccugcgggagaccgccugccucggcaaggccuacgcgcagaugugggcccugauguacuuccaccgccgggaccugcgccucgccagcaacgccaucugcuccgccgugcccguccacugggugcccaccagccggaccacgugguccauccacgcgcaccaccaguggaugaccaccgaggacaugcugaccguguggaaccgcgucuggaucgaggacaacccguggauggaggacaagacgcccgugaccaccugggaggacgugcccuaccuggggaagcgggaggaccaguggugcggcagccucaucgggcugaccucccgcgccacgugggcccagaacauccugaccgccauccagcagguccggagccucaucggcaacgaggaguuccuggacuacaugcccuccaugaagcgcuuccggaaggaggaggagagcgagggggccaucugguga

SEQ ID NO: 10374 - RNA, 9873 nt, Artificial Sequence
  derived and/or modified CDS sequence (opt1) from DENV-3__JQ920487__SS-prME
accagccugugccucaugaugaugcugcccgccacccuggccuuccaccucaccagccgggacggcgagccccggaugaucguggggaagaacgagcgcggcaagagccugcuguucaagaccgccagcgggaucaacaugugcacccucaucgccauggaccugggcgagaugugcgacgacaccgugaccuacaagugcccccugaucaccgagguggagcccgaggacaucgacugcuggugcaaccucaccagcaccugggugaccuacgggaccugcaaccaggccggcgagcaccggcgcgacaagcggagcguggcccuggcgccccacgugggcauggggcuggacacccgcacccagaccuggaugagcgcggagggcgccuggcgccagguggagaaggucgagaccugggccuuccgccaccccggguucaccauccucgcccuguuccuggcgcacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacgugaccacggacagccgcugccccacccagggcgaggcgauccugcccgaggagcaggaccagaacuacgucugcaagcacaccuacguggaccggggguggggcaacgggugcggccucuucgggaagggcucccuggugaccugcgccaaguuccagugccuggagagcaucgagggcaaggccguccagcacgagaaccucaaguacacggugaucaucaccgugcacaccggggaccagcaccaggucggcaacgagacccagggggugacggccgagaucacgccccaggccuccaccgucgaggcgauccugcccgaguacggcacccuggggcucgagugcagcccccgcaccggccuggacuucaacgagaugauccugcucacgaugaagaacaaggccuggauggugcaccggcagugguucuucgaccugccgcugcccuggaccuccggcgccaccaccgagacgcccaccuggaacaagaaggagcuccuggugaccuucaagaacgcccacgccaagaagcaggaggucguggugcuggggagccaggagggcgcgaugcacaccgcccucacgggggccaccgagauccagaccuccggcgggaccagcaucuucgccggccaccugaagugccgccugaagauggacaagcucgagcugaagggcauguccuacgccaugugccugaacgcguucguccucaagaaggaggugagcgagacgcagcacgggaccauccugaucaagguggaguacaagggcgaggacgcccccugcaagaucccguucagcaccgaggacgggcagggcaaggcccacaacggccggcugaucaccgccaaccccaucgucacgaagaaggaggagcccgugaacaucgaggcggagcccccguucggggaguccaacaucgugaucggcaucggggacaaggcccugaagaucaacugguacaagaagggcagcuccaucgggaagauguucgaggccaccgcccgcggcgcccggcgcauggcgauccucggcgacaccgccugggacuucgggagcgucggcggggugcugaacucccugggcaagauggugcaccagaucuucgggagcgccuacaccgcccucuucuccggcgucagcuggaucaugaagaucggcaucggggugcugcugacguggaucggccucaacuccaagaacaccagcauguccuucagcugcaucgugaucgggaucaucacccuguaccugggcgccgucgugcaggcggacauggggugcgugaucaacuggaagggcaaggagcucaagugcggcuccgggaucuucgucaccaacgaggugcacacguggaccgagcaguacaaguuccaggccgacagccccaagcggcuggccaccgccaucgccggcgcgugggagaacggggugugcggcauccgcuccaccacgcgcauggagaaccugcucuggaagcagaucgccaacgagcugaacuacauccugugggagaacaacaucaagcucaccgucguggugggggacgucaucggcgugcuggagcagggcaagcggacccugacgccccagcccauggagcucaaguacagcuggaagacgugggggaaggccaagaucgugaccgccgagacccagaacuccagcuucaucaucgacggcccgaacacccccgagugccccuccgcgagccgcgccuggaacgucugggagguggaggacuacggguucggcguguucacgaccaacaucuggcugaagcugcgggagauguacacccagcucugcgaccaccgccugaugagcgccgccgucaaggacgagcgggccgugcacgcggacaugggcuacuggaucgagucccagaagaacgggagcuggaagcuggagaaggccucccucaucgaggugaagaccugcaccuggcccaagagccacacgcugugguccaacggcguccuggagagcgacaugaucaucccgaagucccucgccgggcccaucagccagcacaacuaccgccccggcuaccacacccagaccgccgggccguggcaccugggcaagcuggagcucgacuucaacuacugcgagggcaccacgguggugaucaccgagaacugcgggacccggggccccucccugcgcaccacgaccgucagcgggaagcugauccacgaguggugcugccgguccugcacccugccgccccuccgcuacaugggcgaggacgggugcugguacggcauggagauccggccgaucaacgagaaggaggagaacauggucaagagccugguguccgccggcagcgggaaggcggacaacuucaccaugggcguccucugccuggccauccuguucgaggaggugaugcgcgggaaguucggcaagaagcacaugaucgccggggcccucuucacguucgugcugcugcucuccggccagaucaccuggcgggacauggcccacacccugaucaugaucggcagcaacgcguccgaccgcauggggaugggcgucaccuaccuggcccucaucgccacguucaagauccagcccuuccuggcccugggguucuuccuccggaagcugaccagccgcgagaaccugcuccugggcgugggccuggcgauggccaccacccuccagcugcccgaggacaucgagcagauggccaacgggaucgcccugggccucauggcccugaagcugaucacgcaguucgagaccuaccagcucuggaccgcgcuggugagccugaugugcuccaacaccaucuucacgcucaccgucgccuggcggaccgccacccugauccuggccgugaucagccuccugcccgugugccaguccagcuccaugcgcaagacggacuggcugccgaugaccgucgccgcgaugggggugccgccccucccccuguucaucuucagccugaaggacacccucaagcggcgcuccuggccgcugaacgagggcgucauggccguggggcuggugagcauccucgccuccagcuuccugcgcaacgacguccccauggccggcccccugguggccggcgggcuccugaucgcgugcuacgugaucaccggcacguccgccgaccugaccgucgagaaggccgccgacgugaccugggaggaggaggccgagcagaccggggugagccacaaccucaugaucacggucgacgacgacggcaccaugcggaucaaggacgacgagaccgagaacauccugaccgugcugcucaagaccgcgcugcugaucguguccgggaucuuccccuacagcaucccggccacgcuccuggucuggcacaccuggcagaagcagacccagcgcuccggcgugcugugggacgugcccuccccgcccgagacccagaaggccgagcucgaggagggcgucuaccggaucaagcagcaggggaucuucggcaagacccaggugggggugggcguccagaaggaggggguguuccacaccauguggcacgugacccgcggcgccguccugacccacaacggcaagcggcuggagccgaacugggcgaacgugaagaaggaccucaucuccuacgggggcggguggaagcugagcgcccaguggcagaagggcgaggaggugcaggucaucgccguggagcccgggaagaaccccaagaacuuccagacgaugcccggcaucuuccagaccaccaccggcgagaucggggccaucgcccuggacuucaagccgggcacguccgggagccccaucaucaaccgcgagggcaagguggucggccuguacgggaacggcguggugaccaagaacgggggcuacgucagcgggaucgcgcagaccaacgccgagcccgacggcccgacccccgagcucgaggaggagauguucaagaagcggaaccugacgaucauggaccugcaccccggcuccgggaagacccgcaaguaccuccccgccaucgugcgggaggccaucaagcgccggcugcgcacccugauccucgccccgacccggguggucgcggccgagauggaggaggcccugaagggccugcccauccgcuaccagacgaccgccaccaagagcgagcacaccgggcgggagaucguggaccucaugugccacgccacguucaccaugcgccugcugucccccgugcggguccccaacuacaaccucaucgugauggacgaggcgcacuucaccgacccggccagcaucgccgcccgcggcuacaucuccacccggguggggaugggcgaggcggccgccaucuucaugacggccacgccgcccggcaccgccgacgcguucccccagagcaacgccccgauccaggacgaggagcgcgacauccccgagcgguccuggaacagcgggaacgaguggaucaccgacuucgccggcaagacggucugguucgugcccuccaucaaggccgggaacgacaucgccaacugccugcgcaagaacggcaagaaggugauccagcugagccgcaagaccuucgacaccgaguaccagaagaccaagcucaacgacugggacuucgucgugacgaccgacaucuccgagaugggggcgaacuucaaggccgaccgggugaucgacccccgccggugccugaagccggucauccugaccgacggccccgagcgcgugauccucgccggccccaugcccgugaccgucgccagcgccgcgcagcggcgcgggcgggugggccgcaacccgcagaaggagaacgaccaguacaucuucacggggcagccccugaacaacgacgaggaccacgcccacuggaccgaggccaagaugcugcucgacaacaucaacacccccgagggcaucauccccgcccuguucgagccggagcgggagaaguccgcggccaucgacggggaguaccgccugaagggcgagagccggaagaccuucguggagcucaugcgccggggcgaccugcccgucuggcuggcccacaagguggccuccgaggggaucaaguacaccgaccgcaaguggugcuucgacggcgagcggaacaaccagauccucgaggagaacauggacgucgagaucuggacgaaggagggggagaagaagaagcugcgcccccgguggcuggacgcccgcaccuacagcgacccccucgcgcugaaggaguucaaggacuucgccgccggccggaaguccaucgcccuggaccucgugaccgagaucggccgcgugccgagccaccuggcccaccgcacccggaacgcgcuggacaaccucgucaugcugcacacguccgagcacgggggccgcgccuaccggcacgccguggaggagcugcccgagaccauggagacccuccugcugcucgggcugaugauccugcucaccggcggggccaugcuguuccugaucagcggcaagggcaucgggaagacgagcaucggccucaucugcguggucgccuccagcgggaugcuguggauggcggacgugccccugcaguggaucgccuccgccaucgugcucgaguucuucaugaugguccugcugaucccggagcccgagaagcagcgcacgccccaggacaaccagcucgccuacguggugaucggcauccugacccuggccgcgaucgucgccgccaacgagauggggcuccuggagaccacgaagcgggaccugggcaugagcaaggagcccggcgugguguccccgaccagcuaccucgacgucgaccugcaccccgccuccgcguggacccuguacgccguggccaccacggugaucacccccaugcuccgccacaccaucgagaacagcaccgccaacgucucccuggccgcgaucgccaaccaggccguggugcugauggggcucgacaagggcuggcccaucagcaagauggaccugggggucccgcugcucgcccugggcugcuacucccaggugaacccccugacgcucaccgccgcggugcugcugcucgucacccacuacgccaucaucgggcccggccugcaggccaaggccacccgggaggcccagaagcgcacggcggccggcaucaugaagaaccccaccguggacgggaucaugaccaucgaccuggacccggugaucuacgacagcaaguucgagaagcagcucggccaggucaugcugcuggugcucugcgccgugcagcugcugcucaugcggaccuccugggccuucugcgaggcgcugacgcuggccaccgggcccaucaccacccucugggagggcagccccggcaaguucuggaacacgaccaucgccgucuccauggccaacaucuuccgcgggagcuaccuggccggcgcggggcuggccuucuccaucaugaaguccgugggcaccgggaagcggggcaccggcucccagggggagacgcucggcgagaaguggaagaagaagcugaaccagcugagccgcaaggaguucgaccucuacaagaaguccgggaucaccgagguggaccggaccgaggccaaggagggccugaagcgcggggagaucacccaccacgccgucucccggggcagcgccaagcugcagugguucguggagcgcaacauggugauccccgagggccgggucaucgaccucgggugcggccgcgggggcugguccuacuacugcgcggggcugaagaaggugaccgaggugcggggcuacacgaagggcgggccgggccacgaggagcccguccccaugagcaccuacggguggaacaucgugaagcugauguccggcaaggacguguucuaccucccgcccgagaagugcgacacccugcugugcgacaucggggagagcucccccagccccaccgucgaggagucccgcacgauccgggugcugaagaugguggagcccuggcucaagaacaaccaguucugcaucaagguccugaaccccuacaugcccaccgugaucgagcaccuggagcgccuccagcgcaagcacggcggcaugcuggugcggaacccccugagccgcaacuccacccacgagauguacuggaucagcaacgggaccggcaacaucgucuccagcgugaacauggugucccggcuccugcugaaccgcuucacgaugacccaccggcgccccaccaucgagaaggacgucgaccucggggccggcacccggcacgugaacgccgagccggagacgcccaacauggacgucaucggcgagcgcauccggcgcaucaaggaggagcacagcuccaccuggcacuacgacgacgagaaccccuacaagaccugggccuaccacgggagcuacgaggugaaggccaccggcuccgcgagcagcaugaucaacgggguggucaagcugcugacgaagccgugggacguggugcccauggucacccagauggccaugaccgacaccacgcccuucggccagcagcggguguucaaggagaagguggacacccgcacgccccggccgaugcccgggacccgcaaggucauggagaucacggccgaguggcucuggcggacccugggccgcaacaagcggccccgccugugcacccgggaggaguucaucaagaaggugcgcaccaacgccgcgaugggcgccguguucacggaggagaaccagugggacuccgcccgcgccgccgucgaggacgaggaguucuggaagcucguggaccgggagcgcgagcugcacaagcuggggaagugcggcagcugcguguacaacaugauggggaagcgggagaagaagcucggcgaguucgggaaggcgaagggcucccgcgccaucugguacauguggcugggcgcccgguaccuggaguucgaggcccucggguuccugaacgaggaccacugguucagccgcgagaacucccacagcggcgucgagggggagggccugcacaagcucggguacauccugcgggacaucuccaagauccccggcggcgccauguacgcggacgacaccgccgggugggacacccgcaucaccgaggacgaccugcacaacgaggagaagaucacgcagcagauggacccggagcaccggcagcucgccaacgccaucuucaagcugaccuaccagaacaagguggugaagguccagcgccccacccccaagggcaccgugauggacaucaucagccggaaggaccagcgcggguccggccaggugggcacguacgggcugaacaccuucaccaacauggaggcccagcucauccggcagauggagggcgaggggguccugagcaaggcggaccuggagaacccccaccuccuggagaagaaggugacccaguggcuggagaccaagggcguggagcgccucaagcggauggccaucuccggggacgacugcgucgugaagccgaucgacgaccgcuucgccaacgcccugcuggcccucaacgacaugggcaaggugcggaaggacaucccccaguggcagcccagcaagggcuggcacgacuggcagcagguccccuucugcucccaccacuuccacgagcugaucaugaaggacgggcgcaagcugguggugccgugccggccccaggacgagcucaucggccgcgcgcggaucagccagggggccggcuggucccugcgcgagacggccugccuggggaaggccuacgcgcagaugugggcccucauguacuuccaccgccgggaccugcgccuggccagcaacgccaucugcuccgccguccccgugcacugggugcccaccagccggaccaccugguccauccacgcgcaccaccaguggaugacgaccgaggacaugcucaccgucuggaaccgcguguggaucgaggacaacccguggauggaggacaagacccccgugacgaccugggaggacguccccuaccugggcaagcgggaggaccaguggugcggcagccugaucgggcucaccagccgcgccaccugggcccagaacauccugacggccauccagcagguccggucccugaucggcaacgaggaguuccucgacuacaugcccagcaugaagcgcuuccggaaggaggaggaguccgagggggccaucugguga

SEQ ID NO: 10375 - RNA, 9873 nt, Artificial Sequence
  derived and/or modified CDS sequence (opt1) from DENV-3__JQ920488__SS-prME
accagccugugccugaugaugaugcugcccgccacccuggccuuccaccucaccagccgggacggcgagccccggaugaucguggggaagaacgagcggggcaagagccugcuguucaagaccgccuccgggaucaacaugugcacccucaucgccauggaccugggcgagaugugcgacgacaccgugaccuacaagugcccccugaucaccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagacguggaugagcgcggagggcgccuggcgccagguggagaaggucgagaccugggccuuccgccaccccggguucaccauccucgcccuguuccuggcgcacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacgugaccacggacagccgcugccccacccagggcgaggcgauccugcccgaggagcaggaccagaacuacgucugcaagcacaccuacguggaccggggguggggcaacgggugcggccucuucgggaagggcucccuggugaccugcgccaaguuccagugccuggagagcaucgagggcaaggccguccagcacgagaaccucaaguacacggugaucaucaccgugcacaccggggaccagcaccaggucggcaacgagacccagggggugacggccgagaucacgccccaggccuccaccgucgaggcgauccugcccgaguacggcacccuggggcucgagugcagcccccgcaccggccuggacuucaacgagaugauccugcucacgaugaagaacaaggccuggauggugcaccggcagugguucuucgaccugccgcugcccuggaccuccggcgccaccaccgagacgcccaccuggaacaagaaggagcuccuggugaccuucaagaacgcccacgccaagaagcaggaggucguggugcuggggagccaggagggcgcgaugcacaccgcccucacgggggccaccgagauccagaccuccggcgggaccagcaucuucgccggccaccugaagugccgccugaagauggacaagcucgagcugaagggcauguccuacgccaugugccugaacgcguucguccucaagaaggaggugagcgagacgcagcacgggaccauccugaucaagguggaguacaagggcgaggacgcccccugcaagauccccuucagcaccgaggacgggcagggcaaggcccacaacggccggcugaucaccgccaaccccaucgucacgaagaaggaggagcccgugaacaucgaggcggagcccccguucggggaguccaacaucgugaucggcaucggggacaaggcccugaagaucaacugguacaagaagggcagcuccaucgggaagauguucgaggccaccgcccgcggcgcccggcgcauggcgauccucggcgacaccgccugggacuucgggagcgucggcggggugcugaacucccugggcaagauggugcaccagaucuucgggagcgccuacaccgcccucuucuccggcgucagcuggaucaugaagaucggcaucggggugcugcugacguggaucggccucaacuccaagaacaccagcauguccuucagcugcaucgugaucgggaucaucacccuguaccugggcgccgucgugcaggcggacauggggugcgugaucaacuggaagggcaaggagcucaagugcggcuccgggaucuucgucaccaacgaggugcacacguggaccgagcaguacaaguuccaggccgacagccccaagcggcuggccaccgccaucgccggcgcgugggagaacggggugugcggcauccgcuccaccacgcgcauggagaaccugcucuggaagcagaucgccaacgagcugaacuacauccugugggagaacaacaucaagcucaccaucgucgugggggacgugaucggcguccuggagcagggcaagcggacccugacgccccagcccauggagcucaaguacagcuggaagacgugggggaaggccaagaucgugaccgccgagacccagaacuccagcuucaucaucgacggcccgaacacccccgagugccccuccgcgcugcgcgccuggaacgugugggaggucgaggacuacggguucggcguguucacgaccaacaucuggcugaagcuccgggagaaguacacccagcugugcgaccaccgccugaugagcgccgccgugaaggacgagcgggccguccacgcggacaugggcuacuggaucgagagccagaagaacgaguccuggaagcucgagaaggccagccugaucgaggugaagaccugcaccuggcccaagucccacacgcuguggagcaacggggugcucgaguccgacaugaucauccccaagagccuggccggccccaucucccagcacaacuaccgccccggguaccacacccagaccgccggcccguggcaccuggggaagcucgagcuggacuucaacuacugcgagggcaccacggucgugaucaccgagaacugcggcauccgggggcccagccugcgcaccaccacgguguccggcaagcucauccacgaguggugcugccggagcugcacccugccgccccugcgcuacaugggggaggacggcugcugguacgggauggagauccggccgaucaacgagaaggaggagaacauggucaagucccucgugagcgccggcuccggcaagaccgacaacuucaccaugggggugcugugccuggcgauccucuucgaggaggucaugcgcggcaaguucgggaagaagcacaugaucgccggcgcccuguucacguucgugcugcuccugagcgggcagaucaccuggcgggacauggcccacacccugaucaugaucggcuccaacgccagcgaccgcaugggcaugggggugaccuaccucgcgcugaucgccacguucaagauccagcccuuccuggcccucggcuucuuccugcggaagcugaccucccgcgagaaccuccugcugggggucggccucgccauggcgaccacccugcagcugcccgaggacaucgagcagauggccaacggcaucgcccucgggcugauggcccugaagcucaucacgcaguucgagaccuaccagcuguggaccgcccugaucagccucaugugcagcaacaccaucuucacgcugaccguggcguggcggaccgccacccugauccucgccgugaucucccugcugcccgucugccagagcuccagcaugcgcaagacggacuggcucccgaugaccguggccgccaugggcgugccgccccugccccuguucaucuucucccucaaggacacccugaagcggcgcagcuggccgcugaacgagggggucauggcggugggccucgucuccauccuggccagcuccuuccugcgcaacgacgugcccauggccgggccccucguggccggcggccugcugaucgccugcuacgucaucaccgggacgagcgcggaccucaccguggagaaggccgccgacgugaccugggaggaggaggccgagcagaccggcgucucccacaaccugaugaucacgguggacgacgacgggaccaugcggaucaaggacgacgagaccgagaacauccugaccgugcuccugaagaccgcccugcucaucgucagcggcaucuuccccuacuccaucccggcgacgcugcugguguggcacaccuggcagaagcagacccagcgcagcggggugcucugggacguccccagcccgcccgagacccagaaggccgagcuggaggagggcguguaccggaucaagcagcagggcaucuucgggaagacccaggugggcgucggggugcagaaggagggcguguuccacaccauguggcacgucacccgcggggccgugcugacccacaacggcaagcggcucgagccgaacugggccaacgugaagaaggaccugaucagcuacggcgggggcuggaagcugggggcgcaguggcagaagggcgaggagguccaggugaucgccguggagcccgggaagaaccccaagaacuuccagacgaugcccggcaucuuccagaccaccaccggcgagaucggggccaucgcccuggacuucaagccgggcacguccgggagccccaucaucaaccgcgagggcaaggucgugggccucuacgggaacggcguggucaccaagaacgggggcuacguguccgggaucgcccagaccaacgcggagcccgacggcccgacccccgagcuggaggaggagauguucaagaagcggaaccugacgaucauggaccuccaccccggcagcgggaagacccgcaaguaccugcccgccaucgugcgggaggccaucaagcgccggcugcgcacccucauccuggccccgacccgggucguggccgcggagauggaggaggcccugaagggccuccccauccgcuaccagacgaccgccaccaagagcgagcacaccgggcgggagaucguggaccugaugugccacgccacguucaccaugcgccugcucucccccguccgggugcccaacuacaaccugaucgugauggacgaggcccacuucaccgacccggcgagcaucgccgcccgcggcuacaucuccacccgggucgggaugggcgaggccgcggccaucuucaugacggccacgccgcccggcaccgccgacgccuucccccagagcaacgcgccgauccaggacgaggagcgcgacauccccgagcgguccuggaacagcgggaacgaguggaucaccgacuucgccggcaagacggugugguucgugcccuccaucaaggccgggaacgacaucgccaacugccugcgcaagaacggcaagaaggucauccagcucagccgcaagaccuucgacaccgaguaccagaagaccaagcugaacgacugggacuucguggugacgaccgacaucuccgagaugggggccaacuucaaggcggaccgggucaucgacccccgccggugccugaagccggugauccucaccgacggccccgagcgcgugauccuggccggccccaugcccgucaccguggccagcgccgcccagcggcgcgggcgggugggccgcaacucccagaaggagaacgaccaguacaucuucacggggcagccgcugaacaacgacgaggaccacgcgcacuggaccgaggccaagaugcuccuggacaacaucaacacccccgagggcaucauccccgcccuguucgagcccgagcgggagaaguccgccgcgaucgacggggaguaccgccucaagggcgagucccggaagaccuucgucgagcugaugcgccggggcgaccugccgguguggcucgcccacaagguggccagcgaggggaucaaguacaccgaccgcaaguggugcuucgacggcgagcggaacaaccagauccuggaggagaacauggacgucgagaucuggacgaaggagggggagaagaagaagcugcgcccccgguggcucgacgcccgcaccuacuccgacccccuggcccugaaggaguucaaggacuucgcggccggccgcaagagcaucgcccucgaccuggugaccgagaucggccgcguccccucccaccuggcccaccgcacccggaacgcccucgacaaccuggugaugcugcacacgagcgagcacgggggccgcgcguaccggcacgccguggaggagcucccggagaccauggagacccugcugcuccuggggcugaugauccuccugaccggcggggccaugcuguuccucaucuccggcaagggcaucgggaagacgagcaucggccugaucugcgucguggccagcuccgggaugcuguggauggccgacgugccccuccaguggaucgcgagcgccaucguccuggaguucuucaugauggugcugcucauccccgagccggagaagcagcgcacgccccaggacaaccagcuggccuacguggucaucggcauccugacccucgccgccaucguggcggccaacgagauggggcugcuggagaccacgaagcgggaccucggcauguccaaggagcccggcguggucagccccaccuccuaccuggacguggaccugcacccggccagcgccuggacccucuacgcgguggccaccacggucaucacccccaugcugcgccacaccaucgagaacuccaccgccaacgugagccuggccgccaucgcgaaccaggccgugguccucauggggcuggacaagggcuggcccaucuccaagauggaccugggggugccccuccuggcccugggcugcuacagccaggugaacccgcucacgcugaccgccgccguccugcuccuggugacccacuacgcgaucaucgggcccggccugcaggccaaggccacccgggaggcccagaagcgcacggccgcgggcaucaugaagaaccccaccguggacgggaucaugaccaucgaccucgaccccgucaucuacgacuccaaguucgagaagcagcugggccaggugaugcugcucgugcugugcgccguccagcugcuccugaugcggaccagcugggccuucugcgaggcccugacgcucgcgaccgggccgaucaccacccugugggagggcucccccggcaaguucuggaacacgaccaucgccgugagcauggccaacaucuuccgcggguccuaccuggccggcgccgggcucgcguucagcaucaugaaguccgugggcaccgggaagcggggcaccggcagccagggggagacgcugggcgagaaguggaagaagaagcugaaccagcucucccgcaaggaguucgaccuguacaagaaguccgggaucaccgaggucgaccggaccgaggccaaggagggccugaagcgcggggagaucacccaccacgccgugagccggggcuccgccaagcuccagugguucguggagcgcaacauggucauccccgagggccgggugaucgaccuggggugcggccgcgggggcuggagcuacuacugcgccgggcugaagaaggugaccgagguccggggcuacacgaagggcgggcccggccacgaggagccggugcccauguccaccuacggguggaacaucgugaagcucaugagcggcaaggacgucuucuaccugccgcccgagaagugcgacacccugcugugcgacaucggggaguccagcccgucccccaccguggaggagagccgcacgauccgggugcucaagauggucgagcccuggcugaagaacaaccaguucugcaucaaggugcugaaccccuacaugccgaccgugaucgagcaccucgagcgccugcagcgcaagcacggcggcaugcugguccggaacccccucucccgcaacagcacccacgagauguacuggaucuccaacgggaccggcaacaucgugagcuccgugaacauggucagccggcugcugcucaaccgcuucacgaugacccaccggcgccccaccaucgagaaggacguggaccugggggcgggcacccggcacgugaacgccgagcccgagacgccgaacauggacgucaucggcgagcgcauccggcgcaucaaggaggagcacuccagcaccuggcacuacgacgacgagaaccccuacaagaccugggccuaccacggguccuacgaggugaaggccaccggcagcgccuccagcaugaucaacggggucgugaagcugcucacgaagcccugggacguggucccgauggugacccagauggcgaugaccgacaccacgcccuucggccagcagcggguguucaaggagaaggucgacacccgcacgccccggcccaugccggggacccgcaaggugauggagaucaccgccgaguggcuguggcggacccugggccgcaacaagcggccccgccucugcacccgggaggaguucaucaagaaggugcgcaccaacgccgccaugggcgcggucuucacggaggagaaccagugggacagcgcccgcgccgccguggaggacgaggaguucuggaagcugguggaccgggagcgcgagcugcacaagcucgggaagugcggcuccugcgucuacaacaugauggggaagcgggagaagaagcugggcgaguucgggaaggccaagggcagccgcgcgaucugguacauguggcugggcgcccgguaccucgaguucgaggcccugggguuccugaacgaggaccacugguucucccgcgagaacagccacuccggcguggagggggagggccuccacaagcugggguacauccugcgggacaucagcaagauccccggcggcgccauguacgccgacgacaccgcggggugggacacccgcaucaccgaggacgaccuccacaacgaggagaagaucacgcagcagauggaccccgagcaccggcagcuggccaacgccaucuucaagcugaccuaccagaacaagguggucaaggugcagcgcccgacccccaagggcaccgugauggacaucaucucccggaaggaccagcgcgggagcggccaggucggcacguacgggcucaacaccuucaccaacauggaggcccagcugauccggcagauggagggcgagggggugcuguccaaggccgaccucgagaacccccaccuccuggagaagaaggugacccaguggcucgagaccaagggcgucgagcgccugaagcggauggcgaucagcggggacgacugcguggugaagcccaucgacgaccgcuucgccaacgcccugcucgcccugaacgacaugggcaagguccggaaggacaucccgcaguggcagcccuccaagggcuggcacgacuggcagcagguccccuucugcagccaccacuuccacgagcugaucaugaaggacgggcgcaagcucgugguccccugccggccgcaggacgagcugaucggccgcgcccggaucucccagggggcgggcuggagccugcgcgagacggccugccucgggaaggccuacgcccagaugugggcgcugauguacuuccaccgccgggaccugcgccucgccuccaacgccaucugcagcgccgugcccgugcacuggguccccaccucccggaccaccuggagcauccacgcccaccaccaguggaugacgaccgaggacaugcugaccguguggaaccgcguguggaucgaggacaaccccuggauggaggacaagaccccggucacgaccugggaggacgugcccuaccugggcaagcgggaggaccaguggugcggcucccucaucgggcugaccagccgcgcgaccugggcccagaacauccugacggccauccagcagguccggagccucaucggcaacgaggaguuccuggacuacaugcccuccaugaagcgcuuccggaaggaggaggagagcgagggggccaucugguga

SEQ ID NO: 10376 - RNA, 9873 nt, Artificial Sequence
  derived and/or modified CDS sequence (opt1) from DENV-3__JQ920489__SS-prME
accagccucugccucaugaugaugcugcccgccacccuggccuuccaccucaccagccgggacggcgagccccggaugaucguggggaagaacgagcggggcaagagccugcuguucaagaccgccagcgggaucaacaugugcacccucaucgccauggaccugggcgagaugugcgacgacaccgugaccuacaagugcccccugaucaccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgcggagggcgccuggcgccagguggagaaggucgagaccugggccuuccgccaccccggguucaccauccucgcccuguuccuggcgcacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacaucaccacggacagccgcugccccacccagggcgaggcgauccugcccgaggagcaggaccagaacuacgugugcaagcacaccuacgucgaccggggguggggcaacgggugcggccucuucgggaagggcucccuggugaccugcgccaaguuccagugccuggagagcaucgagggcaaggccgugcagcacgagaaccucaaguacacggucaucaucaccgugcacaccggggaccagcaccaggugggcaacgagacccagggggucacggccgagaucacgccccaggccuccaccguggaggcgauccugcccgaguacggcacccuggggcucgagugcagcccccgcaccggccuggacuucaacgagaugauccugcucacgaugaagaacaaggccuggaugguccaccggcagugguucuucgaccugccgcugcccuggaccuccggcgccaccaccgagacgcccaccuggaacaagaaggagcuccuggugaccuucaagaacgcccacgccaagaagcaggagguggucgugcuggggagccaggagggcgcgaugcacaccgcccucacgggggccaccgagauccagaccuccggcgggaccagcaucuucgccggccaccugaagugccgccugaagauggacaagcucgagcugaagggcauguccuacgccaugugccugaacgcguucgugcucaagaaggaggucagcgagacgcagcacgggaccauccugaucaagguggaguacaagggcgaggacgcccccugcaagauccccuucagcaccgaggacgggcagggcaaggcccacaacggccggcugaucaccgccaaccccaucgugacgaagaaggaggagcccgucaacaucgaggcggagccgcccuucggggaguccaacaucgugaucggcaucggggacaaggcccugaagaucaacugguacaagaagggcagcuccaucgggaagauguucgaggccaccgcccgcggcgcccggcgcauggcgauccucggcgacaccgccugggacuucgggagcgugggcgggguccugaacucccugggcaagauggugcaccagaucuucgggagcgccuacaccgcccucuucuccggcgugagcuggaucaugaagaucggcaucgggguccugcugacguggaucggccucaacuccaagaacaccagcauguccuucagcugcaucgugaucgggaucaucacccuguaccugggcgccgugguccaggcggacauggggugcgugaucaacuggaagggcaaggagcucaagugcggcuccgggaucuucgugaccaacgagguccacacguggaccgagcaguacaaguuccaggccgacagccccaagcggcuggccaccgccaucgccggcgcgugggagaacggggugugcggcauccgcuccaccacgcgcauggagaaccugcucuggaagcagaucgccaacgagcugaacuacauccugugggagaacaacaucaagcucaccaucguggucggggacgugaucggcgugcuggagcagggcaagcggacccugacgccccagcccauggagcucaaguacagcuggaagacgugggggaaggccaagaucgucaccgccgagacccagaacuccagcuucaucaucgacggccccaacacccccgagugccccuccgcgagccgcgccuggaacgugugggagguggaggacuacggguucggcgucuucacgaccaacaucuggcugaagcugcgggagaaguacacccagcucugcgaccaccgccugaugagcgccgccgugaaggacgagcgggccgugcacgcggacaugggcuacuggaucgagucccagaagaacgggagcuggaagcuggagaaggccucccucaucgaggucaagaccugcaccuggcccaagagccacacgcugugguccaacggcgugcuggagagcgacaugaucaucccgaagucccucgccgggcccaucagccagcacaacuaccgccccggcuaccacacccagaccgccgggccguggcaccugggcaagcuggagcucgacuucaacuacugcgagggcaccacgguggucaucaccgagaacugcgggauccggggccccucccugcgcaccaccacggugagcgggaagcugauccacgaguggugcugccgguccugcacccugccgccccuccgcuacaugggcgaggacgggugcugguacggcauggagauccggccgaucaacgagaaggaggagaacauggucaagagccuggucuccgccggcagcgggaagaccgacaacuucaccaugggcgugcucugccuggcgauccuguucgaggaggugaugcgcgggaaguucggcaagaagcacaugaucgccggggcccucuucacguucguccugcugcucuccggccagaucaccuggcgggacauggcccacacccugaucaugaucggcagcaacgccuccgaccgcauggggaugggcgugaccuaccuggcgcucaucgccacguucaagauccagcccuuccuggcccugggguucuuccuccggaagcugaccagccgcgagaaccugcuccugggcgugggccuggccauggcgaccacccuccagcugcccgaggacaucgagcagauggccaacgggaucgcccugggccucauggcccugaagcugaucacgcaguucgagaccuaccagcucuggaccgcccugaucagccugaugugcuccaacaccaucuucacgcucaccgucgcguggcggaccgccacccugauccuggccgugaucagccuccugcccgugugccaguccagcuccaugcgcaagacggacuggcugccgaugaccgucgccgccaugggggugccgccccucccccuguucaucuucagccugaaggacacccucaagcggcgcuccuggccgcugaacgagggcgugauggcggucgggcuggugagcauccucgccuccagcuuccugcgcaacgacguccccauggccggcccccugguggccggcgggcuccugaucgccugcuacgugaucaccggcacguccgcggaccugaccgucgagaaggccgccgacgugaccugggaggaggaggccgagcagaccggggugagccacaaccucaugaucacggucgacgacgacggcaccaugcggaucaaggacgacgagaccgagaacauccugaccgugcugcucaagaccgcccugcugaucguguccgggaucuuccccuacagcaucccggcgacgcuccuggucuggcacaccuggcagaagcagacccagcgcuccggcgugcugugggacgugcccuccccgcccgagacccagaaggccgagcucgaggagggcgucuaccggaucaagcagcaggggaucuucggcaagacccaggugggggugggcguccagaaggaggggguguuccacaccauguggcacgugacccgcggcgccguccugacccacaacggcaagcggcuggagccgaacugggccaacgugaagaaggaccucaucuccuacgggggcggguggaagcugagcgcgcaguggcagaagggcgaggaggugcaggucaucgccguggagcccgggaagaaccccaagaacuuccagacgaugcccggcaucuuccagaccaccaccggcgagaucggggccaucgcccuggacuucaagccgggcacguccgggagccccaucaucaaccgcgagggcaagguggucggccuguacgggaacggcguggugaccaagaacgggggcuacgucagcgggaucgcccagaccaacgcggagcccgacggcccgacccccgagcucgaggaggagauguucaagaagcggaaccugacgaucauggaccugcaccccggcuccgggaagacccgcaaguaccuccccgccaucgugcgggaggccaucaagcgccggcugcgcacccugauccucgccccgacccggguggucgccgcggagauggaggaggcccugaagggccugcccauccgcuaccagacgaccgccaccaagagcgagcacaccgggcgggagaucguggaccucaugugccacgccacguucaccaugcgccugcugucccccgugcggguccccaacuacaaccucaucgugauggacgaggcccacuucaccgacccggcgagcaucgccgcccgcggcuacaucuccacccggguggggaugggcgaggccgcggccaucuucaugacggccacgccgcccggcaccgccgacgccuucccccagagcaacgcgccgauccaggacgaggagcgcgacauccccgagcgguccuggaacagcgggaacgaguggaucaccgacuucgccggcaagacggucugguucgugcccuccaucaaggccgggaacgacaucgccaacugccugcgcaagaacggcaagaaggugauccagcugagccgcaagaccuucgacaccgaguaccagaagaccaagcucaacgacugggacuucgucgugacgaccgacaucuccgagaugggggccaacuucaaggcggaccgggugaucgacccccgccggugccugaagccggucauccugaccgacggccccgagcgcgugauccucgccggccccaugcccgugaccgucgccagcgccgcccagcggcgcgggcgggugggccgcaacucccagaaggagaacgaccaguacaucuucacggggcagccgcugaacaacgacgaggaccacgcgcacuggaccgaggccaagaugcugcucgacaacaucaacacccccgagggcaucauccccgcccuguucgagcccgagcgggagaaguccgccgcgaucgacggggaguaccgccugaagggcgagucccggaagaccuucguggagcucaugcgccggggcgaccugccggucuggcuggcccacaagguggccagcgaggggaucaaguacaccgaccgcaaguggugcuucgacggcgagcggaacaaccagauccucgaggagaacauggacguggagaucuggacgcgcgagggggagaagaagaagcugcggccccgcuggcuggacgcccggaccuacuccgacccccucgcccugaaggaguucaaggacuucgcggccggccgcaagagcaucgcccuggaccucgucaccgagaucggccgcgugcccucccaccuggcccaccggacccgcaacgcccuggacaaccucgucaugcugcacacgagcgagcacgggggccgggcguaccgccacgccguggaggagcugccggagaccauggagacccuccugcugcucgggcugaugauccugcucaccggcggggccaugcuguuccugaucagcggcaagggcaucgggaagacguccaucggccucaucugcguggucgccagcuccgggaugcuguggauggccgacgugccccugcaguggaucgcgagcgccaucgugcucgaguucuucaugaugguccugcugauccccgagccggagaagcagcggacgccccaggacaaccagcucgccuacguggugaucggcauccugacccuggccgccaucgucgcggccaacgagauggggcuccuggagaccacgaagcgcgaccugggcauguccaaggagcccggcguggugagccccaccuccuaccucgacgucgaccugcacccggccagcgccuggacccuguacgcgguggccaccacggugaucacccccaugcuccggcacaccaucgagaacuccaccgccaacgucagccuggccgccaucgcgaaccaggccguggugcugauggggcucgacaagggcuggcccaucuccaagauggaccugggggucccccugcucgcccugggcugcuacagccaggugaacccgcugacgcucaccgccgccgugcugcugcucgucacccacuacgcgaucaucgggcccggccugcaggccaaggccacccgcgaggcccagaagcggacggccgcgggcaucaugaagaaccccaccguggacgggaucaugaccaucgaccuggaccccgugaucuacgacuccaaguucgagaagcagcucggccaggucaugcugcuggugcucugcgccgugcagcugcugcucaugcgcaccagcugggccuucugcgaggcccugacgcuggcgaccgggccgaucaccacccucugggagggcucccccggcaaguucuggaacacgaccaucgccgucagcauggccaacaucuuccggggguccuaccuggccggcgccgggcuggcguucagcaucaugaaguccgugggcaccgggaagcgcggcaccggcagccagggggagacgcucggcgagaaguggaagaagaagcugaaccagcugagccggaaggaguucgaccucuacaagaaguccgggaucaccgagguggaccgcaucgaggccaaggagggccugaagcgcggggagaucacccaccacgccgucagccgcggcuccgccaagcugcagugguucguggagcggaacauggugauccccgagggccgcgucaucgaccucgggugcggccgcgggggcuggagcuacuacugcgccgggcugaagaaggugaccgaggugcgcggcuacaccaagggcgggcccggccacgaggagccgguccccauguccacguacggguggaacaucgugaagcugaugagcggcaaggacguguucuaccugccgcccgagaagugcgacacccugcugugcgacaucggggaguccagcccgucccccaccgucgaggagagccggaccauccgcgugcugaagaugguggagcccuggcucaagaacaaccaguucugcaucaagguccugaaccccuacaugccgacggugaucgagcaccuggagcgccuccagcggaagcacggcggcaugcuggugcgcaacccccugucccggaacagcacccacgagauguacuggaucuccaacgggaccggcaacaucgucagcuccgugaacauggugagccgccuccugcugaaccgguucaccaugacgcaccgccggcccaccaucgagaaggacgucgaccucggggcgggcacccgccacgugaacgccgagcccgagaccccgaacaugaacgugaucggcgagcggauccgccggaucaaggaggagcacuccagcacguggcacuacgacgacgagaaccccuacaagaccugggccuaccacggguccuacgaggucaaggccaccggcagcgccagcuccaugaucaacgggguggucaagcugcugaccaagcccugggacguggugccgauggucacgcagauggcgaugaccgacaccacccccuucggccagcagcgcguguucaaggagaagguggacacgcggacgccccggcccaugccggggacccggaaggucauggagaucaccgccgaguggcucuggcgcacgcugggccggaacaagcgcccccggcugugcacccgcgaggaguucaucaagaaggugcgcaccaacgccgccaugggcgcgguguucaccgaggagaaccagugggacagcgcccgggccgccgucgaggacgaggaguucuggaagcucguggaccgcgagcgggagcugcacaagcuggggaagugcggcuccugcguguacaacaugauggggaagcgcgagaagaagcucggcgaguucgggaaggccaagggcagccgggcgaucugguacauguggcugggcgcccgcuaccuggaguucgaggcccucggguuccugaacgaggaccacugguucucccgggagaacagccacuccggcgucgagggggagggccugcacaagcucggguacauccugcgcgacaucagcaagauccccggcggcgccauguacgccgacgacacggcggggugggacacccggaucaccgaggacgaccugcacaacgaggagaagaucacccagcagauggaccccgagcaccgccagcucgccaacgccaucuucaagcugacguaccagaacaagguggugaagguccagcggccgacccccaagggcaccgugauggacaucaucucccgcaaggaccagcgggggagcggccaggugggcaccuacgggcugaacacguucaccaacauggaggcccagcucauccgccagauggagggcgaggggguccuguccaaggccgaccuggagaacccccaccuccuggagaagaaggugacccaguggcuggagaccaagggcguggagcggcucaagcgcauggcgaucagcggggacgacugcgucgugaagcccaucgacgaccgguucgccaacgcccugcuggcccucaacgacaugggcaaggugcgcaaggacaucccgcaguggcagcccuccaagggcuggcacgacuggcagcagguccccuucugcagccaccacuuccacgagcugaucaugaaggacgggcggaagcugguggugcccugccgcccgcaggacgagcucaucggccgggcccgcaucucccagggggcgggcuggagccugcgcgagaccgccugccuggggaaggccuacgcccagaugugggcgcucauguacuuccaccggcgcgaccugcggcuggccuccaacgccaucugcagcgccguccccgugcacugggugcccacgucccgcaccaccuggagcauccacgcccaccaccaguggaugaccacggaggacaugcucaccgucuggaaccggguguggaucgaggacaaccccuggauggaggacaagaccccggugaccacgugggaggacguccccuaccugggcaagcgcgaggaccaguggugcggcagccugaucgggcucaccucccgggcgaccugggcccagaacauccugaccgccauccagcagguccgcagccugaucggcaacgaggaguuccucgacuacaugcccuccaugaagcgguuccgcaaggaggaggagagcgagggggccaucugguga

SEQ ID NO: 10377 - RNA, 9873 nt, Artificial Sequence
  derived and/or modified CDS sequence (opt1) from DENV-3__KF824902__SS-prME
accagccugugccucaugaugaugcugcccgccacccuggccuuccaccucacgucccgcgacggcgagccgcggaugaucguggggaagaacgagcgcggcaagagccugcuguucaagaccgcguccgggaucaacaugugcacccucaucgccauggaccugggcgagaugugcgacgacaccgucacguacaagugcccccugaucgccgagguggagcccgaggacaucgacugcuggugcaaccucaccagcaccugggugaccuacgggacgugcaaccaggccggcgagcaccggcgcgacaagcgguccgucgcccuggcgccccacgugggcauggggcuggacacccgcacccagaccuggaugagcgccgagggcgccuggcggcagguggagaaggucgagacgugggcccuccgccacccgggguucaccauccuggcgcuguuccucgcccacuacaucggcaccucccugacccagaagguggugaucuucauccugcucaugcuggucacgcccagcauggccaugcggugcgugggggugggcaaccgcgacuucgucgagggccuguccggggccaccuggguggacgugguccucgagcacggcgggugcgugaccaccauggccaagaacaagcccacgcuggacaucgagcugcagaagaccgaggcgacccagcucgccacccugcggaagcugugcaucgagggcaagaucacgaacaucaccaccgacagccgcugccccacccagggcgaggccauccucccggaggagcaggaccagaacuacgugugcaagcacacguacgucgaccggggguggggcaacgggugcggccuguucgggaagggcucccuggugaccugcgccaaguuccagugccucgagagcaucgagggcaaggugguccagcacgagaaccugaaguacaccgugaccaucacggugcacaccggggaccagcaccaggucggcaacgacacccagggggugaccgccgagaucacgccccaggcguccaccgucgaggccauccugcccgaguacggcacccucgggcuggagugcagcccccgcaccggccuggacuucaacgagaugauccuccugaccaugaagaacaaggccuggauggugcaccggcagugguucuucgaccugccgcuccccuggacguccggcgccaccaccgagacccccacguggaaccgcaaggagcugcuggugaccuucaagaacgcccacgcgaagaagcaggaggucguggugcucgggagccaggagggcgccaugcacaccgcccugaccggggccacggagauccagaacuccggcgggaccagcaucuucgccggccaccugaagugccggcucaagauggacaagcuggagcugaagggcauguccuacgcgaugugccucaacaccuucguccugaagaaggaggugagcgagacccagcacgggacgauccugaucaagguggaguacaagggcgaggacgcccccugcaagaucccguucagcaccgaggacgggcagggcaaggcccacaacggccgccugaucaccgccaaccccgucgugaccaagaaggaggagcccgugaacaucgaggcggagcccccguucggggaguccaacaucgucaucggcaucggggacaaggcccucaagaucaacugguacaagaagggcagcuccaucgggaagauguucgaggccacggcccggggcgcccgccggauggcgauccugggcgacaccgccugggacuucgggagcgugggcggggugcugaacucccucggcaagaugguccaccagaucuucgggagcgccuacaccgcccuguucggcggcguguccuggaucaugaagaucgggaucggcgugcugcucaccuggaucgggcugaacagcaagaacacguccaugagcuucuccugcaucgucaucggcaucaucacccuguaccucgggaccguggugcaggccgacaugggcugcgucaucaacuggaagggcaaggagcugaagugcgggagcggcaucuucgugaccaacgaggugcacacguggaccgagcaguacaaguuccaggcggacucccccaagcgccuggccaccgccaucgccggggccugggagaacggcgucugcgggauccgcagcaccacgcggauggagaaccuccuguggaagcagaucgcgaacgagcugaacuacauccucugggagaacaacaucaagcugaccgugguggucggcgacaucaucggcgugcuggagcaggggaagcgcgcccucaccccccagcccauggagcugaaguacuccuggaagaccuggggcaaggccaagaucgugacggccgagauccagaacagcuccuucaucaucgacgggccgaacacccccgagugccccagcgcgucccgggccuggaacgucugggagguggaggacuacggcuucggcguguucaccaccaacaucuggcugaagcuccgcgaggucuacacgcagaccugcgaccaccggcugaugagcgccgccaucaaggacgagcgcgccgugcacgcggacaugggguacuggaucgagagccagaagaacggcuccuggaagcuggagaaggccagcuucaucgaggugaagaccugcaccuggcccaagacccacacgcucugguccaacgggguccuggagagcgacaugaucaucccgaagucccuggccggccccaucagccagcacaaccaccggcccggguaccacacccagaccgccggcccguggcaccucggcaagcuggagcuggacuucaacuacugcgaggggaccacgguggugaucaccgagaacugcggcacccgcgggcccucccuccggaccacgaccgucagcggcaagcugauccacgaguggugcugccgcuccugcacccugcccccccuccgguacaugggggaggacggcugcugguacggcauggagauccgcccgaucaacgagaaggaggagaacauggugaagagccugguguccgccgggagcggcaaggucgacaacuucaccaugggggugcugugccucgcgauccuguucgaggaggugaugcggggcaaguucgggaagaagcacaugaucgccggcguccuguucacguucaugcuccugcuguccggccagaucaccuggcgcgacauggcccacacccucaucaugaucgggagcaacgccuccgaccggaugggcaugggggugaccuaccuggcccugaucgcgacguucaagauccagcccuuccucgcccugggcuucuuccugcgcaagcucaccagccgggagaaccugcugcucggcguggggcuggccauggccaccacccugcagcuccccgaggacaucgagcagauggcgaacggcaucgcccuggggcugauggcccucaagcugaucacgcaguucgagaccuaccagcuguggaccgcccucgucucccugaccugcagcaacacgaucuucacccugaccguggccuggcgcaccgcgacgcucauccuggccggcgugagccugcuccccgucugccaguccagcuccaugcggaagaccgacuggcugccgguggccgucgccgccaugggggugcccccccugccccucuucaucuucagccugaaggacacccugaagcgccgcuccuggccgcucaacgagggcgugauggcggucggccuggugagcauccuggccuccagccuccugcggaacgacgugcccauggccgggccccuggucgccggcgggcuccugaucgccugcuacgugaucaccggcacguccgcggaccugaccguggagaaggccgccgacgucaccugggaggaggaggccgagcagaccggggugagccacaaccucaugaucacgguggacgacgacggcaccaugcgcaucaaggacgacgagaccgagaacauccugaccguccugcucaagaccgcccugcugaucguguccggcaucuuccccuacagcaucccggcgacgcuccugguguggcacaccuggcagaagcagacccagcgguccgggguccugugggacgugcccagcccccccgagacccagaaggccgagcucgaggagggcguguaccgcaucaagcagcaggggaucuucggcaagacgcaggucggggugggcgugcagaaggagggcgucuuccacaccauguggcacgugacccggggggccgugcugacccacaacggcaagcgccuggagccgaacugggccuccgucaagaaggaccucaucagcuacgggggcggguggcggcuguccgcgcaguggcagaagggcgaggaggugcaggugaucgccgucgagcccggccgcaaccccaagaacuuccagacgaugcccgggaucuuccagaccaccaccggcgagaucggggccaucgcccuggacuucaagccgggcacgagcggcucccccaucaucaaccgggaggggaagguggugggccuguacgggaacggcgucgugaccaagaacgggggcuacgugagcggcaucgcccaggcgaacgccgagcccgaggggccgacccccgagcucgaggaggagauguucaagaagcgcaaccugaccaucauggaccugcaccccggcagcgggaagacgcggaaguaccuccccgccaucguccgcgaggccaucaagcggcgccugcggacccugauccucgccccgacccgcgugguggcggccgagauggaggaggcccugaagggccugcccauccgguaccagaccacggccaccaaguccgagcacaccgggcgcgagaucgucgugcucaugugccacgccaccuucacgaugcggcugcugagccccgugcgcguccccaacuacaaccucaucaucauggacgaggcgcacuucaccgacccggccuccaucgccgcccggggcuacaucagcacccgcgugggcaugggggaggcggccgccaucuucaugaccgccacgccccccggcaccgccgaggcguucccccaguccaacgccccgauccaggacgaggagcgcgacauccccgagcggagcuggaacuccgggaacgaguggaucaccgacuucgugggcaagaccgucugguucgugcccagcaucaaggccgggaacgacaucgccaacugccugcgcaagaacggcaagaaggugauccagcugucccggaagacguucgacaccgaguaccagaagaccaagcucaacgacugggacuucgucgugaccacggacaucagcgagaugggcgccaacuucaaggcggaccgcgugaucgacccccggcgcugccugaagccggucauccugaccgacgggcccgagcgggugauccucgccggccccaugcccgugaccgccgccuccgccgcgcagcgccgggggcgcgucggccggaacccgcagaaggagaacgaccaguacaucuucauggggcagccccugaacaacgacgaggaccacgcccacuggaccgaggccaagaugcugcucgacaacaucaacacgcccgagggcaucauccccgcccuguucgagccggagcgcgagaagagcgcggccaucgacggcgaguaccggcugaagggggagucccgcaagaccuucguggagcucaugcggcgcggcgaccugcccgucuggcuggcccacaagguggccagcgaggggaucaaguacaccgaccggaaguggugcuucgacggcgagcgcaacaaccagauccucgaggagaacauggacguggagaucuggaccaaggagggcgagcggaagaagcugcgcccccgcuggcuggacgcccggaccuacuccgacccccucgcgcugaaggaguucaaggacuucgccgccgggcgcaagagcaucgcccuggaccucgucacggagaucggccgggugccgucccaccuggcccaccgcacccggaacgcgcuggacaaccucgugaugcugcacaccagcgagcacgggggccgcgccuaccggcacgccgucgaggagcugcccgagaccauggagacgcuccugcugcucgggcugaugauccugcucaccggcggcgccaugcuguuccugaucuccgggaagggcaucgggaagaccagcaucggccucaucugcgugaucgugagcuccgggaugcuguggauggccgacgucccccugcaguggaucgcgagcgccaucgugcucgaguucuucaugauggugcugcugaucccggagcccgagaagcagcgcaccccccaggacaaccagcucgccuacgucgugaucggcauccugacgcuggccgccaucguggcggccaacgagaugggccuccuggagaccaccaagcgggaccuggggauguccaaggagcccggcgucgugagcccgaccuccuaccucgacguggaccugcaccccgccagcgccuggacgcuguacgcggucgccaccaccgugaucacccccaugcuccgccacacgaucgagaacuccaccgccaacgugagccuggccgccaucgcgaaccaggccgucgugcugauggggcucgacaagggcuggcccaucuccaagauggaccugggggugccgcugcucgcccugggcugcuacagccaggucaacccccugacccucaccgccgccgugcugcugcucgugacgcacuacgcgaucaucggccccgggcugcaggccaaggccacccgggaggcccagaagcgcaccgccgcgggcaucaugaagaaccccaccgucgacgggaucaugacgaucgaccuggacccggugaucuacgacuccaaguucgagaagcagcucggccaggugaugcugcugguccucugcgccgugcagcugcugcucaugcggaccagcugggcccugugcgaggcccugacccucgcgaccggccccaucacgacccugugggaggggucccccggcaaguucuggaacaccaccaucgccgugagcauggccaacaucuuccgcggguccuaccuggccggcgccgggcucgcguucagcaucaugaaguccgucggcacgggcaagcgggggaccggcagccagggggagacccugggcgagaaguggaagaagaagcugaaccagcucucccgccgggaguucgagcuguacaagaagagcgggaucaccgagguggaccgcacggaggccaaggagggccugaagcggggcgagaccacccaccacgccgugagccgcggguccgccaagcuccagugguucgucgagcggaacauggugauccccgagggccgcgugaucgaccuggggugcggccgcgggggcuggagcuacuacugcgccggccugaagaaggucaccgaggugcggggguacaccaagggcgggccgggccacgaggagcccgugcccauguccacguacggguggaacaccgucaagcucaugagcggcaaggacguguucuaccugcccccggagaagugcgacacccugcugugcgacaucggcgaguccagccccucccccaccguggaggagagccgcacgauccggguccucaagaugguggagcccuggcugaagaacaaccaguucugcaucaaggugcugaacccguacaugcccaccgucaucgagcaccucgagcgccugcagcggaagcacgggggcaugcuggugcgcaacccccucucccggaacagcacccacgagauguacuggaucuccaacgggaccggcaacaucgugagcuccgucaacauggugagccgccugcugcucaaccgguucacgaugacccaccgccggcccaccaucgagaaggacgucgaccugggcgcggggacccgccacgugaacgccgagccggagacgcccaacauggacgugaucggcgagcggaucaagcgcaucaaggaggagcacuccagcaccuggcacuacgacgacgagaaccccuacaagaccugggccuaccacggguccuacgaggucaaggccaccggcagcgccuccagcaugaucaacgggguggugaagcugcucacgaagccgugggacgucgugcccauggugacccagauggcgaugaccgacaccacgcccuucggccagcagcgggucuucaaggagaagguggacacccgcaccccccggccgaugcccggcacccgcaaggugauggagaucacggccgaguggcuguggcggacccuggggcgcaacaagcgcccccggcucugcacccgcgaggaguucaccaagaagguccggacgaacgccgccaugggcgcgguguucaccgaggagaaccagugggagagcgcccgcgccgccguggaggacgaggaguucuggaagcuggucgggcgggagcgcgagcugcacaagcucggcaagugcggguccugcguguacaacaugaugggcaagcgggagaagaagcugggcgaguucgggaaggccaagggcagccgcgcgaucugguacauguggcugggggcccgguaccucgaguucgaggcccugggcuuccugaacgaggaccacugguucucccgcgagaacagcuacuccgggguggagggcgagggccuccacaagcugggguacauccugcgggacaucagcaagauccccggcggggccauguacgccgacgacaccgcgggcugggacacccgcaucacggaggacgaccuccacaacgaggagaagaucacccagcagauggacccggagcaccggcagcuggccaacgccaucuucaagcugaccuaccagaacaaggucgugaaggugcagcgccccacccccaagggcacggucauggacaucaucucccggaaggaccagcgcgggagcggccagguggggaccuacggccucaacaccuucaccaacauggaggcccagcugauccggcagauggagggggagggcgugcuguccaaggccgaccucgagaacccccaccugcuggagaagaagaucacccaguggcucgagacgaagggcgucgagcgccugaagcggauggcgaucagcggggacgacugcguggugaagccgaucgacgaccgcuucgccaacgcccugcucgcccugaacgacaugggcaagguccggaaggacaucccccaguggcagcccuccaagggguggcacgacuggcagcaggugcccuucugcagccaccacuuccacgagcugaucaugaaggacggccgcaagcucguggucccgugccgcccccaggacgagcugaucgggcgggcccgcaucucccagggcgcgggcuggagccugaaggagaccgccugccucgggaaggccuacgcccagauguggucccugauguacuuccaccggcgcgaccugcggcucgcgagcaacgccaucugcuccgccgugcccgugcacuggguccccaccagccgcaccacgugguccauccacgcccaccaccaguggaugaccaccgaggacaugcugaccguguggaaccggguguggaucgaggacaacccguggauggaggacaagacgcccgucaccaccugggaggacgugcccuaccugggcaagcgcgaggaccaguggugcgggagccucaucggccugaccagccgggccacgugggcgcagaacauccugaccgccauccagcaggugcgcucccucaucggggacgaggaguuccuggacuacaugcccagcaugaagcgguuccgcaaggaggaggaguccgagggcgccaucugguga

SEQ ID NO: 10378 - RNA, 9873 nt, Artificial Sequence
  derived and/or modified CDS sequence (opt1) from DENV-3__KF824903__SS-prME
accagccugugccucaugaugaugcugcccgccacccuggccuuccaccucaccagccgggacggcgagccccggaugaucguggggaagaacgagcggggcaagagccugcuguucaagaccgcgagcgggaucaacaugugcacccucaucgccauggaccugggcgagaugugcgacgacaccgugaccuacaagugcccccugaucgccgagguggagcccgaggacaucgacugcuggugcaaccucaccagcaccugggugaccuacgggacgugcaaccaggccggcgagcaccggcgcgacaagcgguccguggcccuggcgccccacgugggcauggggcuggacacccgcacccagaccuggaugagcgccgagggcgccuggcgccagguggagaaggucgagacgugggcccuccgccaccccggguucaccauccuggcgcuguuccucgcccacuacaucggcaccucccugacccagaagguggugaucuucauccugcucaugcuggucacgcccagcauggccaugcggugcgugggggugggcaaccgcgacuucgucgagggccuguccggggccaccuggguggacgugguccucgagcacggcgggugcgugaccaccauggccaagaacaagcccacgcuggacaucgagcugcagaagaccgaggcgacccagcucgccacccugcggaagcugugcaucgagggcaagaucacgaacaucaccaccgacagccgcugccccacccagggcgaggccauccucccggaggagcaggaccagaacuacgugugcaagcacacguacgucgaccggggguggggcaacgggugcggccuguucgggaagggcucccuggugaccugcgccaaguuccagugccucgagagcaucgagggcaaggugguccagcacgagaaccugaaguacaccgugaccaucacggugcacaccggggaccagcaccaggucggcaacgacacccagggggugaccgccgagaucacgccccaggcguccaccgucgaggccauccugcccgaguacggcacccucgggcuggagugcagcccccgcaccggccuggacuucaacgagaugauccuccugaccaugaagaacaaggccuggauggugcaccggcagugguucuucgaccugccgcuccccuggacguccggcgccaccaccgagacccccacguggaaccgcaaggagcugcuggugaccuucaagaacgcccacgcgaagaagcaggaggucguggugcucgggagccaggagggcgccaugcacaccgcccugaccggggccacggagauccagaacuccggcgggaccagcaucuucgccggccaccugaagugccggcucaagauggacaagcuggagcugaagggcauguccuacgcgaugugccucaacaccuucguccugaagaaggaggugagcgagacccagcacgggacgauccugaucaagguggaguacaagggcgaggacgcccccugcaagaucccguucagcaccgaggacgggcagggcaaggcccacaacggccgccugaucaccgccaaccccgucgugaccaagaaggaggagcccgugaacaucgaggcggagcccccguucggggaguccaacaucgucaucggcaucggggacaaggcccucaagaucaacugguacaagaagggcagcuccaucgggaagauguucgaggccacggcccggggcgcccgccggauggcgauccugggcgacaccgccugggacuucgggagcgugggcggggugcugaacucccucggcaagaugguccaccagaucuucgggagcgccuacaccgcccuguucggcggcguguccuggaucaugaagaucgggaucggcgugcugcucaccuggaucgggcugaacagcaagaacacguccaugagcuucuccugcaucgucaucggcaucaucacccuguaccucgggaccguggugcaggccgacaugggcugcgucaucaacuggaagggcaaggagcugaagugcgggagcggcaucuucgugaccaacgaggugcacacguggaccgagcaguacaaguuccaggcggacucccccaagcgccuggccaccgccaucgccggggccugggagaacggcgucugcgggauccgcagcaccacgcggauggagaaccuccuguggaagcagaucgcgaacgagcugaacuacauccucugggagaacaacaucaagcugaccgugguggucggcgacaucaucggcgugcuggagcaggggaagcgcgcccucacgccccagcccauggagcugaaguacuccuggaagaccuggggcaaggccaagaucgugacggccgagauccagaacagcuccuucaucaucgacgggccgaacacccccgagugccccagcgcgucccgggccuggaacgucugggagguggaggacuacggcuucggcguguucaccaccaacaucuggcugaagcuccgcgaggucuacacgcagaccugcgaccaccggcugaugagcgccgccaucaaggacgagcgcgccgugcacgcggacaugggguacuggaucgagagccagaagaacggcuccuggaagcuggagaaggccagcuucaucgaggugaagaccugcaccuggcccaagucccacacccucuggagcaacgggguccuggaguccgacaugaucauccccaagagccuggccggccccaucucccagcacaaccaccggcccggguaccacacgcagaccgccggcccguggcaccucggcaagcuggagcuggacuucaacuacugcgaggggaccaccguggugaucacggagaacugcggcacccgcgggcccagccuccggaccaccacggucuccggcaagcugauccacgaguggugcugccgcagcugcacccugccgccccuccgguacaugggggaggacggcugcugguacggcauggagauccgcccgaucaacgagaaggaggagaacauggugaagucccuggugagcgccggguccggcaaggucgacaacuucaccaugggggugcugugccucgcgauccuguucgaggaggugaugcggggcaaguucgggaagaagcacaugaucgccggcguccuguucaccuucaugcuccugcugagcggccagaucacguggcgcgacauggcccacacccucaucaugaucggguccaacgccagcgaccggaugggcaugggggugaccuaccuggcccugaucgcgaccuucaagauccagcccuuccucgcccugggcuucuuccugcgcaagcucacgucccgggagaaccugcugcucggcguggggcuggccauggccaccacccugcagcuccccgaggacaucgagcagauggcgaacggcaucgcccuggggcugauggcccucaagcugaucacccaguucgagacguaccagcuguggaccgcccucgucagccugaccugcagcaacaccaucuucacgcugaccguggccuggcgcaccgcgacccucauccuggccggcgugucccugcuccccgucugccagagcuccagcaugcggaagacggacuggcugccgguggccgucgccgccaugggggugccgccccucccccucuucaucuucucccugaaggacacccugaagcgccgcagcuggccgcucaacgagggcgugauggcggucggccugguguccauccuggccagcucccuccugcggaacgacgugcccauggccgggccccuggucgccggcgggcuccugaucgccugcuacgugaucaccggcaccagcgcggaccugacgguggagaaggccgccgacgucaccugggaggaggaggccgagcagaccggggugucccacaaccucaugaucaccguggacgacgacggcacgaugcgcaucaaggacgacgagaccgagaacauccugaccguccugcucaagaccgcccugcugaucgugagcggcaucuuccccuacuccaucccggcgacccuccugguguggcacacguggcagaagcagacccagcggagcgggguccugugggacgugcccagcccgcccgagacccagaaggccgagcucgaggagggcguguaccgcaucaagcagcaggggaucuucggcaagacccaggucggggugggcgugcagaaggagggcgucuuccacacgauguggcacgugacccgcggggccgugcugacccacaacggcaagcgccuggagccgaacugggccagcgucaagaaggaccucaucuccuacgggggcggguggcggcugagcgcgcaguggcagaagggcgaggagguccaggugaucgccgucgagcccggccgcaaccccaagaacuuccagaccaugcccgggaucuuccagacgaccaccggcgagaucggggccaucgcccuggacuucaagccgggcaccuccggcagccccaucaucaaccgggaggggaagguggugggccuguacgggaacggcgucgugacgaagaacgggggcuacgugagcggcaucgcccaggcgaacgccgagcccgaggggccgacccccgagcucgaggaggagauguucaagaagcgcaaccugaccaucauggaccugcaccccggcuccgggaagacccggaaguaccuccccgccaucguccgcgaggccaucaagcggcgccugcggacgcugauccucgccccgacccgcgugguggcggccgagauggaggaggcccugaagggccugcccauccgguaccagaccaccgccaccaaguccgagcacaccgggcgcgagaucgucgagugcaugugccacgccaccuucaccaugcggcuccugucccccgugcgcgugcccaacuacaaccugaucaucauggacgaggcgcacuucacggacccggccagcaucgccgcccggggcuacaucuccacccgcgucggcaugggggaggcggccgccaucuucaugaccgccacgccgcccggcacggccgaggcguucccccagagcaacgccccgauccaggacgaggagcgcgacauccccgagcgguccuggaacagcgggaacgaguggaucaccgacuucgugggcaagaccgugugguucguccccuccaucaaggccgggaacgacaucgccaacugccuccgcaagaacggcaagaaggugauccagcugagccggaagaccuucgacacggaguaccagaagaccaagcugaacgacugggacuucguggucaccaccgacaucuccgagaugggcgccaacuucaaggcggaccgcgugaucgacccccggcgcugccucaagccggugauccugacggacgggcccgagcgggucauccuggccggccccaugcccgugaccgccgccagcgccgcgcagcgccgggggcgcgugggccggaacccgcagaaggagaacgaccaguacaucuucaccgggcagccccucaacaacgacgaggaccacgcccacuggaccgaggccaagaugcugcuggacaacaucaacacgcccgagggcaucauccccgcccucuucgagccggagcgcgagaaguccgcggccaucgacggcgaguaccggcugaagggggagagccgcaagaccuucgucgagcugaugcggcgcggcgaccuccccguguggcuggcccacaaggucgccuccgaggggaucaaguacaccgaccggaaguggugcuucgacggcgagcgcaacaaccagauccuggaggagaacauggacguggagaucuggaccaaggagggcgagcggaagaagcuccgcccccgcuggcuggacgcccggaccuacagcgacccccuggcgcucaaggaguucaaggacuucgccgccgggcgcaaguccaucgcccuggaccuggugacggagaucggccgggucccgagccaccucgcccaccgcacccggaacgcgcuggacaaccuggugaugcuccacaccuccgagcacgggggccgcgccuaccggcacgccguggaggagcugcccgagaccauggagacgcugcuccugcuggggcucaugauccugcugaccggcggcgccaugcuguuccugaucagcgggaagggcaucgggaagaccagcaucggccugaucugcgucaucguguccagcgggaugcucuggauggccgacgugccccugcaguggaucgcguccgccaucguccuggaguucuucaugauggugcuccugaucccggagcccgagaagcagcgcacgccccaggacaaccagcuggccuacguggucaucggcauccucacgcuggccgccaucguggcggccaacgagaugggccugcucgagaccaccaagcgggaccuggggaugagcaaggagcccggcguggucuccccgaccagcuaccuggacguggaccuccaccccgccuccgccuggacgcuguacgcgguggccaccaccgucaucacccccaugcugcgccacacgaucgagaacagcaccgccaacgugucccucgccgccaucgcgaaccaggccgugguccugauggggcuggacaagggcuggcccaucagcaagauggaccucggggugccgcugcuggcccucggcugcuacucccaggugaacccccugacccugaccgccgccguccuccugcuggugacgcacuacgcgaucaucggccccgggcuccaggccaaggccacccgggaggcccagaagcgcaccgccgcgggcaucaugaagaaccccaccguggacgggaucaugacgaucgaccuggacccggucaucuacgacagcaaguucgagaagcagcugggccaggugaugcuccuggugcugugcgccguccagcuccugcugaugcggaccuccugggcccucugcgaggcccugacccuggcgaccggccccaucacgacccucugggaggggagccccggcaaguucuggaacaccaccaucgccguguccauggccaacaucuuccgcgggagcuaccuggccggcgccgggcuggcguucuccaucaugaaguccgugggcacgggcaagcgggggaccggcucccagggggagacccucggcgagaaguggaagaagaagcugaaccagcugagccgccgggaguucgagcucuacaagaaguccgggaucaccgaggucgaccgcacggaggccaaggagggccugaagcggggcgagaccacccaccacgccgugucccgcgggagcgccaagcugcagugguucguggagcggaacauggucauccccgagggccgcgugaucgaccucgggugcggccgcgggggcugguccuacuacugcgccggccugaagaaggugaccgagguccggggguacaccaagggcgggccgggccacgaggagcccgugcccaugagcacguacggguggaacaccgugaagcugauguccggcaaggacgucuucuaccucccgcccgagaagugcgacacccugcugugcgacaucggcgagagcucccccagccccaccguggaggagucccgcacgauccgggugcugaagauggucgagcccuggcucaagaacaaccaguucugcaucaaggugcugaaccccuacaugcccaccgugaucgagcaccuggagcgccuccagcggaagcacgggggcaugcugguccgcaacccccugagccggaacuccacccacgagauguacuggaucagcaacgggaccggcaacaucguguccagcgugaacauggucucccgccuccugcugaaccgguucacgaugacccaccgccggcccaccaucgagaaggacguggaccucggcgcggggacccgccacgucaacgccgagccggagacgcccaacauggacgugaucggcgagcggaucaagcgcaucaaggaggagcacagcuccaccuggcacuacgacgacgagaaccccuacaagaccugggccuaccacgggagcuacgaggugaaggccaccggcuccgccagcagcaugaucaacggggucgugaagcugcugacgaagccgugggacgugguccccauggugacccagauggcgaugaccgacaccacgcccuucggccagcagcggguguucaaggagaaggucgacacccgcacgccccggccgaugcccggcacccgcaaggugauggagaucaccgccgaguggcucuggcggacccuggggcgcaacaagcgcccccggcugugcacccgcgaggaguucaccaagaaggugcggacgaacgccgccaugggcgcggucuucaccgaggagaaccagugggaguccgcccgcgccgccguggaggacgaggaguucuggaagcucguggggcgggagcgcgagcugcacaagcugggcaagugcgggagcugcgucuacaacaugaugggcaagcgggagaagaagcucggcgaguucgggaaggccaagggcucccgcgcgaucugguacauguggcugggggcccgguaccuggaguucgaggcccucggcuuccugaacgaggaccacugguucagccgcgagaacuccuacagcgggguggagggcgagggccugcacaagcucggguacauccugcgggacaucuccaagauccccggcggggccauguacgccgacgacaccgcgggcugggacacccgcaucacggaggacgaccugcacaacgaggagaagaucacccagcagauggacccggagcaccggcagcucgccaacgccaucuucaagcugaccuaccagaacaagguggucaaggugcagcgccccacccccaagggcacggugauggacaucaucagccggaaggaccagcgcggguccggccaggucgggaccuacggccugaacaccuucaccaacauggaggcccagcucauccggcagauggagggggagggcgugcugagcaaggccgaccuggagaacccccaccuccuggagaagaagaucacccaguggcuggagacgaagggcguggagcgccucaagcggauggcgaucuccggggacgacugcgucgugaagccgaucgacgaccgcuucgccaacgcccugcuggcccucaacgacaugggcaaggugcggaaggacaucccccaguggcagcccagcaagggguggcacgacuggcagcagguccccuucugcucccaccacuuccacgagcugaucaugaaggacggccgcaagcugguggugccgugccgcccccaggacgagcucaucgggcgggcccgcaucagccagggcgcgggcuggucccugaaggagaccgccugccuggggaaggccuacgcccagauguggagccucauguacuuccaccggcgcgaccugcggcuggcguccaacgccaucugcagcgccguccccgugcacugggugcccaccucccgcaccacguggagcauccacgcccaccaccaguggaugaccaccgaggacaugcucaccgucuggaaccggguguggaucgaggacaacccguggauggaggacaagacgcccgugaccaccugggaggacguccccuaccugggcaagcgcgaggaccaguggugcgggagccugaucggccucaccucccgggccacgugggcgcagaacauccugaccgccauccagcagguccgcagccugaucggggacgaggaguuccucgacuacaugcccuccaugaagcgguuccgcaaggaggaggagagcgagggcgccaucugguga

SEQ ID NO: 10379 - RNA, 9873 nt, Artificial Sequence
  derived and/or modified CDS sequence (opt1) from DENV-3__JF504679__SS-prME
accagccugugccucaugaugauccugcccgccgcccuggcguuccaccucaccagccgggacggggagccgcggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccggauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggcggacauggggugcgucaucaacuggaagggcaaggagcugaagugcggcagcgggaucuucgugacgaacgaggugcacaccuggaccgagcaguacaaguuccaggccgacucccccaagcgccucgccaccgucaucgccggcgccugggagaacggggugugcggcauccgcagcacgacccggauggagaaccugcuguggaagcagaucgcgaacgagcucaacuacauccugugggagaacaacaucaagcugaccguggucgugggggacaccaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgccucccgggcguggaacgugugggagguggaggacuacggguucggcgucuucaccaccaacaucuggcucaagcugcgcgagguguacacccagaugugcgaccaccggcugaugagcgccgccgugaaggacgagcgcgccguccacgccgacaugggcuacuggaucgagagccagaagaacggguccuggaagcucgagaaggcgagccugaucgaggugaagacgugcaccuggccgaagucccacacccuguggagcaacggcgugcucgaguccgacaugaucauccccaagagccuggccgggcccgucucccagcacaacuaccggccgggcuaccacacccagacggccgggcccuggcaccugggcaagcucgagcuggacuucaacuacugcgagggcaccaccguggugaucaccgagaacugcgggacgcgcggccccagccugcggaccaccaccgucuccgggaagcucauccacgaguggugcugccgcagcugcacgcugcccccgcugcgguacaugggcgaggacgggugcugguacggcauggagauccgccccaucuccgagcgggaggagaacauggucaagagccucguguccgccggcagcgggaaggucgacaacuucaccaugggcgugcugugccuggccauccucuucgaggaggugaugcgcgggaaguucggcaagaagcacaugaucgcgggggucuucuucaccuucaugcugcugcucuccggccagaucaccuggcgggacauggcccacacgcugaucaugaucggcagcaacgccuccgaccgcauggggaugggcgugaccuaccuggcccucaucgccaccuucaagauccagcccuuccuggcgcugggguucuuccuccggaagcugaccagccgcgagaaccugcuccugggcgugggccuggccauggccacgaccauccagcuccccgaggacaucgagcagauggccaacgggaucgcgcugggccugauggcccucaagcugaucacccaguucgagaccuaccagcuguggacggcccucaucagccugaccugcuccaacaccaucuucacccugacggucgccuggcggaccgccacccucauccuggcgggggugagccugcucccggucugccaguccagcuccaugcgcaagaccgacuggcugcccaugacgguggccgccaugggcgugccgccccugccccucuucaucuucagccugaaggacacccugaagcgccgguccuggccccucaacgagggggucauggccgugggccuggugagcauccuggccuccagccuccugcgcaacgacguccccauggcgggcccccugguggccgggggccuccugaucgccugcuacgugaucaccgggaccuccgccgaccugacggucgagaaggccgcggacgugaccugggaggaggaggccgagcagaccggcgugagccacaaccucaugaucaccgucgacgacgacgggaccaugcggaucaaggacgacgagacggagaacauccugaccgugcugcucaagaccgcccugcugaucguguccggcaucuucccguacagcauccccgccacccuccuggucuggcacacguggcagaagcagacccagcgcuccggcgugcugugggacgugcccagcccgcccgagacccagaaggccgagcucgaggagggggucuaccggaucaagcagcagggcauccuggggaagacccaggugggcguggggguccagaaggagggcguguuccacacgauguggcacgugacccgcggcgcgguccugacccacaacgggaagcggcucgagcccaacugggccuccgugaagaaggaccugaucagcuacggcgggggcuggcgccuguccgcccaguggcagaagggggaggaggugcaggucaucgccguggagcccggcaagaaccccaagaacuuccagaccaugcccggcacguuccagaccaccaccggggagaucggcgcgaucgcccucgacuucaagcccgggacgagcggcagccccaucaucaaccgggagggcaagguggucgggcuguacggcaacgggguggugaccaagaacggcggguacgucuccggcaucgcccagaccaacgccgagccggacggccccacccccgagcuggaggaggagauguucaagaagcgcaaccugacgaucauggaccuccaccccgggagcggcaagacccggaaguaccugccggccaucgugcgcgaggcgaucaagcggcgccugcggacccucauccuggcccccacccgcguggucgccgccgagauggaggaggcccugaaggggcuccccauccgguaccagacgaccgcgaccaaguccgagcacaccggccgcgagaucguggaccugaugugccacgccacguucaccaugcggcugcucagccccgugcgcgucccgaacuacaaccugaucaucauggacgaggcccacuucaccgaccccgccuccaucgccgcgcggggguacaucagcacccgcgugggcaugggcgaggccgccgccaucuucaugacggcgacgccgcccgggaccgccgacgccuucccgcaguccaacgcccccauccaggacgaggagcgcgacauccccgagcggagcuggaacuccggcaacgaguggaucaccgacuucgccgggaagacggugugguucguccccagcaucaaggcgggcaacgacaucgccaacugccugcgcaagaacgggaagaaggugauccagcucucccggaagaccuucgacaccgaguaccagaagaccaagcugaacgacugggacuucguggucacgaccgacaucagcgagaugggcgccaacuucaaggccgaccgcgugaucgacccgcggcgcugccugaagcccgugauccucaccgacggccccgagcgggucauccuggccgggcccaugccggugaccguggcguccgccgcccagcgccggggccgcgucgggcggaacccccagaaggagaacgaccaguacaucuucaccggccagccccugaacaacgacgaggaccacgcccacuggacggaggccaagaugcuccuggacaacaucaacacccccgaggggaucaucccggcgcuguucgagcccgagcgcgagaaguccgccgccaucgacggcgaguaccggcucaagggcgagucccgcaagaccuucguggagcugaugcggcgcggggaccugcccgucuggcucgcccacaagguggcgagcgagggcaucaaguacaccgaccggaaguggugcuucgacgggcagcgcaacaaccagauccuggaggagaacauggacguggagaucuggacgaaggagggcgagaagaagaagcugcggccccgcuggcucgacgcccgcaccuacuccgacccgcuggcccugaaggaguucaaggacuucgccgccggccgcaagagcaucgcgcucgaccuggucaccgagaucgggcgcgugcccucccaccuggcccaccggacccgcaacgcccucgacaaccuggugaugcugcacacgagcgagcacggcgggcgggccuaccgccacgccgucgaggagcuccccgagaccauggagacccugcugcuccugggccugaugauccuccugaccgggggcgcgaugcuguuccucaucagcggcaaggggaucggcaagacguccaucgggcugaucugcgugaucgccagcuccggcaugcuguggauggccgagaucccgcuccaguggaucgccagcgccaucgugcuggaguucuucaugaugguccugcucauccccgagcccgagaagcagcggacgccccaggacaaccagcuggcguacguggugaucgggauccugacccucgccgccaucaucgccgccaacgagaugggccugcuggagaccacgaagcgcgaccucggcauguccaaggagccgggggucgugagccccaccuccuaccuggacguggaccugcaccccgcgagcgccuggacccucuacgccgucgccaccacggugaucacccccaugcugcggcacaccaucgagaacuccaccgcgaacgugagccuggccgccaucgccaaccaggccgucgugcucaugggccuggacaagggguggccgaucuccaagauggaccugggcgugccccuccuggcgcuggggugcuacagccaggucaacccccucacgcugaccgccgccgugcugcuccuggugacccacuacgccaucaucggccccggccugcaggccaaggcgacccgcgaggcccagaagcggacggccgccgggaucaugaagaacccgaccgucgacggcaucaucaccaucgaccucgaccccgugaucuacgacuccaaguucgagaagcagcugggccaggugaugcugcucguccugugcgccgugcagcugcuccugaugcgcaccagcugggcgcugugcgaggcccucacgcuggccaccggccccaucaccacccugugggagggcucccccgggaaguucuggaacacgaccaucgccgugagcauggcgaacaucuuccggggcuccuaccucgccggggccggccuggccuucagcaucaugaaguccgucgggaccggcaagcgcggcaccgggagccagggcgagacccugggggagaaguggaagaagaagcucaaccagcugagccggaaggaguucgaccuguacaagaaguccggcaucacggagguggaccgcaccgaggccaaggaggggcucaagcggggcgagaccacccaccacgcggugagccgcggcuccgccaagcugcagugguucgucgagcggaacauggugaucccggaggggcgcgugaucgaccugggcugcgggcggggcggguggagcuacuacugcgccggccucaagaaggucacggaggugcgcggcuacaccaagggcgggcccgggcacgaggagcccgugcccauguccaccuacggcuggaacaucgucaagcugaugagcgggaaggacguguucuaccugccgcccgagaagugcgacacccuccugugcgacaucggcgaguccagccccucccccacgguggaggagagccgcaccauccggguccugaagaugguggagccguggcugaagaacaaccaguucugcaucaaggugcucaaccccuacaugcccgccgucaucgagcaccuggagcgccugcagcggaagcacggcgggaugcucgugcgcaacccccugucccggaacagcacccacgagauguacuggaucuccaacggcaccgggaacaucgugagcuccgucaacauggugagccgccugcuccugaaccgguucacgaugacccaccgccggccgaccaucgagaaggacguggaccugggcgccggcacccgccacgucaacgcggagcccgagacgcccaacauggacgugaucggggagcggauccgccggaucaaggaggagcacaacuccaccuggcacuacgacgacgagaacccguacaagaccugggccuaccacggcagcuacgaggucaaggccaccggguccgccagcagcaugaucaacggcguggugaagcuccugacgaagcccugggacgucgugcccauggugacccagauggccaugaccgacaccacgcccuucgggcagcagcgcgucuucaaggagaagguggacacccggaccccgcgccccaugcccggcacccggaaggugauggagaucacggcggaguggcuguggcgcacccucggccggaacaagcgcccccgccugugcacccgggaggaguucaccaagaagguccgcacgaacgccgccaugggggccguguucaccgaggagaaccagugggacuccgcgaaggccgccguggaggacgaggaguucuggaagcuggucgaccgggagcgcgagcuccacaagcugggcaagugcgggagcugcguguacaacaugaugggcaagcgggagaagaagcugggggaguucggcaaggccaagggcucccgcgccaucugguacauguggcucggggcgcgguaccuggaguucgaggcccugggcuuccucaacgaggaccacugguucagccgcgagaacuccuacagcgggguggagggcgaggggcugcacaagcugggcuacauccuccgggacaucuccaagaucccgggcggggccauguacgccgacgacaccgccggcugggacacccgcaucacggaggacgaccugcacaacgaggagaagaucacccagcagaugaaccccgagcaccggcugcucgcgaacgccaucuucaagcugaccuaccagaacaaggucgugaaggugcagcgccccacccccaccgggacggucauggacaucaucagccggaaggaccagcgcggcuccggccagguggggaccuacggccugaacaccuucaccaacauggaggcccagcucgugcggcagauggagggggagggcguccugagcaaggccgaccuggagaacccgcaccuccccgagaagaagaucacgcaguggcuggagaccaaggggguggagcgccugaagcggauggccaucuccggcgacgacugcguggucaagcccaucgacgaccgcuucgcgaacgcccuccuggcccugaacgacaugggcaaggugcggaaggacaucccccaguggcagccgagcaagggguggcacgacuggcagcagguccccuucugcucccaccacuuccacgagcucaucaugaaggacggccgcaagcuggucgugcccugccggccccaggacgagcugaucgggcgcgcccgcaucagccagggcgccggguggucccuccgggagaccgcgugccugggcaaggccuacgcccagauguggagccugauguacuuccaccgccgggaccuccgccuggccuccaacgcgaucugcagcgccgugccgguccacugggugcccaccucccggacgaccuggagcauccacgcccaccaccaguggaugaccaccgaggacaugcugacgguguggaaccgcgucuggaucgaggacaaccccuggauggaggacaagacccccgugaccaccugggagaacgugccguaccucggcaagcgggaggaccaguggugcgggagccugaucggccugacgucccgcgccaccugggcccagaacauccccaccgcgauccagcagguccggagccucaucgggaacgaggaguuccuggacuacaugcccuccaugaagcgcuuccggaaggaggaggagagcgagggcgccaucugguga

SEQ ID NO: 10380 - RNA, 9873 nt, Artificial Sequence
  derived and/or modified CDS sequence (opt1) from DENV-3__KC425219__SS-prME
accagccucugccucaugaugauccuccccgccgcccuggcguuccaccucaccagccgggacggggagccgcggaugaucguggggaagaacgagcgcggcaagagccugcuguucaagaccgccagcgggaucaacaugugcacccucaucgccauggaccugggcgagaugugcgacgacaccgugaccuacaagugcccccacaucacggagguggagcccgaggacaucgacugcuggugcaaccugaccagcaccugggugaccuacgggacgugcaaccaggccggcgagcggcgccgggacaagcgcuccguggcccucgcgccccacgugggcauggggcuggacacccggacccagaccuggaugagcgccgagggcgccuggcgccagguggagaagguggagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccgugcugccggaggagcaggaccagaacuacgucugcaagcacaccuacguggaccgcggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcggaccggccuggacuucaacgagaugauccugcucacgaugaagaacaaggccuggauggugcaccgccagugguucuucgaccugccccugcccuggaccagcggcgccaccaccgagacgcccaccuggaaccggaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccgccugaagauggacaagcucgagcugaagggcaugagcuacgccaugugcaccaacacguucguccugaagaaggagguguccgagacccagcacgggaccauccucaucaagguggaguaccggggcgaggacgcgccgugcaagauccccuucagcaccgaggacgggcagggcaaggcccacaacggccgccugaucacggccaaccccgucgugaccaagaaggaggagcccgugaacaucgaggccgagccgcccuucggggagagcaacaucgucaucggcaucggggacaacgcgcugaagaucaacugguacaagaagggcuccagcaucgggaagauguucgaggccaccgcccggggcgcccgccgcauggccauccugggcgacaccgcgugggacuucggguccgugggcggggugcucaacagccugggcaagaugguccaccagaucuucggguccgccuacacggcccuguucagcggcguguccugggugaugaagaucggcaucgggguccuccugaccuggaucggccugaaccccaagaacaccagcauguccuucagcugcaucgccaucgggaucaucacccucuaccugggcgccguggugcaggcggacauggggugcgucaucaacuggaagggcaaggagcugaagugcggcuccgggaucuucgugacgaacgaggugcacaccuggaccgagcaguacaaguuccaggccgacagccccaagcggcucgccaccgccaucgccggcgcgugggagaacggggucugcggcauccgcuccacgacccggauggagaaccugcuguggaagcagaucgccaacgagcucaacuacauccugugggagaacaacaucaagcugaccgugguggucggggacaucaucggcgugcucgagcagggcaagcgcacccugacgccgcagcccauggagcugaaguacagcuggaagaccugggggaaggccaagaucgugaccgccgagacccagaacuccagcuucaucaucgacggccccaacacgcccgagugcccguccgcgagccgggccuggaacgucugggagguggaggacuacggguucggcguguucaccaccaacaucuggcucaagcugcgcgaggucuacacccagcugugcgaccaccggcucauguccgccgccgugaaggacgagcgcgccgugcacgcggacaugggcuacuggaucgagagccagaagaacgggagcuggaagcuggagaaggccucccugaucgaggucaagaccugcacguggcccaagagccacacccucugguccaacggcgugcuggagagcgacaugaucauccccaagucccuggccgggccgaucagccagcacaaccaccggcccggcuaccacacccagaccgccgggcccuggcaccucggcaagcuggagcuggacuucaacuacugcgagggcacgaccguggucaucaccgagaacugcgggacccgcggccccucccuccggacgaccaccgugagcgggaagcugauccacgaguggugcugccgcuccugcacccugccgccccuccgguacaugggcgaggacgggugcugguacggcauggagauccgccccaucagcgagaaggaggagaacauggugaagucccuggucagcgccggcuccgggaagguggacaacuucacgaugggcgugcugugccucgcgauccuguucgaggaggucaugcgggggaaguucggcaagaagcacaugaucgccgggguguucuucaccuucgugcugcuccugagcggccagaucaccuggcgcgacauggcccacacccugaucaugaucggcuccaacgccagcgaccggauggggaugggcgucacguaccucgcccugaucgcgaccuucaagauccagcccuuccuggcccucggguucuuccugcgcaagcugaccucccgggagaaccuccugcugggcgugggccucgccauggccaccacgcugcagcugccggaggacaucgagcagauggcgaacgggaucgcccucggccugauggcccugaagcucaucacccaguucgagaccuaccagcuguggaccgcccugaucagccucacgugcagcaacaccauguucacccugaccguggccuggcgcacggcgacccugauccucgccggggucucccugcugcccgugugccagagcuccagcaugcgcaagaccgacuggcuccccauggccgucgccgccaugggcgugcccccgcugccccuguucaucuucucccucaaggacacccugaagcggcgcagcuggccccugaacgagggggugauggcggucggccucguguccauccuggccagcucccugcuccggaacgacgugcccauggccggcccgcuggucgccgggggccugcucaucgccugcuacgugaucacggggaccagcgcggaccugaccguggagaaggccgccgacaucaccugggaggaggaggccgagcagacgggcgucucccacaaccugaugaucaccguggacgacgacgggaccaugcgcaucaaggacgacgagaccgagaacauccucaccgugcugcugaagacggcccuccugaucgucagcggcguguuccccuacuccauccccgcgacccugcucguguggcacaccuggcagaagcagacccagcggagcggcguccugugggacgugcccuccccgcccgagacgcagaaggccgagcuggaggaggggguguaccgcaucaagcagcagggcaucuucgggaagacccaggucggcgugggggugcagaaggagggcgucuuccacaccauguggcacgugacccggggcgccgugcucacguacaacgggaagcgccuggagcccaacugggccagcgucaagaaggaccugaucuccuacggcgggggcuggcggcucagcgcgcaguggcagaagggggaggagguccaggugaucgccgucgagcccggcaagaacccgaagaacuuccagaccaugcccggcaccuuccagaccacgaccggggagaucggcgccaucgcccuggacuucaagcccgggaccuccggcagcccgaucaucaaccgcgagggcaaggugguggggcuguacggcaacggggucgugaccaagaacggcggguacgugagcggcaucgcccagacgaacgcggagcccgacggccccacccccgagcuggaggaggagauguucaagaagcggaaccucaccaucauggaccugcacccgggguccggcaagacccgcaaguaccugcccgccaucguccgggaggccaucaagcgccggcuccgcacgcugauccuggcccccacccgggugguggccgcggagauggaggaggcccucaaggggcugcccauccgcuaccagaccaccgccaccaagagcgagcacacgggccgggagaucgucgaccugaugugccacgccaccuucaccaugcgccuccuguccccggugcgggugcccaacuacaaccugaucaucauggacgaggcccacuucacggaccccgcgagcaucgccgcccgcggguacaucuccacccgcgucggcaugggcgaggccgcggccaucuucaugaccgccacgccgcccgggacggccgacgccuucccccagagcaacgcgcccauccaggacgaggagcgggacauccccgagcgcuccuggaacagcggcaacgaguggaucaccgacuucgccgggaagaccgugugguucgugccguccaucaaggccggcaacgacaucgccaacugccuccggaagaacgggaagaaggucauccagcugagccgcaagaccuucgacacggaguaccagaagaccaagcugaacgacugggacuucguggugaccaccgacaucuccgagaugggcgccaacuucaaggcggaccgggucaucgacccccgccggugccucaagcccgugauccugacggacggccccgagcgcgugauccuggccgggccgaugcccgucaccgccgccagcgccgcgcagcggcgcggccggguggggcgcaacccccagaaggagaacgaccaguacaucuucaccggccagccccucaacaacgacgaggaccacgcccacuggaccgaggccaagaugcugcuggacaacaucaacaccccggaggggaucauccccgcccucuucgagcccgagcgggagaaguccgcggccaucgacggcgaguaccgccugaagggcgagagccggaagacguucguggagcugaugcgccgcggggaccuccccgucuggcuggcccacaagguggccuccgagggcaucaaguacaccgaccgcaaguggugcuucgacgggcagcggaacaaccagauccuggaggagaacauggacgucgagaucuggaccaaggagggcgagaagaagaagcuccgcccgcgcuggcuggacgcccggaccuacagcgacccccuggcgcucaaggaguucaaggacuucgccgccggccgcaaguccaucgcccuggaccuggugacggagaucgggcgggugcccagccaccucgcccaccgcacccggaacgcgcuggacaaccuggucaugcuccacaccuccgagcacggcgggcgcgccuaccggcacgccguggaggagcugccggagaccauggagacgcugcuccugcugggccucaugauccugcugaccgggggcgccaugcuguuccugaucagcggcaaggggaucggcaagaccagcaucgggcugaucugcgugaucgccuccagcggcaugcucuggauggcggagaucccccugcaguggaucgccuccgccaucguccuggaguucuucaugauggugcuccugauccccgagcccgagaagcagcgcaccccgcaggacaaccagcuggccuacguggucaucgggauccucacgcuggccgcgaucaucgccgccaacgagaugggccugcucgagaccaccaagcgggaccugggcaugagcaaggagcccgggguggugucccccaccagcuaccuggacgucgaccuccaccccgccuccgcguggacgcuguacgccguggccaccaccgugaucaccccgaugcugcgccacacgaucgagaacagcaccgccaacgucucccucgccgcgaucgccaaccaggccguggugcugaugggccuggacaagggguggcccaucagcaagauggaccucggcgucccccugcuggcccucgggugcuacucccaggugaacccccugacccugaccgccgcggugcuccugcugaucacgcacuacgccaucaucggcccgggccuccaggccaaggccacccgggaggcccagaagcgcaccgcggccgggaucaugaagaaccccaccgucgacggcaucaugacgaucgaccuggaccccgugaucuacgacagcaaguucgagaagcagcugggccaggugaugcuccugguccugugcgccgugcagcuccugcugaugcggaccuccugggcccucugcgaggcgcugacccuggccaccggccccaucacgacccucugggagggcagcccggggaaguucuggaacaccaccaucgccguguccauggccaacaucuuccgcggcagcuaccuggccggggcgggccuggccuucuccaucaugaaguccgucgggacgggcaagcggggcaccgggucccagggcgagacccucggggagaaguggaagaagaagcugaaccagcugagccgcaaggaguucgaccucuacaagaaguccggcaucaccgagguggaccggaccgaggccaaggaggggcugaagcgcggcgagaucacgcaccacgccgugucccggggcagcgccaagcugcagugguucgucgagcgcaacauggugauccccgaggggcgggugaucgaccucggcugcgggcgcggcgggugguccuacuacugcgcgggccugaagaaggucaccgaggugcgcggcuacaccaagggcgggcccgggcacgaggagcccgugccgaugagcaccuacggcuggaacaucgucaagcugauguccgggaaggacguguucuaccugccgcccgagaagugcgacacgcugcugugcgacaucggcgagagcucccccagcccgaccguggaggagucccggaccauccgcguccugaagaugguggagcccuggcucaagaacaaccaguucugcaucaaggugcugaaccccuacaugcccaccgucaucgagcaccuggagcggcuccagcgcaagcacggcgggaugcuggugcggaacccgcugagccgcaacuccacgcacgagauguacuggaucagcaacggcaccgggaacaucguggccuccgucaacauggugagccggcuccugcugaaccgcuucaccaugacccaccggcgccccacgaucgagaaggacguggaccucggcgccggcacccggcacgucaacgccgagcccgagaccccgaacauggacgugaucggggagcgcaucaagcggaucaaggaggagcacaacuccaccuggcacuacgacgacgagaaccccuacaagacgugggccuaccacggcagcuacgaggugaaggcgaccggguccgccagcuccaugaucaacggcgucgugaagcugcugaccaagcccugggacgucgugcccauggugacccagauggccaugacggacaccaccccguucgggcagcagcgcgucuucaaggagaagguggacacccggacgccccgcagcaugcccggcacccggcgcgugaugggcaucaccgccgaguggcucuggcggacccuggggcgcaacaagaagccccgccugugcacgcgggaggaguucaccaagaagguccgcaccaacgcggccaugggcgccguguucaccgaggagaaccagugggacagcgccaaggccgcgguggaggacgaggacuucuggaagcucgucgaccgggagcgcgagcugcacaagcuggggaagugcggcuccugcguguacaacaugauggggaagcgggagaagaagcucggcgaguucggcaaggccaaggggagccgcgccaucugguacauguggcugggcgcccgguaccuggaguucgaggcccucggguuccugaacgaggaccacugguucucccgcgagaacagcuacuccggcguggagggggagggccugcacaagcucggcuacauccugcgggacaucagcaagauccccggcggggcgauguacgccgacgacacggccgggugggacacccgcaucaccgaggacgaccugcacaacgaggagaagaucacccagcagauggaccccgagcaccggcagcucgccaacgccaucuucaagcugacguaccagaacaaggucgugaaggugcagcgccccacccccaccgggaccgucauggacaucaucucccggaaggaccagcgcggcagcggccaggugggcaccuacgggcugaacacguucaccaacauggaggcgcagcucauccggcagauggagggcgagggggugcuguccaaggccgaccuggagaacccgcaccuccccgagaagaagaucacccaguggcuggagaccaagggcgucgagcgccugaagcggauggccaucagcggcgacgacugcguggugaagcccaucgacgaccgcuucgccaacgcccuccuggcgcugaacgacauggggaagguccggaaggacaucccccaguggcagccguccaagggcuggcacgacuggcagcagguccccuucugcagccaccacuuccacgagcucaucaugaaggacgggcgcaagcuggugguccccugccggccccaggacgagcugaucggccgcgcccgcaucucccagggggccggcuggagccuccgggagacggccugccugggcaaggcguacgcccagauguggucccugauguacuuccaccgccgggaccuccgccuggccagcaacgccaucugcuccgccgugccggugcacuggguccccaccagccggaccaccugguccauccacgcgcaccaccaguggaugacgaccgaggacaugcugaccguguggaaccgcguguggaucgaggacaaccccuggauggaggacaagacccccgucacgaccugggagaacgugccguaccucgggaagcgggaggaccaguggugcggcagccugaucgggcugaccagccgcgccaccugggcccagaacauccccacggccauccagcagguccggucccucaucggcaacgaggaguuccuggacuacaugcccagcaugaagcgcuuccggaaggaggaggaguccgagggggccaucugguga

SEQ ID NO: 10381 - RNA, 9873 nt, Artificial Sequence
  derived and/or modified CDS sequence (opt1) from DENV-3__AY858037__SS-prME
accagccugugccucaugaugaugcugcccgugacccuggccuuccaccucacgucccgcgacggcgagccgcggaugaucgucgggaagaacgagcgcggcaagagccugcuguucaagaccgccuccgggaucaacaugugcacccucaucgcgauggaccugggcgagaugugcgacgacaccgugacguacaagugcccccugaucaccgagguggagcccgaggacaucgacugcuggugcaaccucaccagcaccugggucacguacgggaccugcaaccaggccggcgagcaccggcgcgacaagcgguccguggcccuggccccccacgugggcauggggcuggacacccgcgcccagaccuggaugagcgcggagggcgccuggcggcaggucgagaagguggagacgugggccuuccgccacccgggguucaccauccucgcccuguuccuggcgcacuacaucggcaccucccucacccagaagguggucaucuucauccugcugaugcucgugacgcccagcaugaccaugcggugcgugggggucggcaaccgcgacuucguggagggccuguccggggccaccuggguggacgucgugcuggagcacggcgggugcgugaccacgauggccaagaacaagcccacccucgacaucgagcugcagaagaccgaggccacccagcuggccacgcuccggaagcugugcaucgagggcaagaucaccaacgucaccaccgacagccgcugccccacgcagggcgaggcgauccugccggaggagcaggaccagaacuacgugugcaagcacaccuacguggaccggggguggggcaacgggugcggccucuucgggaagggcucccuggucaccugcgccaaguuccagugccuggagagcaucgagggcaagguggugcagcacgagaaccucaaguacaccgucaucaucacggugcacaccggggaccagcaccaggucggcaacgagacccagggggugaccgccgagaucacgccccaggccuccaccguggaggccauccugcccgaguacggcacccuggggcucgagugcagcccccgcaccggccuggacuucaacgagaugauccugcucaccaugaagaacaaggcguggaugguccaccggcagugguucuucgaccugccgcugcccuggacguccggcgccaccaccgagacccccacguggaacaagaaggagcuccuggugaccuucaagaacgcccacgccaagaagcaggagguggucgugcuggggagccaggagggcgccaugcacaccgcgcucaccggggccacggagauccagaccuccggcgggaccagcaucuucgccggccaccugaagugccgccugaagauggacaagcucgagcugaagggcauguccuacgccaugugcagcaacgccuucgugcugaagaaggaggucagcgagacccagcacgggacgauccucaucaagguggaguacaagggcgaggacgcgcccugcaagaucccguucuccaccgaggacgggcagggcaaggcccacaacggccggcugaucaccgccaaccccguggucaccaagaaggaggagcccgugaacaucgaggccgagcccccguucggggagagcaacaucaucaucggcaucggggaccgcgcgcugaagaucaacugguacaagaagggcuccagcaucgggaagauguucgaggccacggcccggggcgcccgccggauggccauccugggcgacaccgcgugggacuucggguccgugggcgggguccucaacagccugggcaagauggugcaccagaucuucggguccgccuacaccgcccuguucagcggcguguccuggaucaugaagaucggcaucgggguccuccugaccuggaucggccugaacagcaagaacacguccaugagcuucuccugcaucgugaucgggaucaucacccucuaccugggcgccgugguccaggccgacauggggugcgugaucaacuggaagggcaaggagcugaagugcggcagcgggaucuucgugaccaacgagguccacaccuggacggagcaguacaaguuccaggcggacucccccaagcgccucgccaccgccaucgccggcgccugggagaacggggugugcggcauccgcagcaccacccggauggagaaccugcuguggaagcagaucgcgaacgagcucaacuacauccugugggagaacaacaucaagcugacgguggucgugggggacaucaucggcgugcucgagcagggcaagcgcacccugaccccccagcccauggagcugaaguacuccuggaagaccugggggaaggccaagaucgucacggccgagacccagaacagcuccuucaucaucgacggcccgaacacccccgagugccccaacgccagccgggcguggaacgugugggagguggaggacuacggguucggcgucuucaccacgaacaucuggcucaagcugcgcgagauguacacccagcugugcgaccaccggcucaugagcgccgccgugaaggacgagcgcgccgugcacgccgacaugggcuacuggaucgagucccagaagaacgggagcuggaagcuggagaaggcgucccugaucgaggucaagaccugcaccuggcccaagagccacacccucugguccaacggcgugcuggagagcgacaugaucaucccgaagucccuggccgggcccaucagccagcacaacuaccggcccggcuaccacacgcagaccgccgggccguggcaccucggcaagcuggagcuggacuucaacuacugcgagggcaccaccguggucaucacggagaacugcgggacccgcggccccucccuccggaccaccacggugagcgggaagcugauccacgaguggugcugccgcuccugcacccugcccccccuccgguacaugggcgaggacgggugcugguacggcauggagauccgcccgaucaacgagaaggaggagaacauggugaagagccuggucuccgccggcagcgggaagguggacaacuucaccaugggcgugcugugccucgccauccuguucgaggaggucaugcgggggaaguucggcaagaagcacaugaucgcgggggugcuguucaccuucgugcuccugcuguccggccagaucacguggcgcgacauggcccggacccucaucaugaucggcagcaacgccuccgaccgcauggggaugggcgucaccuaccuggcccugaucgccaccuucaagauccagcccuuccucgcgcugggguucuuccugcggaagcucacgagccgcgagaaccugcugcucggcgugggccuggccauggccaccacccugcagcuccccgaggacaucgagcagauggccaacgggaucgcgcugggccugauggcccucaagcugaucacccaguucgagacguaccagcuguggaccgcccucgugagccugaugugcuccaacaccaucuucacccugacggucgccuggcggaccgccacccucauccuggcggggaucagccuguuccccgugugccaguccagcuccaugcgcaagaccgacuggcucccgaugacggucgccgccaugggcgugcccccccugccccuguucaucuucagccucaaggacacccugaagcgccgguccuggccgcugaacgagggggugauggccgucggccucgugagcauccuggccuccagccugcuccgcaacgacgugcccauggcgggcccccuggucgccgggggccugcucaucgccugcuacgugaucaccgggaccuccgccgaccugacgguggagaaggccgcggacgucaccugggaggaggaggccgagcagaccggcgugagccacaaccugaugaucaccguggacgacgacgggacgaugcggaucaaggacgacgagaccgagaacauccucaccguccugcugaagaccgcccuccugaucguguccggcaucuuccccuacagcaucccggccacccugcucguguggcacacguggcagaagcagacccagcgcuccggcguccugugggacgugcccagcccccccgagacccagaaggccgagcuggaggaggggguguaccggaucaagcagcagggcaucuucgggaagacccaggucggcgugggggugcagaaggagggcgucuuccacacgauguggcacgugacccgcggcgcggugcucaccuacaacgggaagcggcuggagccgaacugggccuccgucaagaaggaccugaucagcuacggcgggggcuggcgccucuccgcccaguggcagaagggggaggaggugcaggugaucgccgucgagcccggcaagaaccccaagaacuuccagaccaugcccggcaucuuccagacgaccaccggggagaucggcgcgaucgcccuggacuucaagccggggaccagcggcagccccaucaucaaccgggagggcaaggugguggggcuguacggcaacggggucgugacgaagaacggcggguacguguccggcaucgcccagaccaacgccgagcccgacggcccgacccccgagcuggaggaggagauguucaagaagcgcaaccucaccaucauggaccugcaccccgggagcggcaagacgcggaaguaccugcccgccaucguccgcgaggcgaucaagcggcgccuccggacccugauccuggccccgacccgcgugguggccgccgagauggaggaggcccucaaggggcugcccauccgguaccagaccacggcgaccaaguccgagcacaccggcaaggagaucgucgaccugaugugccacgccaccuucacgaugcgccuccugagccccgugcgggugcccaacuacaaccugaucaucauggacgaggcccacuucaccgacccggccuccaucgccgcgcgcggguacaucagcacccgggucggcaugggcgaggccgccgccaucuucaugaccgcgacgccccccgggaccgccgacgccuucccccaguccaacgccccgauccaggacgaggagcgcgacauccccgagcgcagcuggaacuccggcaacgacuggaucaccgacuucgccgggaagaccgugugguucgugcccagcaucaaggcgggcaacgacaucgccaacugccuccggaagaacgggaagaaggucauccagcugucccgcaagacguucgacaccgaguaccagaagaccaagcugaacgacugggacuucguggugaccacggacaucagcgagaugggcgccaacuucaaggccgaccgggucaucgacccccgccggugccucaagccggugauccugaccgacggccccgagcgcgugauccuggccgggcccaugcccgucaccguggcguccgccgcccagcggcgcggccggguggggcgcaacccgcagaaggagaacgaccaguacaucuucaccggccagccccucaacaacgacgaggaccacgcccacuggacggaggccaagaugcugcuggacaacaucaacacccccgaggggaucauccccgcgcucuucgagccggagcgggagaagagcgccgccaucgacggcgaguaccgccugaagggcgagucccggaagaccuucgucgagcugaugcgccggggggaccuccccguguggcuggcccacaaggucgcgagcgagggcaucaaguacaccgaccgcaaguggugcuucgacggggagcggaacaaccagauccuggaggagaacauggacguggagaucuggaccaaggagggcgagaagaagaagcuccgcccccgguggcuggacgcccgcacguacuccgacccccuggcccucaaggaguucaaggacuucgccgccggccgcaagagcaucgcgcuggaccuggugaccgagaucgggcgggucccgucccaccucgcccaccgcacccggaacgcccuggacaaccuggugaugcuccacaccagcgagcacggcgggcgcgccuaccggcacgccguggaggagcugcccgagacgauggagacccugcuccugcugggccucaugauccugcugaccgggggcgcgaugcucuuccugaucagcggcaagggggucggcaagaccuccaucgggcugaucugcgugguggccagcuccggcaugcucuggauggccgacaucccccugcaguggaucgccagcgccaucguccuggaguucuucaugauggugcuccugaucccggagcccgagaagcagcgcacgccccaggacaaccagcuggcguacguggucaucgggauccucacccuggccgccaucguggccgccaacgagaugggccugcucgagaccaccaagcgggaccugggcauguccaaggagcccgggguggucagcccgacguccuaccuggacguggaccuccaccccgcgagcgccuggacccuguacgccguggccaccaccgucaucacgcccaugcugcgccacaccaucgagaacuccaccgcgaacgugagccucgccgccaucgccaaccaggccgugguccugaugggccuggacaagggguggcccaucuccaagauggaccucggcgugccgcugcuggcgcucgggugcuacagccaggugaacccccugacccugacggccgccguccuccugcuggugacccacuacgccaucaucggccccggccuccaggccaaggcgacccgggaggcccagaagcgcaccgccgccgggaucaugaagaaccccacgguggacggcaucaugaccaucgaccuggacccggucaucuacgacuccaaguucgagaagcagcuggggcaggugaugcuccuggugcugugcgccguccagcuccugcugaugcggaccagcugggcguucugcgaggcccucacccuggccacgggccccaucaccacccugugggagggcucccccgggaaguucuggaacaccacgaucgccgugagcauggcgaacaucuuccgcggcuccuaccucgccggggccggccuggccuucagcaucaugaaguccguggggaccggcaagcggggcaccgggagccagggcgagacccugggggagaaguggaagaagaagcucaaccagcugagccgcaaggaguucgaccuguacaagaaguccggcaucacggaggucgaccggaccgaggccaaggaggggcucaagcgcggcgagaucacccaccacgcggugagccggggcuccgccaagcugcagugguucguggagcgcaacauggucauccccgaggggcgggugaucgaccugggcugcgggcgcggcggguggagcuacuacugcgccggccucaagaaggugaccgagguccggggcuacaccaaggggggcccggggcacgaggagcccgugcccauguccacguacggcuggaacaucgugaagcugaugagcgggaaggacgucuucuaccugcccccggagaagugcgacacccuccugugcgacaucggcgaguccagccccucccccaccguggaggagagccgcaccauccgcgugcugaagauggucgagcccuggcugaagaacaaccaguucugcaucaaggugcucaacccguacaugcccacggugaucgagcaccuggagcggcugcagcgcaagcacggcgggaugcucguccggaacccccugucccgcaacagcacccacgagauguacuggaucuccaacggcaccgggaacaucgugagcuccgugaacauggucagccggcugcuccugaaccgcuucaccaugacguaccggcgccccaccaucgagaaggacguggaccugggcgccggcacccggcacgucaacgccgagccggagacccccaacauggacgugaucggggagcgcauccggcgcaucaaggaggagcacuccagcacguggcacuacgacgacgagaaccccuacaagaccugggcguaccacggcuccuacgaggugaaggccaccgggagcgccagcuccaugaucaacggcgucgugaagcuccugaccaagccgugggacgugguccccacggugacccagauggccaugaccgacaccacgcccuucgggcagcagcggguguucaaggagaaggucgacacccgcacccccaagccgaugcccggcacccggaaggugauggagaucacggccgaguggcuguggcgcacccucggccggaacaagcgcccccggcugugcacccgcgaggaguucaccaagaaggugcgcacgaacgcggccaugggggccgucuucaccgaggagaaccagugggacagcgcccgggcggccguggaggacgaggaguucuggaagcugguggaccgcgagcgggagcuccacaagcugggcaagugcggguccugcgucuacaacaugaugggcaagcgcgagaagaagcugggggaguucggcaaggccaagggcagccgggccaucugguacauguggcucggggcccgcuaccuggaguucgaggcgcugggcuuccucaacgaggaccacugguucucccgggagaacagcuacuccgggguggagggcgaggggcugcacaagcugggcuacauccuccgcgacaucagcaagauccccggcggggccauguacgccgacgacaccgccggcugggacacccggaucacggaggacgaccugcacaacgaggagaagaucacccagcagauggacccggagcaccgccagcuggccaacgcgaucuucaagcucaccuaccagaacaagguggucaaggugcagcggcccacccccaaggggacggugauggacaucaucucccgcaaggaccagcggggcagcggccaggucgggaccuacggccugaacaccuucaccaacauggaggcccagcugauccgccagauggagggggagggcgugcucuccaagaccgaccuggagaacccccaccugcucgagaagaagaucacgcaguggcuggagaccaaggggguggagcggcugaagcgcauggccaucagcggcgacgacugcgucgugaagccgaucgacgaccgguucgccaacgcccuccuggcgcugaacgacaugggcaaggugcgcaaggacaucccccaguggcagcccuccaagggguggcacgacuggcagcagguccccuucugcagccaccacuuccacgagcucaucaugaaggacggccggaagcugguggugccgugccgcccccaggacgagcugaucgggcgggcccgcaucucccagggcgccggguggagccucaaggagaccgccugccugggcaaggccuacgcgcagaugugggcccugauguacuuccaccgccgggaccuccgccuggccuccaacgccaucugcagcgcgguccccgugcacugggugcccaccucccggacgaccuggagcauccacgcccaccaccaguggaugaccaccgaggacaugcugacggucuggaaccgcguguggaucgaggacaacccguggauggaggacaagacccccgugaccaccugggaggacguccccuaccucggcaagcgggaggaccaguggugcgggagccugaucggccugacgucccgcgccaccugggcccagaacauccucaccgccauccagcaggugcggagccugaucgggaacgaggaguuccuggacuacaugcccuccaugaagcgcuuccggaaggaggaggagagcgagggcgcgaucugguga

SEQ ID NO: 10382 - RNA, 9873 nt, Artificial Sequence
  derived and/or modified CDS sequence (opt1) from DENV-3__KJ737429__SS-prME
accagccugugccucaugaugaugcugcccgccacccuggccuuccaccucaccagccgggacggcgagccgcggaugaucguggggaagaacgagcgcggcaagagccugcuguucaagaccgcguccgggaucaacaugugcacccucaucgccauggaccugggcgagaugugcgacgacaccgugacguacaagugcccccugaucgccgagguggagcccgaggacaucgacugcuggugcaaccucaccagcaccugggugaccuacgggacgugcaaccaggccggcgagcaccggcgcgacaagcgguccgucgcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagaacaagcccacccuggacaucgagcugcagaagaccgaggccacccagcucgcgacgcugcggaagcugugcaucgagggcaagaucaccaacaucaccaccgacagccgcugccccacgcagggcgaggccauccucccggaggagcaggaccagaacuacgugugcaagcacaccuacgucgaccggggguggggcaacgggugcggccuguucgggaagggcucccuggugaccugcgccaaguuccagugccucgagcccaucgagggcaaggugguccaguacgagaaccugaaguacaccgugaucaucacggugcacaccggggaccagcaccaggucggcaacgacacccagggggugaccgucgagaucacgccccaggccagcaccguggaggccgugcugcccgaguacggcacccucgggcuggagugcuccccgcgcaccggccuggacuucaacgagaugauccuccugaccaugaagaacaaggcguggaugguccaccggcagugguucuucgaccugccccuccccuggacgagcggcgccaccaccgagacccccacguggaaccgcaaggagcugcuggugaccuucaagaacgcccacgccaagaagcaggagguggucgugcucgggucccaggagggcgccaugcacaccgcgcugaccggggccacggagauccagaacagcggcgggaccuccaucuucgccggccaccugaagugccggcucaagauggacaagcuggagcugaagggcaugagcuacgccaugugccucaacaccuucgugcugaagaaggaggucuccgagacccagcacgggacgauccugaucaagguggaguacaagggcgaggacgccccgugcaagauccccuucagcaccgaggacgggcagggcaaggcgcacaacggccgccugaucaccgccaaccccguggucaccaagaaggaggagcccgugaacaucgaggccgagccgcccuucggggagagcaacaucgugaucggcaucggggacaaggcccucaagaucaacugguacaagaagggcuccagcaucgggaagauguucgaggcgacggcccggggcgcccgccggauggccauccugggcgacaccgccugggacuucggguccgucggcggggugcugaacagccucggcaagauggugcaccagaucuucggguccgcguacaccgcccuguucagcggcgucuccuggaucaugaagaucggcaucggggugcugcucaccuggaucggccugaacagcaagaacacguccaugagcuucuccugcaucgugaucgggaucaucacccuguaccucggcgccgucgugcaggccgacauggggugcgugaucaacuggaagggcaaggagcugaagugcggcagcgggaucuucgucaccaacgaggugcacaccuggacggagcaguacaaguuccaggccgacucccccaagcgccuggcgaccgccaucgccggcgccugggagaacggggugugcggcauccgcagcaccacccggauggagaaccuccuguggaagcagaucgccaacgagcugaacuacauccucugggagaacaacaucaagcugacggucguggugggggacaucaucggcguccuggagcagggcaagcgcacccucacgccccagccgauggagcugaaguacuccuggaagaccugggggaaggcgaagaucgugacggccgagacccagaacagcuccuucaucaucgacggccccaacacccccgagugccccagcgccucccgggccuggaacgugugggaggucgaggacuacggguucggcguguucaccacgaacaucuggcugaagcuccgcgagguguacacccagagcugcgaccaccggcugaugagcgcggccaucaaggacgagcgcgccguccacgccgacaugggcuacuggaucgagucccagaagaacgggagcuggaagcuggagaaggccuccuucaucgaggugaagaccugcaccuggcccaagagccacacccucugguccaacggcgugcuggagagcgacaugaucauccccaagucccuggcggggcccaucagccagcacaaccaccggccgggcuaccacacgcagaccgccgggcccuggcaccucggcaagcuggagcuggacuucaacuacugcgagggcaccaccgucgugaucacggagaacugcgggacccgcggccccucccuccggaccaccacggugagcgggaagcugauccacgaguggugcugccgcuccugcacccugcccccgcuccgguacaugggcgaggacgggugcugguacggcauggagauccgccccaucaacgagaaggaggagaacauggucaagagccugguguccgccggcagcgggaagguggacaacuucaccaugggcguccugugccucgccauccuguucgaggaggugaugcgggggaaguucggcaagaagcacaugaucgccggggugcuguucaccuucguccuccugcuguccggccagaucacguggcgcgacauggcgcacacccucaucaugaucggcagcaacgccuccgaccggauggggaugggcgugaccuaccuggcccugaucgccaccuucaagauccagcccuuccucgcccugggguucuuccugcgcaagcucacgagccgggagaaccugcugcucggcgugggccuggcgauggccaccacccugcagcuccccgaggacaucgagcagauggccaacgggaucgcccugggccugaugacccucaagcugaucacgcaguucgagaccuaccagcuguggaccgcgcucgucagccugaccugcuccaacacgaucuucacccugaccguggccuggcgcaccgccacgcucauccuggccggggucagccugcucccgcugugccaguccagcuccaugcggaagaccgacuggcugcccaugaccguggccgcgaugggcgugccgccccugccgcuguucaucuucagccugaaggacacccccaagcgccgcuccuggccccucaacgagggggucauggccgugggccuggugagcauccuggccuccagccuccugcggaacgacguccccauggccggcccgcugguggccgggggccuccugaucgcgugcuacgugaucacggggaccuccgccgaccugaccgucgagaaggccgccgacgugaccugggaggaggaggccgagcagacgggcgugagccacaaccucaugaucaccgucgacgacgacgggaccaugcgcaucaaggacgacgagaccgagaacauccugaccgugcugcucaagacggcgcugcugaucguguccggcaucuuccccuacagcauccccgccacccuccuggucuggcacaccuggcagaagcagacccagcgguccggcgugcugugggacgugcccagcccgcccgagacgcagaaggccgagcucgaggagggggucuaccgcaucaagcagcagggcaucuucgggaagacccaggugggcguggggguccagaaggagggcguguuccacaccauguggcacgugacccggggcgccguccugacgcacaacgggaagcgccuggagcccaacugggccuccgugaagaaggaccucaucagcuacggcgggggcuggcggcuguccgcgcaguggcagaagggggaggaggugcaggucaucgccguggagcccggcaagaacccgaagaacuuccagaccaugcccggcaucuuccagaccaccacgggggagaucggcgccaucgcccuggacuucaagcccgggaccagcggcagcccgaucaucaaccgcgagggcaagguggucgggcuguacggcaacgggguggugaccaagaacggcggguacgucuccggcaucgcgcagaccaacgccgagcccgacggccccacgcccgagcucgaggaggagauguucaagaagcggaaccugaccaucauggaccugcacccggggagcggcaagacccgcaaguaccuccccgccaucgugcgggaggccaucaagcgccggcugcgcacccugauccucgcccccacgcggguggucgcggccgagauggaggaggcccugaaggggcugcccauccgcuaccagaccaccgccaccaaguccgagcacacgggccgggagaucguggaccucaugugccacgccaccuucaccaugcgccugcugagcccggugcggguccccaacuacaaccucaucaucauggacgaggcgcacuucaccgaccccgccuccaucgccgcccgcggguacaucagcacgcgggugggcaugggcgaggccgcggccaucuucaugaccgccacgccgcccgggaccgccgaggcguucccccaguccaacgcccccauccaggacgaggagcgcgacauccccgagcgcagcuggaacuccggcaacgaguggaucacggacuucguggggaagaccgucugguucgugcccagcaucaaggccggcaacgacaucgccaacugccugcggaagaacgggaagaaggugauccagcugucccgcaagaccuucgacaccgaguaccagaagacgcggcucaacgacugggacuucgucgugaccaccgacaucagcgagaugggcgccaacuucaaggcggaccgcgugaucgacccccggcgcugccugaagcccgucauccugaccgacggccccgagcgggugauccucgccgggccgaugcccgugacggccgccuccgccgcgcagcgccggggccgcgucgggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgccgcgaucgacggcgaguaccggcugaagggcgagucccgcaagaccuucguggagcucaugcggcgcggggaccugcccgucuggcuggcccacaagguggccagcgagggcaucaaguacacggaccggaaguggugcuucgacggggagcgcaacaaccagauccucgaggagaacauggacguggagaucuggaccaaggagggcgagcggaagaagcugcgcccgcgcuggcuggacgcccggaccuacuccgacccccucgcgcugaaggaguucaaggacuucgccgccggccgcaagagcaucgcccuggaccucgucaccgagaucgggcgggugcccucccaccuggcccaccgcacgcggaacgcgcuggacaaccucgugaugcugcacaccagcgagcacggcgggcgcgccuaccggcacgccgucgaggagcugccggagaccauggagacccuccugcugcucggccugaugauccugcucaccggcggggccaugcuguuccugaucagcgggaaggggaucggcaagaccuccaucgggcucaucugcgugaucgugagcuccggcaugcuguggauggccgacgucccccugcaguggaucgcgagcgccaucgugcucgaguucuucaugauggugcugcugauccccgagcccgagaagcagcgcaccccgcaggacaaccagcucgccuacgucgugaucgggauccugacccuggccgccaucguggcggccaacgagaugggccuccuggagacgaccaagcgggaccugggcauguccaaggagcccggggucgugagccccaccuccuaccucgacguggaccugcaccccgccagcgccuggacccuguacgccgucgcgacgaccgugaucaccccgaugcuccgccacaccaucgagaacuccacggccaacgugagccuggccgccaucgcgaaccaggccgucgugcugaugggccucgacaagggguggcccaucuccaagauggaccugggcgugccccugcucgcccuggggugcuacagccaggucaacccccugacccucaccgccgccgugcugcugcucgugacccacuacgcgaucaucggcccgggccugcaggccaaggccacgcgggaggcccagaagcgcaccgccgcggggaucaugaagaaccccaccgucgacggcaucaugaccaucgaccuggaccccgugaucuacgacuccaaguucgagaagcagcucggccaggugaugcugcugguccucugcgccgugcagcugcugcucaugcggacgagcugggcccugugcgaggcccugacccucgccaccggccccaucaccacgcugugggagggcuccccggggaaguucuggaacaccaccaucgcggugagcauggccaacaucuuccgcggcuccuaccuggccggggccggccucgcguucagcaucaugaaguccgucgggaccggccggcgcggcacggggagccagggcgagacccugggggagaaguggaagaagaagcugaaccagcucagccggaaggaguucgaccuguacaagaaguccggcaucaccgagguggaccgcaccgaggccaaggaggggcugaagcggggcgagaccacgcaccacgccgugagccgcggcuccgccaagcuccagugguucgucgagcggaacauggugauccccgaggggcgcgugaucgaccugggcugcgggcgcggcggguggagcuacuacugcgccggccugaagaaggucaccgaggugcggggcuacaccaagggcgggcccgggcacgaggagcccgugccgauguccaccuacggcuggaacaucgucaagcucaugagcgggaaggacguguucuaccugccgcccgagaagugcgacacgcugcugugcgacaucggcgaguccagccccuccccgaccguggaggagagccgcaccauccggguccucaagaugguggagcccuggcugaagaacaaccaguucugcaucaaggugcugaaccccuacaugcccaccgucaucgagcaccucgagcgccugcagcggaaguacggcgggaugcuggugcgcaacccgcucucccggaacagcacgcacgagauguacuggaucuccaacggcaccgggaacaucgugagcuccgucaacauggugagccgccugcugcucaaccgguucaccaugacccaccgccggcccacgaucgagaaggacgucgaccugggcgcgggcacccgccacgugaacgccgagcccgagaccccgaacauggacgugaucggggagcggaucaagcgcaucaaggaggagcacuccagcaccuggcacuacgacgacgagaaccccuacaagacgugggccuaccacggcuccuacgaggucaaggccaccgggagcgccagcuccaugaucaacggcguggugaagcugcucaccaagcccugggacgucgugcccauggugacccagauggcgaugacggacaccaccccguucgggcagcagcgggucuucaaggagaagguggacacccgcacgccccggcccaugcccggcacccgcaaggugauggagaucaccgccgaguggcuguggcggacccugggccgcaacaagaagccgcgccucugcacgcgggaggaguucaccaagaagguccgcaccaacgccgccaugggggccguguucaccgaggagaaccagugggacagcgcgcgggccgccguggaggacgaggaguucuggaagcuggucgaccgcgagcgggagcugcacaagcucggcaagugcggguccugcguguacaacaugaugggcaagcgcgagaagaagcugggggaguucggcaaggccaagggcagccgggcgaucugguacauguggcugggggcccgcuaccucgaguucgaggcccugggcuuccugaacgaggaccacugguucucccgggagaacagcuacuccgggguggagggcgaggggcuccacaagcugggcuacauccugcgcgacaucagcaagauccccggcggggccauguacgccgacgacacggcgggcugggacacccggaucaccgaggacgaccuccacaacgaggagaagaucacccagcagauggaccccgagcaccgccagcuggccaacgccaucuucaagcugacguaccagaacaaggucgugaaggugcagcggcccaccccgaaggggaccgucauggacaucaucucccgcaaggaccagcggggcagcggccagguggggaccuacggccucaacaccuucacgaacauggaggcccagcuggugcgccagauggagggggagggcguccuguccaaggccgaccucgagaacccccaccuccuggagaagaagaucacccaguggcucgagaccaaggggguggagcggcugaagcgcauggcgaucagcggcgacgacugcguggucaagcccaucgacgaccgguucgccaacgcccugcucgcccugaacgacaugggcaaggugcgcaaggacaucccccaguggcagccguccaagggguggcacgacuggcagcagguccccuucugcagccaccacuuccacgagcugaucaugaaggacggccggaagcucgucgugcccugccgcccccaggacgagcugaucgggcgcgcccggaucucccagggcgcgggguggagccugaaggagaccgccugccucggcaaggccuacgcccagauguggucccugauguacuuccaccgccgggaccugcgccucgccagcaacgcgaucugcuccgccgugccgguccacugggugcccacgagccggaccaccuggagcauccacgcccaccaccaguggaugaccacggaggacaugcugaccguguggaaccgcgucuggaucgaggacaaccccuggauggaggacaagacccccgugaccacgugggaggacgugccguaccugggcaagcgggaggaccaguggugcgggucccucaucggccugaccagccgcgccaccugggcgcagaacauccugaccgccauccagcagguccggucccucaucggggacgaggaguuccuggacuacaugcccagcaugaagcgcuuccggaaggaggaggaguccgagggcgccaucugguga

SEQ ID NO: 10383 - RNA, 9873 nt, Artificial Sequence
  derived and/or modified CDS sequence (opt1) from DENV-3__DQ863638__SS-prME
accagccugugccucaugaugaugcugcccgcgacccuggccuuccaccucaccagccgggacggcgagccccggaugaucguggggaagaacgagcggggcaagagccugcuguucaagaccgcgagcgggaucaacaugugcacccucaucgccauggaccugggcgagaugugcgacgacaccgugaccuacaagugcccccacaucgccgagguggagcccgaggacaucgacugcuggugcaaccugaccagcaccugggugaccuacgggacgugcaaccaggccggcgagcaccggcgcgacaagcgguccguggcccucgcgccccacgugggcauggggcuggacacccgcacccagaccuggaugagcgccgagggcgccuggcgccagguggagaaggucgagacgugggcccugcgccaccccggguucaccauccucgcgcuguuccuggcccacuacaucggcaccucccucacccagaagguggugaucuucauccugcugauccucgucacgcccagcauggccaugcggugcgugggggugggcaaccgcgacuucgucgagggccuguccggggccaccuggguggacgugguccuggagcacggcgggugcgugaccaccauggccaagaacaagcccacgcucgacaucgagcugcagaagaccgaggcgacccagcuggccacccuccggaagcugugcaucgagggcaagaucacgaacaucaccaccgacagccgcugccccacccagggcgaggccauccugcccgaggagcaggaccagaacuacgugugcaagcacacguacgucgaccggggguggggcaacgggugcggccucuucgggaagggcucccuggugaccugcgccaaguuccagugccuggagagcaucgagggcaaggugguccagcacgagaaccucaaguacaccgugaucaucaccgugcacacgggggaccagcaccaggucggcaacgagacccagggggugaccgccgagaucacgccccaggcguccacggucgaggccauccugcccgaguacggcacccuggggcucgagugcagcccccgcaccggccuggacuucaacgagaugauccugcucaccaugaagaacaaggccuggauggugcaccggcagugguucuucgaccugccgcugcccuggaccuccggcgccacgaccgagacccccaccuggaaccgcaaggagcuccuggugacguucaagaacgcccacgcgaagaagcaggaggucguggugcuggggagccaggagggcgccaugcacaccgcccucaccggggccaccgagauccagaacuccggcgggacgagcaucuucgccggccaccugaagugccggcugaagauggacaagcucgagcugaagggcauguccuacgcgaugugccugaacaccuucguccucaagaaggaggugagcgagacccagcacgggaccauccugaucaagguggaguacaagggcgaggacgcccccugcaagaucccguucagcacggaggacgggcagggcaaggcccacaacggccgccugaucaccgccaaccccgucgugaccaagaaggaggagcccgugaacaucgaggcggagcccccguucggggaguccaacaucgucaucggcaucggggacaaggcccugaagaucaacugguacaagaagggcagcuccaucgggaagauguucgaggccaccgcccggggcgcccgccggauggcgauccucggcgacacggccugggacuucgggagcgugggcggggugcugaacucccugggcaagaugguccaccagaucuucgggagcgccuacaccgcccucuucuccggcgugagcuggaucaugaagaucggcaucggggugcugcugaccuggaucggccucaacuccaagaacaccagcauguccuucagcugcaucgccaucgggaucaucacgcuguaccugggcgcggucgugcaggccgacauggggugcgugaucaacuggaagggcaaggagcucaagugcggcuccgggaucuucgucaccaacgaggugcacaccuggaccgagcaguacaaguuccaggccgacagccccaagcgccuggccacggccaucgcgggcgccugggagaacggggugugcggcauccgcuccaccacccggauggagaaccugcucuggaagcagaucgccaacgagcugaacuacauccugugggagaacaacaucaagcucaccgucguggugggggacaucaucggcguccuggagcagggcaagcgcacgcugacgccccagcccauggagcucaaguacagcuggaagaccugggggaaggccaagaucgugaccgcggagacgcagaacuccagcuucaucaucgacggcccgcacacccccgagugcccccgggccucccgcgccuggaacgugugggaggucgaggacuacggguucggcguguucaccaccaacaucuggcugaagcugcgggaggaguacacgcagcucugcgaccaccgccugaugagcgccgccgugaaggacgagcgggcgguccacgccgacaugggcuacuggaucgagagccagaagaacggguccuggaagcuggagaaggccagccucaucgaggugaagaccugcaccuggcccaagucccacacccuguggagcaacggcgugcuggaguccgacaugaucauccccaagagccucgccgggcccaucucccagcacaaccaccgccccggcuaccacacccagacggccgggccguggcaccugggcaagcuggagcucgacuucaacuacugcgagggcaccaccgucgugaucaccgagaacugcgggacgcggggccccagccugcgcaccaccaccguguccgggaagcugauccacgaguggugcugccggagcugcacgcugccgccccuccgcuacaugggcgaggacgggugcugguacggcauggagauccggccgaucaacgagaaggaggagaacauggucaagucccuggcgagcgccggcuccgggaagguggacaacuucaccaugggcuuccucugccuggccauccuguucgaggaggugaugcgcgggaaguucggcaagaagcacaugaucgccggggucuuccucaccuuccugcugcuccugagcggccagaucaccuggcgggacauggcccacacgcugaucaugaucggcuccaacgcgagcgaccgcauggggaugggcgugaccuaccucgcccugaucgccaccuucaagauccagcccuuccuggcccucggguucuuccugcggaagcugaccucccgcgagaacuuccuccugggcgugggccuggcgauggccacgacccuccagcugcccgaggacaucgagcagauggccaacgggaucgcccugggccucauggcccugaagcugaucacccaguucgagaccuaccagcucuggacggcgcuggucagccugaccugcagcaacaccaucuucacccucacgguggccuggcggaccgccacccugauccuggccggggugucccuccugcccgucugccagagcuccagcaugcgcaagaccgacuggcugccgauggccguggcggccaugggcgugccgccccugccccuguucaucuucucccugaaggacacgcucaagcgccggagcuggccgcugaacgagggggucauggccgugggccuggucuccauccucgccagcucccugcugcgcaacgacgugcccauggccggcccccucguggccggcgggcugcugaucgccugcuacgucaucaccgggaccagcgccgaccucaccguggagaaggccgccgacgugacgugggaggaggaggcggagcagaccggggucucccacaaccugaugaucaccguggacgacgacgggaccaugcggaucaaggacgacgagacggagaacauccugaccgugcuccugaagaccgcccugcucaucgucagcggcaucuuccccuacuccaucccggccacccugcugguguggcacaccuggcagaagcagacgcagcgcagcggcgugcucugggacguccccagcccgcccgagacccagaaggccgagcuggaggaggggguguaccggaucaagcagcagggcaucuucgggaagacccaggugggcgucggggugcagaaggagggcguguuccacaccauguggcacgucacgcgcggcgcggugcugacccacaacgggaagcggcucgagccgaacugggccagcgugaagaaggaccugaucuccuacggcgggggcuggcgccugagcgcccaguggcagaagggggaggagguccaggugaucgccguggagcccggcaagaaccccaagaacuuccagaccaugcccggcaucuuccagaccacgaccggggagaucggcgccaucgcgcuggacuucaagccggggaccuccggcagccccaucaucaaccgggagggcaaggucguggggcucuacggcaacgggguggucaccaagaacggcggguacgugagcggcaucgcccagacgaacgccgagcccgacggcccgacccccgagcuggaggaggagauguucaagaagcgcaaccugaccaucauggaccuccaccccggguccggcaagacccggaaguaccugcccgccaucgugcgcgaggccaucaagcggcgccugcggacgcucauccuggcgccgacccgcgucguggccgccgagauggaggaggcccugaaggggcuccccauccgguaccagaccaccgccaccaaguccgagcacaccggccgcgagaucguggaccugaugugccacgcgaccuucaccaugcggcugcucucccccguccgcgugcccaacuacaaccugaucaucauggacgaggcccacuucacggacccggccagcaucgccgcgcggggguacaucuccacccgcgugggcaugggcgaggccgccgccaucuucaugaccgccacgccgcccgggacggcggacgccuucccccagagcaacgccccgauccaggacgaggagcgcgacauccccgagcgguccuggaacagcggcaacgaguggaucaccgacuucgucgggaagaccgugugguucgugcccuccaucaaggccggcaacgacaucgccaacugccugcgcaagaacgggaagaaggucauccagcucagccggaagaccuucgacacggaguaccagaagaccaagcugaacgacugggacuucguggugaccaccgacaucuccgagaugggcgcgaacuucaaggccgaccgcgucaucgacccccggcgcugccugaagccggugauccucacggacggccccgagcgggugauccuggccgggcccaugcccgucaccgccgccagcgcggcccagcgccggggccgcguggggcggaacccgcagaaggagaacgaccaguacaucuuccgcggccagccccugaacaacgacgaggaccacgcccacuggaccgaggccaagaugcuccuggacaacaucaacacccccgaggggaucauccccgcgcuguucgagccggagcgggagaaguccgccgccaucgacggcgaguaccgccucaagggcgagagccggaagacguucguggagcugaugcgccgcggggaccugcccgucuggcucgcccacaagguggccuccgagggcaucaaguacaccgaccgcaaguggugcuucgacggggagcggaacaaccagauccuggaggagaacauggacguggagaucuggaccaaggagggcgagaagaagaagcugcgcccccgcuggcucgacgcgcggaccuacagcgacccccuggcccugaaggaguucaaggacuucgccgccggccgcaaguccaucgcccucgaccuggucaccgagaucgggcgggugccgagccaccuggcgcaccgcacgcggaacgcccucgacaaccuggucaugcugcacaccuccgagcacggcgggcgcgccuaccggcacgccguggaggagcuccccgagaccauggagacccugcugcuccugggccugaugauccuccugaccggcggggccaugcuguuccucaucagcgggaaggggaucggcaagaccagcaucgggcugaucugcgugaucgcguccagcggcaugcuguggauggccgacgucccccuccaguggaucgccuccgccaucgugcuggaguucuucaugauggugcugcucaucccggagcccgagaagcagcgcacgccccaggacaaccagcuggccuacgucgugaucgggauccugacccucgcggccaucguggccgccaacgagaugggccugcuggagacgaccaagcgggaccucggcaugagcaaggagcccggggucguguccccgaccagcuaccuggacguggaccugcaccccgcguccgccuggacccucuacgccgucgccacgaccgugaucacccccaugcugcgccacaccaucgagaacagcacggccaacgugucccuggcggccaucgccaaccaggccgucgugcucaugggccuggacaagggguggcccaucagcaagauggaccugggcgugccgcuccuggcccuggggugcuacucccaggucaacccccucacccugaccgcggccgugcugcuccuggccacccacuacgccaucaucggccccggccugcaggccaaggcgacgcgggaggcccagaagcgcaccgccgccgggaucaccaagaaccccaccguggacggcaucaugacgaucgaccucgacccggucaucuacgacagcaaguucgagaagcagcugggccaggugaugcugcucgugcugugcgcgguccagcugcuccugaugcggaccuccugggcccugugcgaggcccucacccuggccaccggccccaucacgacccugugggagggcagccccgggaaguucuggaacaccaccaucgccguguccauggcgaacaucuuccgcggcagcuaccucgccggggccggccuggccuucuccaucaugaaguccguggggacgggcaagcggggcaccgggucccagggcgagacccugggggagaaguggaagaagaagcucaaccagcugagccgcaaggaguucgaccuguacaagaaguccggcaucaccgaggucgaccggacggaggccaaggaggggcucaagcgcggcgagaucacccggcacgcggugucccgcggcagcgccaagcugcagugguucguggagcggaacauggucauccccgaggggcgcgugaucgaccugggcugcgggcgcggcgggugguccuacuacugcgccggccucaagaaggugaccgagguccggggcuacaccaagggcggcccggggcacgaggagcccgugcccaugagcaccuacggcuggaacaucgugaagcugauguccgggaaggacgucuucuaccugcccccggagaagugcgacacgcugcucugcgacaucggcgagagcucccccagccccaccguggaggagucccgcaccauccgggugcugaagauggucgagcccuggcugaagaacaaccaguucugcaucaaggugcucaacccguacaugcccaccgugaucgagcaccuggagcgccugcagcggaagcacggcgggaugcucguccgcaacccccugagccggaacuccacgcacgagauguacuggaucagcaacggcaccgggaacaucguguccagcgugaacauggucucccgccugcuccugaaccgguucaccaugacccaccgccggcccacgaucgagaaggacguggaccugggcgccggcacccgccacgugaacgccgagccggagacccccaacauggacgucaucggggagcggaucaagcgcaucaaggaggagcacaacagcaccuggcacuacgacgacgagaaccccuacaagacgugggcguaccacggcuccuacgaggugaaggccaccgggagcgccuccagcaugaucaacggcguggucaagcuccugaccaagccgugggacgugguccccauggugauccagauggccaugaccgacacgacccccuucgggcagcagcggguguucaaggagaaggucgacacccgcacgccccggccgaugcccggcacccgcaaggugauggagaucaccgcggaguggcuguggcggacccucggccgcaacaagcgcccccggcugugcacccgcgaggaguucacgaagaaggugcggaccaacgccgccaugggggccgucuucaccgaggagaaccagugggacagcgcccgcgcggccguggaggacgaggaguucuggaagcugguggaccgggagcgcgagcuccacaagcugggcaagugcggguccugcgucuacaacaugaugggcaagcgggagaagaagcugggggaguucggcaaggccaagggcagccgcgccaucugguacauguggcucggggcccgguaccuggaguucgaggcgcugggcuucuucaacgaggaccacugguucucccgcgagaacagcuacuccgggguggagggcgaggggcuccacaagcugggcuacauccugcgggacaucagcaagauccccggcggggccauguacgccgacgacaccgccggcugggacacgcgcaucaccgaggacgaccuccacaacgaggagaagaucacccagcagauggacccggagcaccggcagcuggccaacgcgaucuucaagcugaccuaccagaacaagguggucaaggugcagcgccccacgcccaaggggaccgugauggacaucaucucccggaaggaccagcgcggcagcggccaggucgggaccuacggccucaacaccuucacgaacauggaggcccagcuggugcggcagauggagggggagggcgugcuguccaaggccgaccucgagaacccccaccuccuggagaagaagaucacccaguggcucgagaccaagggggucgagcgccugaagcggauggccaucagcggcgacgacugcguggugaagccgaucgacgaccgcuucgccaacgcgcugcucgcccugaacgacaugggcaagguccggaaggacaucccccaguggcagcccuccaagggguggcacgacuggcagcagguccccuucugcagccaccacuuccacgagcugaucaugaaggacggccgcaagcucguggucccgugccgcccccaggacgagcugaucgggcgggcccgcaucucccggggcgccggguggagccugaaggagaccgcgugccucggcaaggccuacgcccagauguggucccugauguacuuccaccgccgggaccugcgccucgccagcaacgccaucugcuccgcggugcccgugcacuggguccccaccagccggacgaccugguccauccacgcccaccaccaguggaugaccaccgaggacaugcugacgguguggaaccgcguguggaucgaggacaacccguggauggaggacaagacccccgucaccaccugggaggacgugcccuaccugggcaagcgggaggaccaguggugcgggagccucaucggccugacgagccgcgccaccugggcccagaacauccugaccgccauccagcagguccggucccucaucgggaacgaggaguuccuggacuacaugcccagcaugaagcgcuucaagaaggaggaggaguccgagggcgcgaucugguga

SEQ ID NO: 10384 - RNA, 9873 nt, Artificial Sequence
  derived and/or modified CDS sequence (opt1) from DENV-3__KJ737430__SS-prME
accagccugugccucaugaugaugcugcccgccacccuggccuuccaccucacgucccgcgacggcgagccgcggaugaucguggggaagaacgagcgcggcaagagccugcuguucaagaccgcguccgggaucaacaugugcacccucaucgccauggaccugggcgagaugugcgacgacaccgucacguacaagugcccccugaucgccgagguggagcccgaggacaucgacugcuggugcaaccucaccagcaccugggugaccuacgggacgugcaaccaggccggcgagcaccggcgcgacaagcgguccgucgcccuggcgccccacgugggcauggggcuggacacccgcacccagaccuggaugagcgccgagggcgccuggcggcagguggagaaggucgagacgugggcccuccgccacccgggguucaccauccuggcgcuguuccucgcccacuacaucggcaccucccugacccagaagguggugaucuucauccugcucaugcuggucacgcccagcauggccaugcggugcgugggggugggcaaccgcgacuucgucgagggccuguccggggccaccuggguggacgugguccucgagcacggcgggugcgugaccaccauggccaagaacaagcccacgcuggacaucgagcugcagaagaccgaggcgacccagcucgccacccugcggaagcugugcaucgagggcaagaucacgaacaucaccaccgacagccgcugccccacccagggcgaggccauccucccggaggagcaggaccagaacuacgugugcaagcacacguacgucgaccggggguggggcaacgggugcggccuguucgggaagggcucccuggugaccugcgccaaguuccagugccucgagagcaucgagggcaaggugguccagcacgagaaccugaaguacaccgugaucaucaccgugcacacgggggaccagcaccaggucggcaacgacacccagggggugaccgucgagaucaccccccaggccuccacgguggaggcgauccugcccgaguacggcacccucgggcuggagugcagcccccgcaccggccuggacuucaacgagaugauccuccugaccaugaagaacaaggccuggauggugcaccggcagugguucuucgaccugccgcuccccuggaccuccggcgccacgaccgagacccccaccuggaaccgcaaggagcugcuggucacguucaagaacgcccacgccaagaagcaggagguggugguccucgggagccaggagggcgcgaugcacaccgcccugaccggggccaccgagauccagaacuccggcgggacgagcaucuucgccggccaccugaagugccggcucaagauggacaagcuggagcugaagggcauguccuacgccaugugccucaacaccuucgugcugaagaaggaggugagcgagacccagcacgggaccauccugaucaaggucgaguacaagggcgaggacgcgcccugcaagaucccguucagcacggaggacgggcagggcaaggcccacaacggccgccugaucaccgccaaccccguggugaccaagaaggaggagcccgucaacaucgaggccgagcccccguucggggaguccaacaucgugaucggcaucggggacaaggcgcucaagaucaacugguacaagaagggcagcuccaucgggaagauguucgaggccaccgcccggggcgcccgccggauggccauccugggcgacacggcgugggacuucgggagcgugggcgggguccugaacucccucggcaagauggugcaccagaucuucgggagcgccuacaccgcccuguucuccggcgugagcuggaucaugaagaucggcaucgggguccugcucaccuggaucggccugaacuccaagaacaccagcauguccuucagcugcaucgccaucgggaucaucacgcuguaccucggcgccguggugcaggcggacauggggugcgucaucaacuggaagggcaaggagcugaagugcggcuccgggaucuucgugaccaacgaggugcacaccuggaccgagcaguacaaguuccaggccgacagccccaagcgccuggccacggccaucgccggcgcgugggagaacggggucugcggcauccgcuccaccacccggauggagaaccuccuguggaagcagaucgccaacgagcugaacuacauccucugggagaacaacaucaagcugaccgugguggucggggacaucaucggcgugcuggagcagggcaagcgcacgcucaccccccagcccauggagcugaaguacagcuggaagaccugggggaaggccaagaucgugaccgccgagacgcagaacuccagcuucaucaucgacggcccgaacacccccgagugccccuccgcgagccgggccuggaacgucugggagguggaggacuacggguucggcguguucaccaccaacaucuggcugaagcuccgcgaggucuacacgcagagcugcgaccaccggcugauguccgccgccaucaaggacgagcgcgccgugcacgcggacaugggcuacuggaucgagagccagaagaacggguccuggaagcuggagaaggccagcuucaucgaggugaagaccugcaccuggcccaagucccacacccucuggagcaacggcguccuggaguccgacaugaucaucccgaagagccuggccgggcccaucucccagcacaaccaccggcccggcuaccacacccagacggccgggccguggcaccucggcaagcuggagcuggacuucaacuacugcgagggcaccaccguggugaucaccgagaacugcgggacgcgcggccccagccuccggaccaccaccgucuccgggaagcugauccacgaguggugcugccgcagcugcacgcugcccccccuccgguacaugggcgaggacgggugcugguacggcauggagauccgcccgaucaacgagaaggaggagaacauggugaagucccuggugagcgccggcuccgggaaggucgacaacuucaccaugggcgugcugugccucgcgauccuguucgaggaggugaugcgggggaaguucggcaagaagcacaugaucgccgggguccuguucaccuucgugcuccugcugagcggccagaucaccuggcgcgacauggcccacacgcucaucaugaucggcuccaacgccagcgaccggauggggaugggcgugaccuaccuggcccugaucgcgaccuucaagauccagcccuuccucgcccugggguucuuccugcgcaagcucaccagccgggagaaccugcugcucggcgucggccuggccauggccacgacccugcagcuccccgaggacaucgagcagauggcgaacgggaucgcccugggccugauggcccucaagcugaucacccaguucgagaccuaccagcuguggacggcccucgugucccugaccugcagcaacaccaucuucacccugacgguggccuggcgcaccgcgacccucauccuggccggggucucccugcuccccgugugccagagcuccagcaugcggaagaccgacuggcugccgauggccgucgccgccaugggcgugcccccccugccccucuucaucuucucccugaaggacacgcugaagcgccgcagcuggccgcucaacgagggggugauggcggucggccugguguccauccuggccagcucccuccugcggaacgacgugcccauggccggcccccuggucgccgggggccuccugaucgccugcuacgugaucaccgggaccagcgcggaccugaccguggagaaggccgccgacgucacgugggaggaggaggccgagcagaccggcgugucccacaaccucaugaucaccguggacgacgacgggaccaugcgcaucaaggacgacgagacggagaacauccugaccguccugcucaagaccgcccugcugaucgugagcggcaucuuccccuacuccaucccggcgacccuccugguguggcacaccuggcagaagcagacgcagcggagcggcguccugugggacgugcccuccccccccgagacccagaaggccgagcucgaggaggggguguaccgcaucaagcagcagggcaucuucgggaagacccaggucggcgugggggugcagaaggagggcgucuuccacaccauguggcacgugacgcggggcgccgugcugacccacaacgggaagcgccuggagccgaacugggccagcgucaagaaggaccucaucuccuacggcgggggcuggcggcugagcgcgcaguggcagaagggggaggaggugcaggugaucgccgucgagcccggcaagaaccccaagaacuuccagaccaugcccggcaucuuccagaccacgaccggggagaucggcgccaucgcccuggacuucaagccggggaccagcggcucccccaucaucaaccgcgagggcaaggugguggggcuguacggcaacggggucgugaccaagaacggcggguacgugagcggcaucgcccagacgaacgcggagcccgacggcccgacccccgagcucgaggaggagauguucaagaagcggaaccugaccaucauggaccugcaccccggguccggcaagacccgcaaguaccuccccgccaucguccgggaggccaucaagcgccggcugcgcacgcugauccucgccccgacccgggugguggccgcggagauggaggaggcccugaaggggcugcccauccgcuaccagaccaccgccacgaagagcgagcacaccggccgggagaucgucgaccucaugugccacgccaccuucaccaugcgccugcugucccccgugcgggugcccaacuacaaccucaucaucauggacgaggcccacuucacggacccggcgagcaucgccgcccgcggguacaucuccacccgggucggcaugggcgaggccgcggccaucuucaugaccgccaccccccccgggacggccgaggccuucccccagagcaacgcgccgauccaggacgaggagcgcgacauccccgagcgcuccuggaacagcggcaacgaguggaucaccgacuucguggggaagaccgugugguucguccccuccaucaaggccggcaacgacaucgccaacugccugcggaagaacgggaagaaggugauccagcugagccgcaagaccuucgacacggaguaccagaagaccaagcucaacgacugggacuucguggucaccaccgacaucuccgagaugggcgccaacuucaaggccgaccgggugaucgacccccgccggugccugaagccggugauccugacggacggccccgagcgcgucauccucgcggggcccaugcccgugaccgccgccagcgccgcccagcggcgcggccggguggggcgcaacccgcagaaggagaacgaccaguacaucuucaccggccagccccugaacaacgacgaggaccacgcgcacuggaccgaggccaagaugcugcucgacaacaucaacacgcccgaggggaucauccccgcccuguucgagccggagcgggagaaguccgccgcgaucgacggcgaguaccgccugaagggcgagagccggaagaccuucgucgagcucaugcgccggggggaccugcccguguggcuggcccacaaggucgccuccgagggcaucaaguacaccgaccgcaaguggugcuucgacggggagcggaacaaccagauccucgaggagaacauggacguggagaucuggaccaaggagggcgagcgcaagaagcugcggccccgcuggcuggacgcccgcaccuacagcgacccccucgcccugaaggaguucaaggacuucgcggccggccggaaguccaucgcccuggaccucgugacggagaucgggcgcgucccgagccaccuggcccaccggacccgcaacgcccuggacaaccucgugaugcugcacaccagcgagcacggcgggcgggcguaccgccacgccguggaggagcugcccgagaccauggagacgcuccugcugcucggccugaugauccugcucaccgggggcgccaugcuguuccugaucuccggcaaggggaucggcaagaccagcaucgggcucaucugcgucaucguguccagcggcaugcuguggauggccgacgugccccugcaguggaucgccuccgcgaucguccucgaguucuucaugauggugcugcugaucccggagcccgagaagcagcggaccccccaggacaaccagcucgccuacguggucaucgggauccugacgcuggccgccaucguggccgcgaacgagaugggccuccuggagaccaccaagcgcgaccugggcaugagcaaggagcccgggguggucuccccgaccagcuaccucgacguggaccugcaccccgccuccgccuggacgcuguacgccguggcgaccaccgucaucacccccaugcuccggcacacgaucgagaacagcaccgccaacgugucccuggccgccaucgccaaccaggcggugguccugaugggccucgacaagggguggcccaucagcaagauggaccugggcgugccgcugcucgcccuggggugcuacucccaggugaacccccugacccucaccgccgccguccugcugcucgugacgcacuacgccaucaucggccccggccugcaggcgaaggccacccgcgaggcccagaagcggaccgccgccgggaucaugaagaaccccaccguggacggcaucaugacgaucgaccuggacccggucaucuacgacagcaaguucgagaagcagcucgggcaggugaugcugcuggugcucugcgcgguccagcugcugcucaugcgcaccuccugggcccugugcgaggcccugacccucgccaccggccccaucacgacccugugggagggcagccccgggaaguucuggaacaccaccaucgcgguguccauggccaacaucuuccggggcagcuaccuggccggggccggccucgccuucuccaucaugaagagcguggggacgggcaagcgcggcaccgggagccagggcgagacccugggggagaaguggaagaagaagcugaaccagcucucccggaaggaguucgaccuguacaagaagagcggcaucaccgaggucgaccgcacggaggcgaaggaggggcugaagcggggcgagaccacccaccacgccgugucccgcggcagcgccaagcuccagugguucguggagcggaacauggucauccccgaggggcgcgugaucgaccugggcugcgggcggggcgggugguccuacuacugcgccggccugaagaaggugaccgagguccgcggcuacaccaaggggggcccggggcacgaggagcccgugcccaugagcacguacggcuggaacaucgugaagcucauguccgggaaggacgucuucuaccugcccccggagaagugcgacacccugcugugcgacaucggcgagagcucccccagccccaccguggaggagucccgcaccauccgggugcucaagauggucgagcccuggcugaagaacaaccaguucugcaucaaggugcugaacccguacaugcccacggugaucgagcaccucgagcgccugcagcggaaguacggcgggaugcugguccgcaacccccucagccggaacuccacccacgagauguacuggaucagcaacggcaccgggaacaucguguccagcgugaacauggucucccgccugcugcucaaccgguucaccaugacgcaccgccggcccaccaucgagaaggacguggaccugggcgccggcacccgccacgucaacgcggagccggagacccccaacauggacgugaucggggagcggaucaagcgcaucaaggaggagcacagcuccacguggcacuacgacgacgagaaccccuacaagaccugggccuaccacggcagcuacgaggugaaggccaccgggagcgccuccagcaugaucaacggcgucgugaagcugcucaccaagccgugggacgugguccccauggugauccagauggccaugacggacaccacccccuucgggcagcagcggguguucaaggagaaggucgacacccgcacgccccggccgaugcccggcacccgcaaggugauggagaucaccgcggaguggcuguggcggacccugggccgcaacaagcggccccgccucugcacgcgcgaggaguucaccaagaaggugcggaccaacgccgccaugggggccgucuucaccgaggagaaccagugggacuccgcgcgcgccgccguggaggacgaggaguucuggaagcugguggaccgggagcgcgagcugcacaagcucggcaagugcgggagcugcgucuacaacaugaugggcaagcgggagaagaagcugggggaguucggcaaggccaagggcucccgcgccaucugguacauguggcugggggcgcgguaccucgaguucgaggcccugggcuuccugaacgaggaccacugguucagccgcgagaacuccuacagcgggguggagggcgaggggcuccacaagcugggcuacauccugcgggacaucuccaagauccccggcggggccauguacgccgacgacacggccggcugggacacccgcaucaccgaggacgaccuccacaacgaggagaagaucacccagcagauggacccggagcaccggcagcuggcgaacgccaucuucaagcugacguaccagaacaagguggucaaggugcagcgccccacccccaaggggaccgugauggacaucaucagccggaaggaccagcgcggcuccggccaggucgggaccuacggccucaacacguucaccaacauggaggcccagcuggugcggcagauggagggggagggcgugcugagcaaggccgaccucgagaacccccaccugcuggagaagaagaucacccaguggcucgagaccaagggggucgagcgccugaagcggauggccaucuccggcgacgacugcguggugaagccgaucgacgaccgcuucgcgaacgcccugcucgcccugaacgacaugggcaagguccggaaggacaucccccaguggcagcccagcaagggguggcacgacuggcagcaggugcccuucugcucccaccacuuccacgagcugaucaugaaggacggccgcaagcucguggucccgugccggccccaggacgagcugaucgggcgcgcccgcaucagccagggcgccggguggucccugaaggagaccgcgugccucggcaaggccuacgcccagauguggagccugauguacuuccaccggcgcgaccugcggcucgccuccaacgcgaucugcagcgccgugcccgugcacuggguccccacgagccgcaccaccugguccauccacgcccaccaccaguggaugaccacggaggacaugcugaccguguggaaccggguguggaucgaggacaacccguggauggaggacaagacccccgucaccacgugggaggacgugcccuaccugggcaagcgcgaggaccaguggugcgggagccucaucggccugaccucccgggccaccugggcccagaacauccugaccgcgauccagcaggugcgcagccucaucggggacgaggaguuccuggacuacaugcccuccaugaagcgguuccgcaaggaggaggagagcgagggcgccaucugguga

SEQ ID NO: 10385 - RNA, 9873 nt, Artificial Sequence
  derived and/or modified CDS sequence (opt1) from DENV-3__AY858040__SS-prME
accagccugugccucaugaugaugcugcccgccacccuggccuuccaccucacgucccgcgacggcgagccgcggaugaucguggggaagaacgagcgcggcaagagccugcuguucaagaccgcguccgggaucaacaugugcacccucaucgccauggaccugggcgagaugugcgacgacaccgucacguacaagugcccccugaucaccgagguggagcccgaggacaucgacugcuggugcaaccucaccagcaccugggugacguacgggaccugcaaccaggccggcgagcaccggcgcgacaagcgguccgucgcccuggccccccacgugggcauggggcuggacacccgcgcgcagaccuggaugagcgccgagggcgccuggcggcagguggagaaggucgagacgugggccuuccgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacgugaccaccgacagccgcugccccacgcagggcgaggccauccugccggaggagcaggaccagaacuacgucugcaagcacaccuacguggaccggggguggggcaacgggugcggccucuucgggaagggcucccuggugaccugcgccaaguuccagugccuggagcucaucgagggcaaggucgugcagcacgagaaccugaaguacaccgugaucaucacgguccacaccggggaccagcaccaggugggcaacgagacccagggggucaccgccgagaucacgccccaggccagcaccguggaggcgauccugcccgaguacggcacccucgggcuggagugcuccccccgcaccggccuggacuucaacgagaugauccuccugaccaugaagaacaaggccuggauggugcaccggcagugguucuucgaccugccgcuccccuggacgagcggcgccaccaccgagacccccacguggaacaagaaggagcugcuggucaccuucaagaacgcccacgccaagaagcaggagguggugguccucgggucccaggagggcgcgaugcacaccgcccugaccggggccacggagauccagaccagcggcgggaccuccaucuucgccggccaccugaagugccgccucaagauggacaagcuggagcugaagggcaugagcuacgccaugugcuccaacgcguucgugcucaagaaggaggugagcgagacccagcacgggacgauccugaucaaggucgaguacaagggcgaggacgcccccugcaagaucccguucagcaccgaggacgggcagggcaaggcccacaacggccggcugaucaccgccaaccccguggugaccaagaaggaggagcccgucaacaucgaggcggagcccccguucggggaguccaacaucaucaucggcaucggggacaaggcccugaagaucaacugguacaagaagggcagcuccaucgggaagauguucgaggccacggcccgcggcgcccggcgcauggcgauccucggcgacaccgccugggacuucgggagcgugggcggggugcugaacucccugggcaagaugguccaccagaucuucgggagcgccuacaccgcccucuucuccggcgugagcuggaucaugaagaucggcaucggggugcugcugaccuggaucggccucaacuccaagaacacgagcauguccuucagcugcaucgucaucgggaucaucacccuguaccugggcgccguggugcaggcggacauggggugcgucaucaacuggaagggcaaggagcucaagugcggcuccgggaucuucgugaccaacgaggugcacaccuggacggagcaguacaaguuccaggccgacagccccaagcggcuggccaccgccaucgccggcgcgugggagaacggggucugcggcauccgcuccaccacccgcauggagaaccugcucuggaagcagaucgccaacgagcugaacuacauccugugggagaacaacaucaagcucacggugguggucggggacaucaucggcgugcuggagcagggcaagcggacccugaccccccagcccauggagcucaaguacagcuggaagaccugggggaaggccaagaucgugacggccgagaagcagaacuccagcuucaucaucgacggcccgaacacccccgagugccccaacgcgucccgcgccuggaacgucugggagguggaggacuacggguucggcguguucaccaccaacaucuggcugaagcugcgggagauguacacgcagcucugcgaccaccgccugaugagcgccgccgucaaggacgagcgggccgugcacgcggacaugggcuacuggaucgagagccagaagaacggguccuggaagcuggagaaggccagccucaucgaggugaagaccugcaccuggcccaagucccacacccuguggagcaacggcguccuggaguccgacaugaucaucccgaagagccucgccgggcccaucucccagcacaacuaccgccccggcuaccacacccagacggccgggccguggcaccugggcaagcuggagcucgacuucaacuacugcgagggcaccaccguggugaucaccgagaacugcgggacgcggggccccagccugcgcaccaccaccgucuccgggaagcugauccacgaguggugcugccggagcugcacgcuccccccccugcgcuacaugggcgaggacgggugcugguacggcauggagauccggccgaucaacgagaaggaggagaacauggugaagucccuggugagcgccggcuccgggaaggucgacaacuucaccaugggcgugcucugccuggcgauccuguucgaggaggugaugcgcgggaaguucggcaagaagcacaugaucgccgggguccucuucaccuucgugcugcugcucagcggccagaucaccuggcgggacauggcccgcacgcugaucaugaucggcuccaacgccagcgaccggauggggaugggcgugaccuaccuggcccucaucgcgaccuucaagauccagcccuuccuggcccugggguucuuccuccgcaagcugaccucccgggagaaccugcuccugggcgucggccuggccauggccacgacccuccagcugcccgaggacaucgagcagauggcgaacgggaucgcccugggccucauggcccugaagcugaucacccaguucgagaccuaccagcucuggacggcccuggugagccugaugugcagcaacaccaucuucacccucaccguggccuggcgcacggcgacccugauccuggccgggaucucccucaugcccgucugccagagcuccagcaugcggaagaccgacuggcugccgaugaccguggccgccaugggcguccccccccugccccucuucaucuucucccugaaggacacgcugaagcgccgcagcuggccgcucaacgagggggugauggccgugggccuggucuccauccuggcgagcucccuccugcggaacgacgugcccauggccggcccccugguggccgggggccuccugaucgccugcuacgucaucaccgggaccagcgccgaccugaccguggagaaggcggccgacgugacgugggaggaggaggccgagcagaccggcgucucccacaaccucaugaucaccguggacgacgacgggaccaugcgcaucaaggacgacgagacggagaacauccugaccgugcugcucaagaccgcccugcugaucgucagcggcaucuuccccuacuccaucccggccacccuccugguguggcacaccuggcagaagcagacgcagcggagcggcgugcugugggacguccccuccccccccgagacccagaaggcggagcucgaggaggggguguaccgcaucaagcagcagggcaucuucgggaagacccaggugggcgucggggugcagaaggagggcguguuccacaccauguggcacgucacgcggggcgccgugcugaccuacaacgggaagcgccuggagccgaacugggccagcgugaagaaggaccucaucuccuacggcgggggcuggcggcugagcgccuacuggcagaagggggaggagguccaggugaucgcgguggagcccggcaagaaccccaagaacuuccagaccaugcccggcaucuuccagaccacgaccggggagaucggcgccaucgcccuggacuucaagccggggaccuccggcagccccaucaucaaccgcgagggcaaggucguggggcuguacggcaacgggguggucaccaagaacggcggguacgugagcggcaucgcccagacgaacgccgagcccgacggcccgacccccgagcucgaggaggagauguucaagaagcggaaccugaccaucauggaccugcaccccggguccggcaagacccgcaaguaccuccccgcgaucgugcgggaggccaucaagcgccggcugcgcacgcugauccucgccccgacccgggucguggccgccgagauggaggaggcgcugaaggggcugcccgugcgcuaccagaccaccgccacgaagagcgagcacaccggcaaggagaucgucgaccucaugugccacgccaccuucaccaugcggcugcugucccccgugcgcgugcccaacuacaaccucaucaucauggacgaggcccacuucacggacccggccagcaucgcggcccggggguacaucuccacccgcgucggcaugggcgaggccgccgcgaucuucaugaccgccaccccccccgggacggccgacgccuucccccagagcaacgccccgauccaggacgaggagcgggacauccccgagcgcuccuggaacagcggcaacgacuggaucaccgacuucgcggggaagaccgugugguucgugcccuccaucaaggccggcaacgacaucgccaacugccugcgcaagaacgggaagaaggucauccagcugagccggaagaccuucgacacggaguaccagaagaccaagcucaacgacugggacuucguggugaccaccgacaucuccgagaugggcgccaacuucaaggccgaccgcgucaucgacccccggcgcugccugaagccggugauccugacggacggccccgagcgggugauccucgcggggcccaugcccgucaccguggccagcgccgcccagcgccggggccgcguggggcggaacccgcagaaggagaacgaccaguacaucuucaccggccagccccugaacaacgacgaggaccacgcccacuggaccgaggcgaagaugcugcucgacaacaucaacacgcccgaggggaucauccccgcccuguucgagccggagcgcgagaaguccgccgccaucgacggcgaguaccggcccaagggcgagagccgcaagaccuucgucgagcugaugcggcgcggggaccuccccguguggcuggcgcacaaggucgccuccgagggcaucaaguacaccgaccggaaguggugcuucgacggggagcgcaacaaccagauccuggaggagaacauggacguggagaucuggaccaaggagggcgagaagaagaagcuccggccccgcuggcuggacgcccggaccuacagcgacccgcuggcccucaaggaguucaaggacuucgccgcgggccgcaaguccaucgcccuggaccuggugacggagaucgggcgcguccccagccaccucgcccaccggacccgcaacgcccuggacaaccuggugaugcuccacaccuccgagcacggcgggcgggccuaccgccacgcgguggaggagcugcccgagaccauggagacgcugcuccugcugggccucaugauccugcugaccgggggcgccaugcucuuccugaucagcggcaagggggucggcaagaccagcaucgggcugaucugcgugguggccuccagcggcaugcucuggauggccgacaucccgcugcaguggaucgccuccgcgaucguccuggaguucuucaugauggugcuccugauccccgagcccgagaagcagcggaccccccaggacaaccagcuggccuacguggucaucgggauccucacgcuggccgccaucguggccgcgaacgagaugggccugcucgagaccaccaagcgcgaccugggcaugagcaaggagccggggguggucucccccaccagcuaccuggacguggaccuccaccccgccuccgccuggacgcuguacgccguggcgaccaccgucaucacccccaugcugcggcacacgaucgagaacagcaccgccaacgugucccucgccgccaucgccaaccaggcggugguccugaugggccuggacaagggguggccgaucagcaagauggaccucggcgugccccugcuggcccucgggugcuacucccaggugaacccccugacccugaccgccgccguccuccugcuggugacgcacuacgccaucaucggccccggccuccaggcgaaggccacccgcgaggcccagaagcggaccgccgccgggaucaugaagaacccgaccguggacggcaucaugacgaucgaccuggaccccgucaucuacgacagcaaguucgagaagcagcuggggcaggugaugcuccuggugcugugcgcgguccagcuccugcugaugcgcaccuccugggccuucugcgaggcccucacccuggccaccggccccaucacgacccugugggagggcagccccgggaaguucuggaacaccaccaucgcgguguccauggccaacaucuuccggggcagcuaccucgccggggccggccuggccuucuccaucaugaagagcguggggacgggcaagcgcggcaccgggucccagggcgagacccugggggagaaguggaagaagaagcucaaccagcugagccggaaggaguucgaccuguacaagaagagcggcaucaccgaggucgaccgcacggaggcgaaggaggggcucaagcggggcgagaucacccaccacgccgugucccgcggcagcgccaagcugcagugguucguggagcggaacauggucaucccggaggggcgcgugaucgaccugggcugcgggcggggcgggugguccuacuacugcgccggccucaagaaggugaccgagguccgcggcuacaccaaggggggccccgggcacgaggagcccgugcccaugagcaccuacggcuggaacaucgugaagcugauguccgggaaggacgucuucuaccugccgcccgagaagugcgacacgcuccugugcgacaucggcgagagcucccccagccccaccguggaggagucccggaccauccgcgugcugaagauggucgagccguggcugaagaacaaccaguucugcaucaaggugcucaaccccuacaugcccaccgugaucgagcaccuggagcgccugcagcggaagcacggcgggaugcucguccgcaacccccugagccggaacuccacgcacgagauguacuggaucagcaacggcaccgggaacaucguguccagcgugaacauggucucccgccugcuccugaaccgguucaccaugaccuaccgccggccgacgaucgagaaggacguggaccugggcgccggcacccgccacgucaacgcggagcccgagacccccaacauggacgugaucggggagcggauccgccggaucaaggaggagcacagcuccaccuggcacuacgacgacgagaacccguacaagacgugggccuaccacggcagcuacgaggugaaggccaccggguccgccagcagcaugaucaacggcgucgugaagcuccugaccaagcccugggacgugguccccaccgugacgcagauggccaugaccgacaccacccccuucgggcagcagcgcguguucaaggagaaggucgacacgcggaccccgaagcccaugcccggcacccgcaaggugauggagaucaccgcggaguggcuguggcggacgcucggccgcaacaagcggccccgccugugcacccgggaggaguucaccaagaaggugcgcaccaacgccgccaugggggccgucuucacggaggagaaccagugggacuccgcgcgcgccgccguggaggacgaggaguucuggaagcugguggaccgggagcgcgagcuccacaagcugggcaagugcgggagcugcgucuacaacaugaugggcaagcgggagaagaagcugggggaguucggcaaggccaagggcucccgcgccaucugguacauguggcucggggcgcgguaccuggaguucgaggcccugggcuuccucaacgaggaccacugguucagccgcgagaacuccuacagcgggguggagggcgaggggcugcacaagcugggcuacauccuccgggacaucuccaagaucccgggcggggccauguacgccgacgacaccgccggcugggacacccgcaucaccgaggacgaccugcacaacgaggagaagaucacgcagcagauggagcccgagcaccggcagcuggcgaacgccaucuucaagcucaccuaccagaacaagguggucaaggugcagcgccccacccccaaggggaccgugauggacaucaucagccggaaggaccagcgcggcuccggccaggucgggacguacggccugaacaccuucaccaacauggaggcccagcugauccggcagauggagggggaggacgugcucagcaagaccgaccuggagaacccgcaccugcucgagaagaagaucacccaguggcuggagacgaagggcguggagcgccugaagcggauggccaucuccggggacgacugcgucgugaagcccaucgacgaccgcuucgccaacgcgcuccuggcccugaacgacaugggcaaggugcggaaggacaucccccaguggcagcccagcaagggcuggcacgacuggcagcaggucccguucugcucccaccacuuccacgagcucaucaugaaggacgggcgcaagcugguggugcccugccggccccaggacgagcugaucggccgcgcccggaucagccagggggccggcuggucccucaaggagaccgccugccuggggaaggcguacgcccagaugugggcccugauguacuuccaccgccgcgaccuccggcuggccagcaacgcgaucugcuccgccguccccgugcacugggugccgaccagccgcaccacgugguccauccacgcccaccaccaguggaugaccaccgaggacaugcugaccgucuggaaccggguguggaucgaggacaaccccuggauggaggacaagacgcccgugaccaccugggaggacguccccuaccucggcaagcgcgaggaccaguggugcggcagccugaucgggcugaccagccgggccacgugggcccagaacauccucaccgcgauccagcaggugcgcucccugaucggcaacgaggaguuccuggacuacaugccgagcaugaagcgguuccgcaaggaggaggaguccgagggggccaucugguga

SEQ ID NO: 10386 - RNA, 9873 nt, Artificial Sequence
  derived and/or modified CDS sequence (opt1) from DENV-3__AY858041__SS-prME
accagccugugccucaugaugaugcugcccgccacccuggccuuccaccucacgucccgcgacggcgagccgcggaugaucguggggaagaacgagcgcggcaagagccugcuguucaagaccgcguccgggaucaacaugugcacccucaucgccauggaccugggcgagaugugcgacgacaccgucacguacaagugcccccugaucaccgagguggagcccgaggacaucgacugcuggugcaaccucaccagcaccugggugacguacgggaccugcaaccaggccggcgagcaccggcgcgacaagcgguccgucgcccuggccccccacgugggcauggggcuggacacccgcgcgcagaccuggaugagcgccgagggcgccuggcggcagguggagaaggucgagacgugggccuuccgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacgugaccaccgacagccgcugccccacgcagggcgaggccauccugccggaggagcaggaccagaacuacgucugcaagcacaccuacguggaccggggguggggcaacgggugcggccucuucgggaagggcucccuggugaccugcgccaaguuccagugccuggagcucaucgagggcaaggucgugcagcacgagaaccugaaguacaccgugaucaucacgguccacaccggggaccagcaccaggugggcaacgagacccagggggucaccgccgagaucacgccccaggccagcaccguggaggcgauccugcccgaguacggcacccucgggcuggagugcuccccccgcaccggccuggacuucaacgagaugauccuccugaccaugaagaacaaggccuggauggugcaccggcagugguucuucgaccugccgcuccccuggacgagcggcgccaccaccgagacccccacguggaacaagaaggagcugcuggucaccuucaagaacgcccacgccaagaagcaggagguggugguccucgggucccaggagggcgcgaugcacaccgcccugaccggggccacggagauccagaccagcggcgggaccuccaucuucgccggccaccugaagugccgccucaagauggacaagcuggagcugaagggcaugagcuacgccaugugcuccaacgcguucgugcucaagaaggaggugagcgagacccagcacgggacgauccugaucaaggucgaguacaagggcgaggacgcccccugcaagaucccguucagcaccgaggacgggcagggccaggcccacaacggccggcugaucaccgccaaccccguggugaccaagaaggaggagcccgucaacaucgaggcggagucccccuucggggagagcaacaucaucaucggcaucggggacaaggcccugaagaucaacugguacaagaagggcuccagcaucgggaagauguucgaggccacggcccgcggcgcccggcgcauggcgauccucggcgacaccgccugggacuucggguccgugggcggggugcugaacagccugggcaagaugguccaccagaucuucggguccgccuacaccgcccucuucagcggcguguccuggaucaugaagaucggcaucggggugcugcugaccuggaucggccucaacagcaagaacacguccaugagcuucuccugcaucgucaucgggaucaucacccuguaccugggcgccguggugcaggcggacauggggugcgucaucaacuggaagggcaaggagcucaagugcggcagcgggaucuucgugaccaacgaggugcacaccuggacggagcaguacaaguuccaggccgacuccccgaagcggcuggccaccgccaucgccggcgcgugggagaacggggucugcggcauccgcagcaccacccgcauggagaaccugcucuggaagcagaucgccaacgagcugaacuacauccugugggagaacaacaucaagcucacggugguggucggggacaucaucggcgugcuggagcagggcaagcggacccugaccccccagcccauggagcucaaguacuccuggaagaccugggggaaggccaagaucgugacggccgagauccagaacagcuccuucaucaucgacggccccaacaccccggagugccccaacgcgagccgcgccuggaacgucugggagguggaggacuacggguucggcguguucaccaccaacaucuggcugaagcugcgggagauguacacgcagcucugcgaccaccgccugaugagcgccgccgucaaggacgagcgggccgugcacgcggacaugggcuacuggaucgagucccagaagaacgggagcuggaagcuggagaaggccucccucaucgaggugaagaccugcaccuggcccaagagccacacccugugguccaacggcguccuggagagcgacaugaucauccccaagucccucgccgggccgaucagccagcacaacuaccgccccggcuaccacacccagacggccgggcccuggcaccugggcaagcuggagcucgacuucaacuacugcgagggcaccaccguggugaucaccgagaacugcgggacgcggggcccgucccugcgcaccaccaccgucagcgggaagcugauccacgaguggugcugccgguccugcacgcuccccccccugcgcuacaugggcgacgacgggugcugguacggcauggagauccggcccaucaacgagaaggaggagaacauggugaagagccugguguccgccggcagcgggaaggucgacaacuucaccaugggcgugcucugccuggcgauccuguucgaggaggugaugcgcgggaaguucggcaagaagcacaugaucgccgggguccucuucauguucgugcugcugcucuccggccagaucaccuggcgggacauggcccgcacccugaucaugaucggcagcaacgccuccgaccggauggggaugggcgugacguaccuggcccucaucgcgaccuucaagauccagccguuccuggcccugggguucuuccuccgcaagcugaccagccgggagaaccugcuccugggcgucggccuggccauggccaccacgcuccagcugcccgaggacaucgagcagauggcgaacgggaucgcccugggccucauggcccugaagcugaucacccaguucgagaccuaccagcucuggaccgcccuggugagccugacgugcuccaacaccaucuucacccucaccguggccuggcgcacggcgacccugauccuggccgggaucagccuccugcccgucugccaguccagcuccaugcggaagaccgacuggcugcccaugaccguggccgccaugggcgucccgccccucccccuguucaucuucagccugaaggacacgcucaagcgccgcuccuggccccugaacgagggggugauggccgugggccuggucagcauccucgcguccagccugcugcggaacgacgugccgauggccggcccccucguggccgggggccugcugaucgccugcuacgucaucaccgggaccuccgccgaccucaccguggagaaggcggccgacgugacgugggaggaggaggccgagcagaccggcgucagccacaaccugaugaucaccguggacgacgacgggaccaugcgcaucaaggacgacgagacggagaacauccugaccgugcuccugaagaccgcccugcucaucgucuccggcaucuuccccuacagcauccccgccacccugcugguguggcacaccuggcagaagcagacgcagcgguccggcgugcucugggacgucccgagcccccccgagacccagaaggcggagcuggaggaggggguguaccgcaucaagcagcagggcaucuucgggaagacccaggugggcgucggggugcagaaggagggcguguuccacaccauguggcacgucacgcggggcgccgugcugaccuacaacgggaagcgccucgagcccaacugggccuccgugaagaaggaccugaucagcuacggcgggggcuggcggcuguccgcccaguggaagaagggggaggagguccaggugaucgcgguggagccgggcaagaaccccaagaacuuccagaccaugcccggcaucuuccagaccacgaccggggagaucggcgccaucgcccuggacuucaagcccgggaccagcggcagcccgaucaucaaccgcgagggcaaggucguggggcucuacggcaacgggguggucaccaagaacggcggguacguguccggcaucgcccagacgaacgccgagcccgacggccccaccccggagcuggaggaggagauguucaagaagcggaaccugaccaucauggaccuccaccccgggagcggcaagacccgcaaguaccugcccgcgaucgugcgggaggccaucaagcgccggcugcgcacgcucauccuggcccccacccgggucguggccgccgagauggaggaggcgcugaaggggcucccgauccgcuaccagaccaccgccacgaaguccgagcacaccggcaaggagaucguggaccugaugugccacgccaccuucaccaugcggcugcucagccccguccgcgugcccaacuacaaccugaucaucauggacgaggcccacuucacggaccccgccuccaucgcggcccggggguacaucagcacccgcgugggcaugggcgaggccgccgcgaucuucaugaccgccaccccgcccgggacggccgacgccuucccccaguccaacgcccccauccaggacgaggagcgggacaucccggagcgcagcuggaacuccggcaacgacuggaucaccgacuucgcggggaagaccgucugguucgugcccagcaucaaggccggcaacgacaucgccaacugccugcgcaagaacgggaagaaggugauccagcucucccggaagaccuucgacacggaguaccagaagaccaagcugaacgacugggacuucgucgugaccaccgacaucagcgagaugggcgccaacuucaaggccgaccgcgugaucgacccccggcgcugccugaagcccgucauccucacggacggcccggagcgggugauccuggcggggcccaugcccgugaccgucgccuccgccgcccagcgccggggccgcguggggcggaacccccagaaggagaacgaccaguacaucuucaccggccagccgcugaacaacgacgaggaccacgcccacuggaccgaggcgaagaugcuccuggacaacaucaacacgcccgaggggaucauccccgcccuguucgagcccgagcgcgagaagagcgccgccaucgacggcgaguaccggcucaagggcgagucccgcaagaccuucguggagcugaugcggcgcggggaccugccggucuggcucgcgcacaagguggccagcgagggcaucaaguacaccgaccggaaguggugcuucgacggggagcgcaacaaccagauccuggaggagaacauggacgucgagaucuggaccaaggagggcgagaagaagaagcugcggccccgcuggcucgacgcccggaccuacuccgacccccuggcccugaaggaguucaaggacuucgccgcgggccgcaagagcaucgcccucgaccuggugacggagaucgggcgcgugcccucccaccuggcccaccggacccgcaacgcccucgacaaccuggucaugcugcacaccagcgagcacggcgggcgggccuaccgccacgcgguggaggagcucccggagaccauggagacgcugcugcuccugggccugaugauccuccugaccgggggcgccaugcuguuccucaucagcggcaagggggugggcaagaccuccaucgggcugaucugcgucguggccagcuccggcaugcuguggauggccgacaucccccuccaguggaucgccagcgcgaucgugcuggaguucuucaugaugguccugcucauccccgagccggagaagcagcggaccccccaggacaaccagcuggccuacguggugaucgggauccugacgcucgccgccaucgucgccgcgaacgagaugggccugcuggagaccaccaagcgcgaccucggcauguccaaggagcccgggguggugagcuccaccagcuaccuggacgucgaccugcaccccgccuccgccuggacgcucuacgccguggcgaccaccgugaucaccccgaugcugcggcacacgaucgagaacagcaccgccaacgucucccuggccgccaucgccaaccaggcgguggugcucaugggccuggacaagggguggcccaucagcaagauggaccugggcgucccccuccuggcccuggggugcuacucccaggugaacccccucacccugaccgccgccgugcugcuccuggucacgcacuacgccaucaucggcccgggccugcaggcgaaggccacccgcgaggcccagaagcggaccgccgccgggaucaugaagaaccccaccguggacggcaucaugacgaucgaccucgaccccgugaucuacgacagcaaguucgagaagcagcuggggcaggucaugcugcucgugcugugcgcggugcagcugcuccugaugcgcaccuccugggccuucugcgaggcccugacccucgccaccggccccaucacgacccugugggagggcagcccggggaaguucuggaacaccaccaucgcggucuccauggccaacaucuuccggggcagcuaccuggccggggccggccucgccuucuccaucaugaagagcguggggacgggcaagcgcggcaccgggagccagggcgagacccugggggagaaguggaagaagaagcugaaccagcucucccggaaggaguucgaccuguacaagaagagcggcaucaccgagguggaccgcacggaggcgaaggaggggcugaagcggggcgagaucacccaccacgccgucucccgcggcagcgccaagcuccagugguucguggagcggaacauggugauccccgaggggcgcgucaucgaccugggcugcgggcggggcgggugguccuacuacugcgccggccugaagaaggugaccgaggugcgcggcuacaccaaggggggccccgggcacgaggagcccgucccgaugagcaccuacggcuggaacaucgugaagcucauguccgggaaggacguguucuaccugccccccgagaagugcgacacgcugcugugcgacaucggcgagagcucccccagcccgaccgucgaggagucccggaccauccgcgugcucaagaugguggagcccuggcugaagaacaaccaguucugcaucaagguccugaaccccuacaugcccaccgugaucgagcaccucgagcgccugcagcggaagcacggcgggaugcuggugcgcaacccgcucagccggaacuccacgcacgagauguacuggaucagcaacggcaccgggaacaucgucuccagcgugaacauggugucccgccugcugcucaaccgguucaccaugaccuaccgccggcccacgaucgagaaggacgucgaccugggcgccggcacccgccacgugaacgcggagcccgagacccccaacauggacgucaucggggagcggauccgccggaucaaggaggagcacagcuccaccuggcacuacgacgacgagaacccguacaagacgugggccuaccacggcagcuacgaggugaaggccaccgggagcgccuccagcaugaucaacggcguggucaagcugcucaccaagcccugggacguggugcccaccgucacgcagauggccaugaccgacaccaccccguucgggcagcagcgcguguucaaggagaagguggacacgcggacccccaagcccaugcccggcacccgcaaggucauggagaucaccgcggaguggcuguggcggacgcugggccgcaacaagcggccgcgccucugcacccgggaggaguucaccaagaaggugcgcaccaacgccgccaugggggccguguucacggaggagaaccagugggacuccgcgcgcgccgccgucgaggacgaggaguucuggaagcugguggaccgggagcgcgagcugcacaagcagggcaagugcgggagcugcguguacaacaugaugggcaagcgggagaagaagcucggggaguucggcaaggccaagggcucccgcgccaucugguacauguggcugggggcgcgguaccuggaguucgaggcccucggcuuccugaacgaggaccacugguucagccgcgagaacuccuacagcggggucgagggcgaggggcugcacaagcucggcuacauccugcgggacaucuccaagauccccggcggggccauguacgccgacgacaccgccggcugggacacccgcaucaccgaggacgaccugcacaacgaggagaagaucacgcagcagauggaccccgagcaccggcagcucgcgaacgccaucuucaagcugaccuaccagaacaagguggugaagguccagcgccccaccccgaaggggaccgugauggacaucaucagccggaaggaccagcgcggcuccggccagguggggacguacggccugaacaccuucaccaacauggaggcccagcucauccggcagauggagggggagggcguccugagcaagaccgaccuggagaacccccaccuccuggagaagaagaucacccaguggcuggagacgaaggggguggagcgccucaagcggauggccaucuccggcgacgacugcguggucaagcccaucgacgaccgcuucgccaacgcgcugcuggcccucaacgacaugggcaaggugcggaaggacaucccccaguggcagccgagcaagggguggcacgacuggcagcaggugcccuucugcucccaccacuuccacgagcugaucaugaaggacggccgcaagcuggucgugcccugccggccccaggacgagcucaucgggcgcgcccggaucagccagggcgccggguggucccugaaggagaccgccugccugggcaaggcguacgcccagaugugggcccucauguacuuccaccgccgcgaccugcggcuggccagcaacgcgaucugcuccgccgugccgguccacugggugcccaccagccgcaccacguggagcauccacgcccaccaccaguggaugaccaccgaggacaugcucaccguguggaaccgggucuggaucgaggacaaccccuggauggaggacaagacgcccgugaccaccugggaggacgugccguaccugggcaagcgcgaggaccaguggugcgggucccugaucggccucaccagccgggccacgugggcccagaacauccugaccgcgauccagcagguccgcucccugaucgggaacgaggaguuccucgacuacaugcccagcaugaagcgguuccgcaaggaggaggaguccgagggcgccaucugguga

SEQ ID NO: 10387 - RNA, 9873 nt, Artificial Sequence
  derived and/or modified CDS sequence (opt1) from DENV-3__KC261634__SS-prME
accagcaucugccugaugaugaugcuccccgccacccuggccuuccaccugacgagccgggacggcgagccgcggaugaucguggggaagaacgagcggggcaagagccuccuguucaagaccgcgagcgggaucaacaugugcacccugaucgccauggaccucggcgagaugugcgacgacaccgugaccuacaagugcccccugaucgccgagguggagcccgaggacaucgacugcuggugcaaccugaccagcaccugggugaccuacgggacgugcaaccaggccggcgagcaccggcgcgacaagcggagcgucgcccucgcgccccacgugggcauggggcuggacacccgcacccagaccuggaugagcgccgagggcgccuggcggcaggucgagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaaccggcccacccucgacaucgagcugcagaagaccgaggccacccagcuggcgacgcuccgcaagcugugcaucgagggcaagaucaccaacaucaccaccgacagccggugccccacgcagggcgaggccgugcugccggaggagcaggaccagaacuacgucugcaagcacaccuacguggaccgcggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgacacccagggggucaccguggagaucacgccccaggccagcaccguggaggccguccugcccgaguacggcacccuggggcucgagugcuccccgcggaccggccuggacuucaacgagaugauccugcucaccaugaagaacaaggcguggauggugcaccgccagugguucuucgaccugccccugcccuggacgagcggcgccaccaccgagacccccacguggaaccggaaggagcuccuggugaccuucaagaacgcccacgccaagaagcaggaggucguggugcuggggucccaggagggcgccaugcacaccgcgcucaccggggccacggagauccagaacagcggcgggaccuccaucuucgccggccaccugaagugccgccugaagauggacaagcucgagcugaagggcaugagcuacgccaugugccugaacaccuucguccucaagaaggagguguccgagacccagcacgggacgauccugauccggguggaguacaagggcgaggacgccccgugcaagauccccuucagcaccgaggacgggcagggcaaggcgcacaacggccgccugaucaccgccaaccccgucgugaccaagaaggaggagcccgugaacaucgaggccgagccgcccuucggggagagcaacaucgucaucggcacgggggacaaggcccugaagaucaacugguacaagaagggcuccagcaucgggaagauguucgaggcgaccgcccggggcgcccgccgcauggccauccucggcgacaccgccugggacuucggguccgugggcggggugcugaacagccugggcaagauggcgcaccagaucuucggguccgccuacaccgcccucuucagcggcgucuccuggaucaugaagaucggcaucggggugcugcugacguggaucggccucaacagcaagaacaccuccaugagcuucuccugcaucgugaucgggaucaucacccuguaccugggcgccgucgugcaggccgacauggggugcgugaucaacuggaagggcaaggagcucaagugcggcagcgggaucuucgucaccaacgaggugcacacguggaccgagcaguacaaguuccaggcggacucccccaagcggcuggccaccgccaucgccggcgccugggagaacggggugugcggcauccgcagcaccacgcggauggagaaccugcucuggaagcagaucgcgaacgagcugaacuacauccugugggagaacaacaucaagcucaccgucguggugggggacaucaucggcguccuggagcagggcaagcgcacccugacgccccagccgauggagcucaaguacuccuggaagacgugggggaaggccaagaucgugaccgccgagauccagaacagcuccuucaucaucgacggccccaacacccccgagugccccagcgccucccgggcguggaacgugugggaggucgaggacuacggguucggcguguucaccacgaacaucuggcugaagcugcgcgagguguacacccagagcugcgaccaccggcucaugagcgccgccaucaaggacgagcgcgccguccacgccgacaugggcuacuggaucgagucccagaagaacgggagcuggaagcuggagaaggcguccuucaucgaggugaagaccugcaccuggcccaagagccacacccugugguccaacggcgugcucgagagcgacaugaucaucccgaagucccuggccgggcccaucagccagcacaaccaccggccgggcuaccacacgcagaccgccgggcccuggcaccugggcaagcucgagcuggacuucaacuacugcgagggcaccaccgucgugaucacggagaacugcgggacccgcggccccucccugcggaccaccacggugagcgggaagcucauccacgaguggugcugccgcuccugcacccugcccccgcugcgguacaugggcgaggacgggugcugguacggcauggagauccgccccaucaacgagaaggaggagaacauggucaagagccucguguccgccggcagcgggaagguggacaacuucaccaugggcguccugugccuggccauccucuucgaggaggugaugcgggggaaguucggcaagaagcacaugaucguggggguccuguucaccuucgugcugcuccuguccggccagaucacguggcgcgacaugacccacacccugaucaugaucggcagcaacgcguccgaccggauggggaugggcgugaccuaccucgcccugaucgccacguucaagauccagcccuuccuggcccucggguucuuccugcgcaagcugaccagccgggagaaccuccugcugggcgucggccucgccauggcgaccacccugcagcugcccgaggacaucgagcagauggccaacgggaucgcccucggccugaugacgcugaagcucaucacccaguucgagaccuaccagcuguggaccgcccuggugagccucacgugcuccaacaccaucuucacccugaccgucgcguggcgcacggccacccugauccucgccggggugagccugcugccgcucugccaguccagcuccaugcgcaagaccgacuggcugcccaugaccguggccgccaugggcgugccgccccucccccucuucaucuucagccugaaggacgcgcccaagaagcgguccuggccccugaacgagggggugauggccgugggccucgucagcauccuggccuccagccugcuccgcaacgacgugcccauggccggcccgcugguggccgggggccugcucaucgcgugcuacgucaucacggggaccuccgccgaccugaccguggagaaggccgccgacgugaccugggaggaggaggccgagcagacgggcgucagccacaaccugaugaucaccguggacgacgacgggaccaugcggaucaaggacgacgagaccgagaacauccucaccgugcugcugaagacggcgcuccugaucgucuccggcaucuuccccuacagcauccccgccacccugcucguguggcacaccuggcagaagcagacccagcgcuccggcgugcugugggacguccccagcccgcccgagacgcagaaggccgagcuggaggaggggguguaccggaucaagcagcagggcaucuucgggaagacccaggugggcgucggggugcagaaggagggcguguuccacaccauguggcacgucacccgcggcgccgugcucacgcacaacgggaagcggcuggagcccaacugggccuccgugaagaaggaccugaucagcuacggcgggggcuggcgccucuccgcgcaguggcagaagggggaggagguccaggugaucgccguggagcccggcaagaacccgaagaacuuccagaccaugcccggcaucuuccagaccaccacgggggagaucggcgccaucgcccuggacuucaagcccgggaccagcggcagcccgaucaucaaccgggagggcaaggucguggggcuguacggcaacgggguggucaccaagaacggcggguacguguccggcaucgcgcagaccaacgccgagcccgacggccccacgcccgagcuggaggaggagauguucaagaagcgcaaccucaccaucauggaccugcacccggggagcggcaagacccggaaguaccugcccgccaucgugcgcgaggccaucaagcggcgccuccggacccugauccuggcccccacgcgcgucguggcggccgagauggaggaggcccucaaggggcugcccauccgguaccagaccaccgccaccaaguccgagcacacgggccgcgagaucguggaccugaugugccacgccaccuucaccaugcggcuccugagcccgguccgcgugcccaacuacaaccugaucaucauggacgaggcgcacuucaccgaccccgccuccaucgccgcccggggguacaucagcacgcgcgugggcaugggcgaggccgcggccaucuucaugaccgccacgcccccggggaccgccgaggcguucccccaguccaacgcccccauccaggacgaggagcgcgacauccccgagcggagcuggaacuccggcaacgaguggaucacggacuucgucgggaagaccgugugguucgugccgagcaucaaggccggcaacgacaucgccaacugccuccgcaagaacgggaagaaggucauccagcugucccggaagaccuucgacaccgaguaccagaagacgcgccugaacgacugggacuucguggugaccaccgacaucagcgagaugggcgccaacuucaaggcggaccgggucaucgacccccgccggugccucaagcccgugauccugaccgacggccccgagcgcgugauccuggccgggccgaugcccgucacggccgccuccgccgcgcagcggcgcggccggguggggcgcaacccccagaaggagaacgaccaguacaucuucaccggccagccccucaacaacgacgaggaccacgcccacuggaccgaggccaagaugcugcuggacaacaucaacaccccggaggggaucauccccgcccucuucgagcccgagcgggagaaguccgccgcgaucgacggcgaguaccgccugaagggcgagucccggaagaccuucgucgagcugaugcgccgcggggaccuccccguguggcuggcccacaagguggccagcgagggcaucaaguacacggaccgcaaguggugcuucgacggggagcggaacaaccagauccuggaggagaacauggacgucgagaucuggaccaaggagggcgagcgcaagaagcuccgcccgcgguggcuggacgcccgcaccuacuccgacccccuggcgcucaaggaguucaaggacuucgccgccggccgcaagagcaucgcccuggaccuggugaccgagaucgggcgcgugcccucccaccucgcccaccggacgcgcaacgcgcuggacaaccuggucaugcuccacaccagcgagcacggcgggcgggccuaccgccacgccguggaggagcugccggagaccauggagacccugcuccugcugggccucaugauccugcugaccggcggggccaugcuguuccugaucagcgggaaggggaucggcaagaccuccaucgggcugaucugcgugaucgucagcuccggcaugcucuggauggccgacgugccccugcaguggaucgcgagcgccaucgugcuggaguucuucaugaugguccuccugauccccgagcccgagaagcagcggaccccgcaggacaaccagcuggccuacguggugaucgggauccucacccuggccgccaucgucgcggccaacgagaugggccugcucgagacgaccaagcgcgaccugggcauguccaaggagcccggggccgugagcuccaccagcuaccuggacguggaccuccaccccgccuccgccuggacccuguacgcggucgccacgaccgugaucacccccaugcugcggcacaccaucgagaacagcacggccaacgugucccucgccgcgaucgccaaccaggccgucgugcugaugggccuggacaagggguggccgaucagcaagauggaccucggcgugccccugcuggcccucgggugcuacucccaggucaacccccugacccugaccgccgcggugcuccugcuggugacccacuacgccaucaucggccccggccuccaggccaaggccacgcgcgaggcccagaagcggaccgcggccgggaucaugaagaacccgaccgucgacggcaucaugaccaucgaccuggaccccgugaucuacgacagcaaguucgagaagcagcugggccaggugaugcuccugguccugugcgccgugcagcuccugcugaugcgcacguccugggcccucugcgaggcccugacccuggcgaccggccccaucaccacgcucugggagggcagccccgggaaguucuggaacaccaccaucgccguguccauggccaacaucuuccggggcagcuaccuggccggggcgggccuggccuucuccaucaugaaguccgucgggaccggccgccggggcacggggagccagggcgagacccucggggagaaguggaagaagcgccugaaccagcugucccggaaggaguucgaccucuacaagaaguccggcaucaccgagguggaccgcaccgaggccaaggaggggcugaagcggggcgagaccacgcaccacgccgugucccgcggcagcgccaagcugcagugguucgucgagcgcaacauggugaucccggaggggcgggugaucgaccucggcugcgggcgcggcgggugguccuacuacugcgcgggccugaagaaggucaccgaggugcggggcuacaccaagggcgggcccgggcacgaggagcccgugcccaugagcaccuacggcuggaacaucgucaagcugauguccgggaaggacguguucuaccucccgcccgagaagugcgacacgcugcugugcgacaucggcgagagcucccccagccccaccguggaggagucccgcaccauccggguccugaagaugguggagccguggcucaagaacaaccaguucugcaucaaggugcugaaccccuacaugcccaccgucaucgagcaccuggagcgccuccagcggaaguacggcgggaugcuggugcgcaacccccugagccggaacuccacgcacgagauguacuggaucagcaacggcaccgggaacaucguguccagcgucaacauggugucccgccuccugcugaaccgguucaccaugacccaccgccggccgacgauggagaaggacgucgaccucggcgccggcacccgccacgugaacgccgagcccgagacccccaacauggacgugaucggggagcggaucaagcgcaucaaggaggagcacagcuccaccuggcacuacgacgacgagaacccguacaagacgugggccuaccacggcagcuacgaggucaaggccaccgggagcgcguccagcaugaucaacggcguggugaagcugcugaccaagcccugggacgucgugcccauggugacccagauggccaugacggacaccacccccuucgggcagcagcgggucuucaaggagaagguggacacccgcacgccgcggcccaugcccggcacccgcaaggugauggagaucaccgccgaguggcucuggcgcacccugggccggaacaagaagccccgccugugcacgcgggaggaguucaccaagaagguccgcaccaacgccgccaugggggcgguguucaccgaggagaaccagugggacuccgcccgggccgccguggaggacgaggaguucuggaagcucgucgaccgcgagcgggagcugcaccgccugggcaagugcgggagcugcguguacaacaugaugggcaagcgggagaagaagcucggggaguucggcaaggcgaagggcucccgcgccaucugguacauguggcugggggcccgguaccuggaguucgaggcccucggcuuccugaacgaggaccacugguucagccgcgagaacuccuacagcgggguggagggcgaggggcugcacaagcucggcuacauccugcgggacaucuccaagaucccgggcggggccauguacgcggacgacacggccggcugggacacccgcaucaccgaggacgaccugcacaacgaggagaagaucacccagcagauggaccccgagcaccggcgccucgccagcgccaucuucaagcugacguaccagaacaaggucgugaaggugcagcggcccacccccaaggggaccgucauggacaucaucucccgcaaggaccagcggggcagcggccagguggggaccuacggccugaacaccuucacgaacauggaggcccagcucgugcgccagauggagggggagggcguccuguccaaggcggaccuggaggacccgcaccuccuggagaagaagaucacccaguggcuggagaccaaggggguggagcggcucaagcgcauggccaucagcggcgacgacugcguggucaagcccaucgacgaccgcuucgccaacgcccugcuggcccucaacgacaugggcaaggugcggaaggacaucccccaguggcagcccuccaagggguggcacgacuggcagcaggucccguucugcagccaccacuuccacgagcugaucaugaaggacggccgcaagcuggucgugcccugccggccccaggacgagcucaucgggcgcgcgcggaucucccagggcgccggguggagccugaaggagaccgccugccugggcaaggccuacgcccagauguggucccucauguacuuccaccgccgggaccugcgccuggcgagcaacgccaucugcagcgccgugcccguccacugggugccgacgucccggaccaccuggagcauccacgcccaccaccaguggaugaccacggaggacaugcucaccguguggaaccgcgucuggaucgaggacaaccccuggauggaggacaagacccccgugaccacgugggaggacgugcccuaccugggcaagcgggaggaccaguggugcgggucccugaucggccucaccagccgcgcgaccugggcccagaacauccugaccgccauccagcagguccggucccugaucggggacgaggaguuccucgacuacaugccgagcaugaagcgcuuccggaaggaggaggaguccgagggcgccaucugguga

SEQ ID NO: 10388 - RNA, 9873 nt, Artificial Sequence
  derived and/or modified CDS sequence (opt1) from DENV-3__JN662391__SS-prME
accagccugugccucaugaugauccugcccgccgcccuggcguuccaccucaccagccgggacggcgagccccggaugaucguggggaagaacgagcgcggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccguggcccucgcgccccacgugggcauggggcuggacacccgcacccagaccuggaugagcgccgagggcgccuggcggcaggucgagaagguggagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggaguacaagggcgaggacgcgccgugcaagauccccuucagcaccgaggacgagcaggggaaggcccacaacggccgccugaucacggccaaccccgucgugaccaagaaggaggagcccgugaacaucgaggccgagccgcccuucggcgagagcaacaucgucaucgggaucggcgacaacgcgcugaagaucaacugguacaagaagggguccagcaucggcaagauguucgaggccaccgcccgcggggcccgccggauggccauccugggcgacaccgcgugggacuucggcuccgucgggggcgugcucaacagccuggggaagaugguccaccagaucuucggcuccgccuacacggcccuguucagcgggguguccugggugaugaagaucggcaucggcguccuccugaccuggaucgggcugaacagcaagaacaccuccaugagcuucuccugcaucgccaucggcaucaucacccucuaccugggggccguggugcaggcggacaugggcugcgucaucaacuggaaggggaaggagcugaagugcggcagcggcaucuucgugacgaacgaggugcacaccuggaccgagcaguacaaguuccaggccgacucccccaagcgccucgccaccgccaucgccggggcgugggagaacggcgucugcgggauccgcagcacgacccggauggagaaccugcuguggaagcagaucgccaacgagcucaacuacauccugugggagaacaacaucaagcugaccgugguggucggcgacaccaucggggugcucgagcagggcaagcgcacgcugacgccccagccgauggagcugaaguacuccuggaagaccuggggcaaggccaagaucgugaccgccgagacgcagaacagcuccuucaucaucgacgggcccaacacccccgagugccccagcgcgucccgggccuggaacgucugggagguggaggacuacggcuucgggguguucaccaccaacaucuggcucaagcugcgcgaggucuacacccagaugugcgaccaccggcugaugagcgccgccgugaaggacgagcgcgccgugcacgcggacaugggcuacuggaucgagagccagaagaacggcuccuggaagcucgagaaggccagccugaucgaggucaagacgugcaccuggccgaagucccacacccuguggagcaacggggugcucgaguccgacaugaucauccccaagagccuggccggccccaucucccagcacaacuaccggccgggguaccacacccagacggccggccccuggcaccuggggaagcucgagcuggacuucaacuacugcgagggcaccaccguggucaucaccgagaacugcggcacgcgcgggcccagccugcggaccaccaccguguccggcaagcucauccacgaguggugcugccgcagcugcacgcugcccccgcugcgguacaugggggaggacggcugcugguacgggauggagauccgccccaucuccgagaaggaggagaacauggucaagagccucgucuccgccggcagcggcaagguggacaacuucaccaugggggugcugugccuggcgauccucuucgaggaggucaugcggggcaaguucgggaagaagcacaugaucgccggcguguuccugaccuucaugcugcuccuguccgggcagaucaccuggcgcgacauggcccacacgcugaucaugaucggcagcaacgccuccgaccggaugggcaugggggugaccuaccucgcccugaucgcgaccuucaagauccagcccuuccuggcccucggcuucuuccugcgcaagcugaccagccgggagaaccuccugcugggggucggccucgccauggccacgaccauccagcugcccgaggacaucgagcagauggcgaacggcaucgcccuggggcucauggcccugaagcugaucacccaguucgagaccuaccagcucuggacggcccugaucagccugaccugcuccaacaccaucuucacccucacgguggccuggcgcaccgcgacccugauccuggccggcgugagccuccugccggucugccaguccagcuccaugcggaagaccgacuggcugcccaugacgguggccgccaugggggugccgccccucccgcuguucaucuucagccugaaggacacccucaagcgccgcuccuggccccugaacgagggcgugauggccguggggcuggucagcauccucgcguccagccugcugcggaacgacgugcccauggccggcccccucguggccggcgggcugcugaucgccugcuacgucaucaccggcaccuccgccgaccucacgguggagaaggcggccgacgugaccugggaggaggaggccgagcagaccggggucagccacaaccugaugaucaccguggacgacgacggcaccaugcgcaucaaggacgacgagacggagaacauccugaccgugcuccugaagaccgcccugcucaucgucuccgggaucuucccguacagcauccccgccacccugcugguguggcacacguggcagaagcagacccagcgguccggcgugcucugggacguccccagcccgcccgagacccagaaggcggagcuggaggagggcguguaccgcaucaagcagcaggggauccugggcaagacccaggugggggucggcgugcagaaggaggggguguuccacacgauguggcacgucacccggggcgccgugcucacccacaacggcaagcgccuggagcccaacugggccuccgugaagaaggaccugaucagcuacgggggcggguggcggcucuccgcccaguggcagaagggcgaggagguccaggugaucgcgguggagcccgggaagaaccccaagaacuuccagaccaugcccggcacguuccagaccaccaccggcgagaucggggccaucgcccuggacuucaagcccggcacgagcgggagccccaucaucaaccgcgagggcaaggucgugggccuguacgggaacggcguggucaccaagaacgggggcuacguguccgggaucgcccagaccaacgccgagccggacggccccacccccgagcuggaggaggagauguucaagaagcggaaccucacgaucauggaccugcaccccggcagcgggaagacccgcaaguaccugccggcgaucgugcgggaggccaucaagcgccggcuccgcacccugauccuggcccccacccgggucguggccgccgagauggaggaggcgcucaagggccugcccauccgcuaccagacgaccgccaccaaguccgagcacaccgggcgggagaucguggaccugaugugccacgccacguucaccaugcgccuccugagccccguccgggugccgaacuacaaccugaucaucauggacgaggcccacuucaccgaccccgccuccaucgcggcccgcggcuacaucagcacccggguggggaugggcgaggccgccgcgaucuucaugacggccacgccgcccggcaccgccgacgccuucccgcaguccaacgcccccauccaggacgaggagcgcgacauccccgagcgcagcuggaacuccgggaacgaguggaucaccgacuucgcgggcaagacggucugguucgugcccagcaucaaggccgggaacgacaucgccaacugccuccggaagaacggcaagaaggugauccagcugucccgcaagaccuucgacaccgaguaccagaagaccaagcugaacgacugggacuucgucgugacgaccgacaucagcgagaugggggccaacuucaaggccgaccgggugaucgacccgcgccggugccucaagcccgucauccugaccgacggccccgagcgcgugauccuggcgggccccaugccggugaccgucgccuccgccgcccagcggcgcgggcgggugggccgcaacccccagaaggagaacgaccaguacaucuucaccgggcagccccucaacaacgacgaggaccacgcccacuggacggaggcgaagaugcugcuggacaacaucaacacccccgagggcaucaucccggcccucuucgagcccgagcgggagaaguccgccgccaucgacggggaguaccgccugaagggcgagucccggaagaccuucguggagcugaugcgccggggcgaccuccccgucuggcuggcgcacaagguggccagcgaggggaucaaguacaccgaccgcaaguggugcuucgacggccagcggaacaaccagauccuggaggagaacauggacgucgagaucuggacgaaggagggggagaagaagaagcuccgcccccgguggcuggacgcccgcaccuacuccgacccgcuggcccucaaggaguucaaggacuucgccgcgggccgcaagagcaucgcccuggaccuggugaccgagaucggccgggugcccucccaccucgcccaccgcacccggaacgcccuggacaaccuggucaugcuccacacgagcgagcacgggggccgcgccuaccggcacgcgguggaggagcugcccgagaccauggagacccugcuccugcuggggcucaugauccugcugaccggcggggccaugcuguuccugaucagcggcaagggcaucgggaagacguccaucggccugaucugcgugaucgccagcuccgggaugcucuggauggccgagaucccgcugcaguggaucgccagcgcgaucguccuggaguucuucaugauggugcuccugauccccgagcccgagaagcagcgcacgccccaggacaaccagcuggccuacguggucaucggcauccucacccuggccgccaucaucgccgcgaacgagauggggcugcucgagaccacgaagcgggaccugggcauguccaaggagccgggcguggugagccccaccuccuaccuggacgucgaccuccaccccgccagcgccuggacccuguacgccguggcgaccacggugaucacccccaugcugcgccacaccaucgagaacuccaccgccaacgucagccucgccgccaucgccaaccaggcgguggugcugauggggcuggacaagggcuggccgaucuccaagauggaccucggggucccccugcuggcccucggcugcuacagccaggugaacccccugacgcugaccgccgccgugcuccugcuggucacccacuacgccaucaucgggcccggccuccaggcgaaggccacccgggaggcccagaagcgcacggccgccggcaucaugaagaacccgaccguggacgggaucaucaccaucgaccuggaccccgugaucuacgacuccaaguucgagaagcagcugggccaggucaugcuccuggugcugugcgcggugcagcuccugcugaugcggaccagcugggcccucugcgaggcccugacgcuggccaccgggcccaucaccacccucugggagggcucccccggcaaguucuggaacacgaccaucgcggucagcauggccaacaucuuccgcggguccuaccuggccggcgccgggcuggccuucagcaucaugaaguccgugggcaccgggaagcggggcaccggcagccagggggagacccucggcgagaaguggaagaagaagcugaaccagcugagccgcaaggaguucgaccucuacaagaaguccgggaucacggagguggaccggaccgaggcgaaggagggccugaagcgcggggagaccacccaccacgccgucagccggggcuccgccaagcugcagugguucguggagcgcaacauggugaucccggagggccgggucaucgaccucgggugcggccgcgggggcuggagcuacuacugcgccgggcugaagaaggugacggaggugcggggcuacaccaagggcgggcccggccacgaggagcccguccccauguccacccacggguggaacaucgugaagcugaugagcggcaaggacguguucuaccucccgcccgagaagugcgacacccugcugugcgacaucggggaguccagccccucccccacggucgaggagagccgcaccauccgcgugcugaagaugguggagccguggcucaagaacaaccaguucugcaucaagguccugaaccccuacaugcccgccgugaucgagcaccuggagcggcuccagcgcaagcacggcggcaugcuggugcggaacccccugucccgcaacagcacccacgagauguacuggaucuccaacgggaccggcaacaucgucagcuccgugaacauggugagccggcuccugcugaaccgcuucacgaugacccaccggcgcccgaccaucgagaaggacgucgaccucggggcgggcacccggcacgugaacgccgagcccgagacgcccaacauggacgugaucggcgagcgcauccggcgcaucaaggaggagcacaacuccaccuggcacuacgacgacgagaacccguacaagaccugggccuaccacgggagcuacgaggucaaggccaccggcuccgccagcagcaugaucaacgggguggucaagcugcugacgaagcccugggacguggugcccauggucacccagauggcgaugaccgacaccacgcccuucggccagcagcggguguucaaggagaagguggacacccgcaccccgcggcccaugcccgggacccgcaaggucauggagaucacggccgaguggcucuggcggacccugggccgcaacaagcggccccgccugugcacccgcgaggaguucaccaagaaggugcggacgaacgccgccaugggcgcgguguucaccgaggagaaccagugggacuccgccaaggccgccgucgaggacgaggaguucuggaagcucguggaccgcgagcgggagcugcacaagcuggggaagugcggcagcugcguguacaacaugauggggaagcgcgagaagaagcucggcgaguucgggaaggccaagggcucccgggcgaucugguacauguggcugggcgcccgcuaccuggaguucgaggcccucggguuccugaacgaggaccacugguucagccgggagaacuccuacagcggcgucgagggggagggccugcacaagcucggguacauccugcgcgacaucuccaagaucccgggcggcgccauguacgccgacgacaccgcggggugggacacccggaucacggaggacgaccugcacaacgaggagaagaucacccagcagaugaaccccgagcaccgccuccuggccaacgccaucuucaagcugaccuaccagaacaagguggugaagguccagcggcccacccccaccggcacggugauggacaucaucagccgcaaggaccagcggggguccggccaggugggcaccuacgggcucaacaccuucaccaacauggaggcccagcugguccgccagauggagggcgagggggugcugagcaaggccgaccucgagaacccgcaccuccccgagaagaagaucacgcaguggcuggagaccaagggcguggagcggcucaagcgcauggcgaucuccggggacgacugcgucgugaagcccaucgacgaccgguucgccaacgcccugcuggcccucaacgacaugggcaaggugcgcaaggacaucccccaguggcagccgagcaagggcuggcacgacuggcagcagguccccuucugcucccaccacuuccacgagcugaucaugaaggacgggcggaagcugguggugcccugccgcccccaggacgagcucaucggccgggcccgcaucagccagggggcgggcuggucccugcgcgagaccgccugccuggggaaggccuacgcccagauguggagccucauguacuuccaccggcgcgaccugcggcuggcguccaacgccaucugcagcgccgucccggugcacugggugcccaccucccgcacgaccuggagcauccacgcccaccaccaguggaugaccaccgaggacaugcucacggucuggaaccggguguggaucgaggacaaccccuggauggaggacaagacccccgugaccaccugggagaacgucccguaccugggcaagcgcgaggaccaguggugcggcagccugaucgggcucacgucccgggccaccugggcgcagaacaucagcaccgccauccagcagguccgcucccugaucggcaacgaggaguuccuggacuacaugcccagcaugaagcgguuccgcaaggaggaggaguccgagggggccaucugguga

SEQ ID NO: 10389 - RNA, 9873 nt, Artificial Sequence
  derived and/or modified CDS sequence (opt1) from DENV-3__AY858043__SS-prME
accagccugugccucaugaugaugcugcccgccacccuggccuuccaccucacgucccgcgacggcgagccgcggaugaucguggggaagaacgagcgcggcaagagccugcuguucaagaccgcguccgggaucaacaugugcacccucaucgccauggaccugggcgagaugugcgacgacaccgucacguacaagugcccccugaucaccgagguggagcccgaggacaucgacugcuggugcaaccucaccagcaccugggugacguacgggaccugcaaccaggccggcgagcaccggcgcgacaagcgguccgucgcccuggccccccacgugggcauggggcuggacacccgcgcgcagaccuggaugagcgccgagggcgccuggcggcaggccgagaagguggagacgugggcgcuccgccacccgggguucaccauccuggcccuguuccucgcccacuacaucggcaccucccugacccagaaggucgugaucuucauccugcucaugcuggugacgcccagcaugaccaugcggugcgucggggugggcaaccgcgacuucguggagggccuguccggggccaccugggucgacguggugcucgagcacggcgggugcgucaccacgauggccaagaacaagcccacccuggacaucgagcugcagaagaccgaggcgacccagcucgccacgcugcggaagcugugcaucgagggcaagaucaccaacgugaccaccgacagccgcugccccacgcagggcgaggccauccucccggaggagcaggaccagaacuacgugugccggcacaccuacgucgaccgcggguggggcaacgggugcggccuguucgggaagggcucccuggugaccugcgccaaguuccagugccucgagcugaucgagggcaaggugguccagcacgagaaccugaaguacaccgugaucaucacggugcacaccggggaccagcaccaggucggcaacgagacccagggggugaccgccgagaucacgccccaggcgagcaccgucgaggccauccuccccgaguacggcacccuggggcuggagugcuccccccggaccggccucgacuucaacgagaugauccugcugaccaugaagaacaaggccuggauggugcaccgccagugguucuucgaccucccgcugcccuggacgagcggcgccaccaccgagacccccacguggaacaagaaggagcugcucgugaccuucaagaacgcccacgcgaagaagcaggaggucguggugcuggggucccaggagggcgccaugcacaccgcccugaccggggccacggagauccagaccagcggcgggaccuccaucuucgccggccaccucaagugccggcugaagauggacaagcuggagcucaagggcaugagcuacgcgaugugcuccaacgccuucguccugaagaaggaggugagcgagacccagcacgggacgauccugaucaagguggaguacaagggcgaggacgcccccugcaagaucccguucagcaccgaggacgggcagggcaagguccacaacggccgccugaucaccgccaaccccguggugaccaagaaggaggagcccgucaacaucgaggcggagcccccguucggggaguccaacaucaucaucggcaucggggacaaggcccucaagaucaacugguacaagaagggcagcuccaucgggaagauguucgaggccacggcccggggcgcccgccggauggcgauccugggcgacaccgccugggacuucgggagcgugggcggggugcugaacucccucggcaagaugguccaccagaucuucgggagcgccuacaccgcccuguucuccggcgugagcuggaucaugaagaucggcaucggggugcugcucaccuggaucggccugaacuccaagaacacgagcauguccuucagcugcaucgucaucgggaucaucacccuguaccucggcgccguggugcaggcggacauggggugcgucaucaacuggaagggcaaggagcugaagugcggcuccgggaucuucgugaccaacgaggugcacaccuggacggagcaguacaaguuccaggccgacagccccaagcgccuggccaccgccaucgccggcgcgugggagaacggggucugcggcauccgcuccaccacccggauggagaaccuccuguggaagcagaucgccaacgagcugaacuacauccucugggagaacaacaucaagcugacggugguggucggggacaucaucggcgugcuggagcagggcaagcgcacccucaccccccagcccauggagcugaaguacagcuggaagaccugggggaaggccaagguggucacggccgagauccagaacuccagcuucaucaucgacggcccgaacacccccgagugccccaacgcgucccgggccuggaacgugugggagguggaggacuacggguucggcgucuucaccaccaacaucuggcugaagcuccgcgagauguacacgcagcugugcgaccaccggcugaugagcgccgccgugaaggacgagcgcgccgugcacgcggacaugggcuacuggaucgagagccagaagaacggguccuggaagcucgagaaggccagccugaucgaggucaagaccugcaccuggcccaagucccacacccuguggagcaacggcgugcucgaguccgacaugaucaucccgaagagccuggccgggcccaucucccagcacaacuaccggcccggcuaccacacccagacggccgggccguggcaccugggcaagcucgagcuggacuucaacuacugcgagggcaccaccguggucaucaccgagaacugcgggacgcgcggccccagccugcggaccaccaccguguccgggaagcucauccacgaguggugcugccgcagcugcacgcugcccccccugcgguacaugggcgaggacgggugcugguacggcauggagauccgcccgaucaacgagaaggaggagaacauggugaagucccucgucagcgccggcuccgggaagguggacaacuucaccaugggcgugcugugccuggcgauccucuucgaggaggucaugcgggggaaguucggcaagaagcacaugaucgccggggugcuguucauguucgugcugcuccugagcggccagaucaccuggcgcgacauggcccggacccugaucaugaucggcuccaacgccagcgaccgcauggggaugggcgucacguaccucgcccugaucgcgaccuucaagauccagcccuuccuggcccucggguucuuccugcggaagcugaccucccgcgagaaccuccugcugggcgugggccucgccauggccaccacgcugcagcugcccgaggacaucgagcagauggcgaacgggaucgcccucggccugauggcccugaagcucaucacccaguucgagaccuaccagcuguggaccgcccuggugagccucacgugcagcaacaccaucuucacccugaccgucgccuggcggacggcgacccugauccucgccgggaucucccugcugcccgugugccagagcuccagcaugcgcaagaccgacuggcucccgaugaccgucgccgccaugggcgugcccccccugccccuguucaucuucucccucaaggacacgcugaagcgccggagcuggccgcugaacgagggggugauggccgucggccucguguccauccuggcgagcucccugcuccgcaacgacgugcccauggccggcccccuggucgccgggggccugcucaucgccugcuacgugaucaccgggaccagcgccgaccugaccguggagaaggcggccgacgucacgugggaggaggaggccgagcagaccggcgugucccacaaccugaugaucaccguggacgacgacgggaccaugcggaucaaggacgacgagacggagaacauccucaccguccugcugaagaccgcccuccugaucgugagcggcaucuuccccuacuccaucccggccacccugcucguguggcacaccuggcagaagcagacgcagcgcagcggcguccugugggacgugcccuccccccccgagacccagaaggcggagcuggaggaggggguguaccggaucaagcagcagggcaucuucgggaagacccaggucggcgugggggugcagaaggagggcgucuuccacaccauguggcacgugacgcgcggcgccgugcucaccuacaacgggaagcggcuggagccgaacugggccagcgucaagaaggaccugaucuccuacggcgggggcuggcgccugagcgcccaguggcggaagggggaggaggugcaggugaucgcggucgagcccggcaagaaccccaagaacuuccagaccaugcccggcaucuuccagaccacgaccggggagaucggcgccaucgcccucgacuucaagccggggaccuccggcagccccaucaucaaccgcgagggcaaggugguggggcuguacggcaacggggucgugaccaagaacggcggguacgugagcggcaucgcccagacgaacgccgagcccgacggcccgacccccgagcuggaggaggagauguucaagaagcggaaccucaccaucauggaccugcaccccggguccggcaagacccgcaaguaccugcccgcgaucguccgggaggccaucaagcgccggcuccgcacgcugauccuggccccgacccgggugguggccgccgagauggaggaggcgcucaaggggcugcccauccgcuaccagaccaccgccacgaagagcgagcacaccggcaaggagaucgucgaccugaugugccacgccaccuucaccaugcggcuccugucccccgugcgcgugcccaacuacaaccugaucaucauggacgaggcccacuucacggacccggccagcaucgcggcccggggguacaucuccacccgcgucggcaugggcgaggccgccgcgaucuucaugaccgccaccccccccgggacggccgacgccuucccccagagcaacgccccgauccaggacgaggagcgcgacauccccgagcgguccuggaacagcggcaacgacuggaucaccgacuucgcggggaagaccgugugguucgugcccuccaucaaggccggcaacgacaucgccaacugccuccgcaagaacgggaagaaggucauccagcugagccggaagaccuucgacacggaguaccagaagaccaagcugaacgacugggacuucguggugaccaccgacaucuccgagaugggcgccaacuucaaggccgaccgcgucaucgacccccggcgcugccucaagccggugauccugacggacggccccgagcgggugauccuggcggggcccaugcccgucaccguggccagcgccgcccagcgccggggccgcguggggcggaacccgcagaaggagaacgaccaguacaucuucaccggccagccccucaacaacgacgaggaccacgcccacuggaccgaggcgaagaugcugcuggacaacaucaacacgcccgaggggaucauccccgcccucuucgagccggagcgcgagaaguccgccgccaucgacggcgaguaccggcugaagggcgagagccgcaagaccuucgucgagcugaugcggcgcggggaccuccccguguggcuggcgcacaaggucgccuccgagggcaucaaguacaccgaccggaaguggugcuucgacggggagcgcaacaaccagauccuggaggagaacauggacguggagaucuggaccaaggagggcgagaagaagaagcuccggccccgcuggcuggacgcccgcaccuacagcgacccccuggcccucaaggaguucaaggacuucgccgcgggccggaaguccaucgcccuggaccuggugacggagaucgggcgcgucccgagccaccucgcccaccggacccgcaacgcccuggacaaccuggugaugcuccacaccuccgagcacggcgggcgggccuaccgccacgcgguggaggagcugcccgagaccauggagacguuccugcuccugggccugaugauccuccugaccgggggcgccaugcuguuccucaucagcggcaagggggucggcaagaccagcaucgggcugaucugcgugguggccuccagcggcaugcuguggauggccgacaucccccuccaguggaucgccuccgcgaucguccuggaguucuucaugauggugcugcucaucccggagcccgagaagcagcggaccccccaggacaaccagcuggccuacguggucaucgggauccugacgcucgccgccaucguggccgcgaacgagaugggccugcuggagaccaccaagcgcgaccucggcaugagcaaggagcccgggguggucuccccgaccagcuaccuggacguggaccugcaccccgccuccgccuggacgcucuacgccguggcgaccaccgucaucacccccaugcugcggcacacgaucgagaacagcaccgccaacgugucccuggccgccaucgccaaccaggcggugguccucaugggccuggacaagggguggcccaucagcaagauggaccugggcgugccgcuccuggcccuggggugcuacucccaggugaacccccucacccugaccgccgccguccugcuccuggugacgcacuacgccaucaucggccccggccugcaggcgaaggccacccgcgaggcccagaagcggaccgccgccgggaucaugaagaaccccaccguggacggcaucaugacgaucgaccucgacccggucaucuacgacagcaaguucgagaagcagcuggggcaggugaugcugcucgugcugugcgcgguccagcugcuccugaugcgcaccuccugggccuucugcgaggcccugacccucgccaccggccccaucacgacccugugggagggcagccccgggaaguucuggaacaccaccaucgcgguguccauggccaacaucuuccggggcagcuaccuggccggggccggccucgccuucuccaucaugaagagcguggggacgggcaagcgcggcaccgggucccagggcgagacccugggggagaaguggaagaagaagcugaaccagcucagccggaaggaguucgaccuguacaagaagagcggcaucaccgaggucgaccgcacggaggcgaaggaggggcugaagcggggcgagaccacccaccacgccgugucccgcggcagcgccaagcuccagugguucguggagcggaacauggucauccccgaggggcgcgugaucgaccugggcugcgggcggggcgggugguccuacuacugcgccggccugaagaaggugaccgagguccgcggcuacaccaaggggggcccggggcacgaggagcccgugcccaugagcacguacggcuggaacaucgugaagcucauguccgggaaggacgucuucuaccugcccccggagaagugcgacacccugcugugcgacaucggcgagagcucccccagccccaccguggaggagucccgcaccauccgggugcucaagauggucgagcccuggcugaagaacaaccaguucugcaucaaggugcugaacccguacaugcccacggugaucgagcaccucgagcgccugcagcggaagcacggcgggaugcugguccgcaacccccucagccggaacuccacccacgagauguacuggaucagcaacggcaccgggaacaucguguccagcgugaacauggucucccgccugcugcucaaccgguucaccaugacguaccgccggcccaccaucgagaaggacguggaccugggcgccggcacccgccacgucaacgcggagccggagacccccaacauggacgugaucggggagcggauccgccggaucaaggaggagcacagcuccacguggcacuacgacgacgagaaccccuacaagaccugggccuaccacggcagcuacgaggugaaggccaccggguccgccagcagcaugaucaacggcgucgugaagcugcucaccaagccgugggacgugguccccacggugacccagauggccaugaccgacaccacgcccuucgggcagcagcgcguguucaaggagaaggucgacacccggacccccaagccgaugcccggcacccgcaaggugauggagaucacggcggaguggcuguggcggacccugggccgcaacaagcggccccgccucugcacccgcgaggaguucaccaagaaggugcggacgaacgccgccaugggggccgucuucaccgaggagaaccagugggacuccgcgcgcgccgccguggaggacgaggaguucuggaagcugguggaccgggagcgcgagcugcacaagcagggcaagugcgggagcugcgucuacaacaugaugggcaagcgggagaagaagcucggggaguucggcaaggccaagggcucccgcgccaucugguacauguggcugggggcgcgguaccuggaguucgaggcccucggcuuccugaacgaggaccacugguucagccgcgagaacuccuacagcgggguggagggcgaggggcugcacaagcucggcuacauccugcgggacaucuccaagauccccggcggggccauguacgccgacgacaccgccggcugggacacccgcaucacggaggacgaccugcacaacgaggagaagaucacccagcagauggacccggagcaccggcagcucgcgaacgccaucuucaagcugaccuaccagaacaagguggucaaggugcagcgccccacccccaaggggacggugauggacaucaucagccggaaggaccagcgcggcuccggccaggucgggaccuacggccugaacaccuucaccaacauggaggcccagcucauccggcagauggagggggagggcgugcugagcaagaccgaccuggagaacccccaccuccuggagaagaagaucauccaguggcuggagacgaaggggguggagcgccucaagcggauggccaucuccggcgacgacugcgucgugaagccgaucgacgaccgcuucgccaacgcgcugcuggcccucaacgacaugggcaaggugcggaaggacaucccccaguggcagcccagccgcggguggcacgacuggcagcagguccccuucugcucccaccacuuccacgagcugaucaugaaggacggccggaagcugguggugccgugccgcccccaggacgagcucaucgggcgcgcccggaucagccagggcgccggguggucccugaaggagaccgccugccugggcaaggcguacgcccagaugugggcccucauguacuuccaccgccgggaccugcgccuggccagcaacgcgaucugcuccgccguccccgugcacugggugcccaccagccggaccacgugguccauccacgcccaccaccaguggaugaccaccgaggacaugcucaccgucuggaaccgcguguggaucgaggacaacccguggauggaggacaagacgcccgugaccaccugggaggacguccccuaccugggcaagcgggaggaccaguggugcgggagccugaucggccucaccagccgcgccacgugggcccagaacauccugaccgcgauccagcaggugcggucccugaucgggaacgaggaguuccucgacuacaugcccagcaugaagcgcuuccggaaggaggaggaguccgagggcgccaucugguga

SEQ ID NO: 10390 - RNA, 9873 nt, Artificial Sequence
  derived and/or modified CDS sequence (opt1) from DENV-3__AY858044__SS-prME
accagccugugccucaugaugaugcugcccgccacccuggccuuccaccucaccagccgcgacggggagccccggaugaucguggggaagaacgagcgcggcaagagccugcuguucaagaccgccuccgggaucaacaugugcacccucaucgccauggaccugggggagaugugcgacgacaccaucaccuacaagugcccccugaucaccgagguggagcccgaggacaucgacugcuggugcaaccucaccagcaccugggugacguacgggaccugcaaccaggccggcgagcaccggcgcgacaagcgguccguggcccuggcgccccacgugggcauggggcuggacacccgcgcgcagaccuggaugagcgccgagggcgccuggcgccagguggagaagguggagacgugggccuuccgccaccccggguucaccauccucgcgcuguuccuggcccacuacaucggcaccucccucacccagaagguggugaucuucauccugcugaugcucgugacgcccagcaugaccaugcggugcgucggggugggcaaccgcgacuucguggagggccuguccggggccaccugggucgacguggugcuggagcacggcgggugcgucaccacgauggccaagaacaagcccacccucgacaucgagcugcagaagaccgaggccacccagcuggcgacgcuccggaagcugugcaucgagggcaagaucaccaacgugaccaccgacagccgcugccccacgcagggcgaggccauccugcccgaggagcaggaccagaacuacgugugcaagcacaccuacgucgaccggggguggggcaacgggugcggccucuucgggaagggcucccuggugaccugcgccaaguuccagugccuggagcucaucgagggcaaggugguccagcacgagaaccugaaguacaccgugaucaucacggugcacaccggggaccagcaccaggucggcaacgagacccagggggugaccgccgagaucacgccccaggccagcaccgucgaggcgauccugcccgaguacggcacccucgggcuggagugcagcccccggaccggccuggacuucaacgagaugauccuccugaccaugaagaacaaggccuggauggugcaccggcagugguucuucgaccugccgcuccccuggacgagcggcgccaccaccgagacccccacguggaacaagaaggagcugcuggugaccuucaagaacgcccacgccaagaagcaggaggucguggugcucgggucccaggagggcgcgaugcacaccgcccugaccggggccacggagauccagaccagcggcgggaccuccaucuucgccggccaccugaagugccgccucaagauggacaagcuggagcugaagggcaugagcuacgccaugugcuccaacgcguucguccucaagaaggaggugagcgagacccagcacgggacgauccugaucaagguggaguacaagggcgaggacgcccccugcaagaucccguucagcaccgaggacgggcagggcaaggcccacaacggccggcugaucaccgccaaccccgucgugaccaagaaggaggagcccgugaacaucgaggcggagcccccguucggggaguccaacaucaucaucggcaucggggacaaggcccugaagaucaacugguacaagaagggcagcuccaucgggaagauguucgaggccacggcccgcggcgcccggcgcauggcgauccucggcgacaccgccugggacuucgggagcgucggcggggugcugaacucccugggcaagauggugcaccagaucuucgggagcgccuacaccgcccucuucuccggcgucagcuggaucaugaagaucggcaucggggugcugcugaccuggaucggccucaacuccaagaacacgagcauguccuucagcugcaucgugaucgggaucaucacccuguaccugggcgccgucgugcaggcggacauggggugcgugaucaacuggaagggcaaggagcucaagugcggcuccgggaucuucgucaccaacgaggugcacaccuggacggagcaguacaaguuccaggccgacagccccaagcggcuggccaccgccaucgccggcgcgugggagaacggggugugcggcauccgcuccaccacccgcauggagaaccugcucuggaagcagaucgccaacgagcugaacuacauccugugggagaacaacaucaagcucacggucguggugggggacaucaucggcguccuggagcagggcaagcggacccugacgccccagcccauggagcucaaguacagcuggaagaccugggggaaggccaagaucgugacggccgagauccagaacuccagcuucaucaucgacggcccgaacacccccgagugccccaacgcgucccgcgccuggaacgugugggaggucgaggacuacggguucggcguguucaccaccaacaucuggcugaagcugcgggagauguacacgcagcucugcgaccaccgccugaugagcgccgccgugaaggacgagcgggccguccacgcggacaugggcuacuggaucgagagccagaagaacggguccuggaagcuggagaaggccagccucaucgaggugaagaccugcaccuggcccaagucccacacccuguggagcaacggcgugcuggaguccgacaugaucauccccaagucccucgccgggcccaucucccagcacaacuaccgccccggcuaccacacccagacggccgggccguggcaccugggcaagcuggagcucgacuucaacuacugcgagggcaccaccgucgugaucaccgagaacugcgggacgcggggccccagccugcgcaccaccaccguguccgggaagcugauccacgaguggugcugccggagcugcacgcugccgccccuccgcuacaugggcgaggacgggugcugguacggcauggagauccggccgaucaacgagaaggaggagaacauggucaagucccuggugagcgccggcuccgggaagguggacaacuucaccaugggcguccucugccuggcgauccuguucgaggaggugaugcgcgggaaguucggcaagaagcacaugaucgccgggguccucuucauguucguccugcugcucagcggccagaucaccuggcgggacauggcccgcacccugaucaugaucggcuccaacgccagcgaccggauggggaugggcgugacguaccuggcccucaucgcgaccuucaagauccagcccuuccuggcccugggguucuuccuccgcaagcugaccucccgggagaaccugcuccugggcgugggccuggccauggccaccacgcuccagcugcccgaggacaucgagcagauggcgaacgggaucgcccugggccucauggcccugaagcugaucacccaguucgagaccuaccagcucuggaccgcccuggucagccugacgugcagcaacaccaucuucacccucaccguggccuggcgcacggcgacccugauccuggccgggaucucccuccugcccgugugccagagcuccagcaugcggaagaccgacuggcugccgaugaccgucgccgccaugggcgugccgccccucccccuguucaucuucucccugaaggacacgcucaagcgccgcagcuggccgcugaacgagggggucauggccgugggccugguguccauccucgcgagcucccugcugcggaacgacguccccauggccggcccccucguggccgggggccugcugaucgccugcuacgugaucaccgggaccagcgccgaccucaccgucgagaaggcggccgacgugacgugggaggaggaggccgagcagaccggcgugucccacaaccugaugaucaccgucgacgacgacgggaccaugcgcaucaaggacgacgagacggagaacauccugaccgugcuccugaagaccgcccugcucaucgugagcggcaucuuccccuacuccaucccggccacccugcuggucuggcacaccuggcagaagcagacgcagcggagcggcgugcucugggacgugcccagcccgcccgagacccagaaggcggagcuggaggagggggucuaccgcaucaagcagcagggcaucuucgggaagacccaggugggcguggggguccagaaggagggcguguuccacaccauguggcacgugacgcggggcgccguccugaccuacaacgggaagcgccucgagccgaacugggccagcgugaagaaggaccugaucuccuacggcgggggcuggcggcugagcgcccaguggcagaagggggaggaggugcaggucaucgcgguggagcccggcaagaaccccaagaacuuccagaccaugcccggcaucuuccagaccacgaccggggagaucggcgccaucgcccuggacuucaagccggggaccuccggcagccccaucaucaaccgcgagggcaagguggucgggcucuacggcaacgggguggugaccaagaacggcggguacgucagcggcaucgcccagacgaacgccgagcccgacggcccgacccccgagcuggaggaggagauguucaagaagcggaaccugaccaucauggaccuccaccccggguccggcaagacccgcaaguaccugcccgcgaucgugcgggaggccaucaagcgccggcugcgcacgcucauccuggccccgacccggguggucgccgccgagauggaggaggcgcugaaggggcuccccauccgcuaccagaccaccgccaccaagagcgagcacaccggcaaggagaucguggaccugaugugccacgccaccuucaccaugcggcugcucucccccgugcgcguccccaacuacaaccugaucaucauggacgaggcccacuucacggacccggccagcaucgcggcccggggguacaucuccacccgcgugggcaugggcgaggccgccgcgaucuucaugaccgccacgccgcccgggacggccgacgccuucccccagagcaacgccccgauccaggacgaggagcgggacauccccgagcgcuccuggaacagcggcaacgacuggaucaccgacuucgcggggaagaccgugugguucguccccuccaucaaggccggcaacgacaucgccaacugccugcgcaagaacgggaagaaggugauccagcucagccggaagaccuucgacacggaguaccagaagaccaagcugaacgacugggacuucguggucaccaccgacaucuccgagaugggcgccaacuucaaggccgaccgcgugaucgacccccggcgcugccugaagccggugauccucacggacggccccgagcgggucauccuggcggggcccaugcccgugaccguggccagcgccgcccagcgccggggccgcgucgggcggaacccgcagaaggagaacgaccaguacaucuucaccggccagccccugaacaacgacgaggaccacgcccacuggaccgaggcgaagaugcuccuggacaacaucaacacgcccgaggggaucauccccgcccuguucgagccggagcgcgagaaguccgccgccaucgacggcgaguaccggcucaagggcgagagccgcaagaccuucguggagcugaugcggcgcggggaccugcccguguggcucgcgcacaaggucgccuccgagggcaucaaguacaccgaccggaaguggugcuucgacggggagcgcaacaaccagauccuggaggagaacauggacguggagaucuggaccaaggagggcgagaagaagaagcugcggccccgcuggcucgacgcccggaccuacagcgacccccuggcccugaaggaguucaaggacuucgccgcgggccgcaaguccaucgcccucgaccuggucacggagaucgggcgcgugccgagccaccuggcccaccggacccgcaacgcccucgacaaccuggugaugcugcacaccuccgagcacggcgggcgggccuaccgccacgcggucgaggagcuccccgagaccauggagacgcugcugcuccugggccugaugauccuccugaccgggggcgccaugcuguuccucaucagcggcaagggggugggcaagaccagcaucgggcugaucugcguggucgccuccagcggcaugcuguggauggccgacaucccccuccaguggaucgccuccgcgaucgugcuggaguucuucaugauggugcugcucaucccggagcccgagaagcagcggacgccccaggacaaccagcuggccuacgucgugaucgggauccugacgcucgccgccaucguggccgcgaacgagaugggccugcuggagaccaccaagcgcgaccucggcaugagcaaggagcccggggucguguccccgaccagcuaccuggacguggaccugcaccccgccuccgccuggacgcucuacgccgucgcgaccaccgugaucacccccaugcugcggcacacgaucgagaacagcaccgccaacgugucccuggccgccaucgccaaccaggcggucgugcucaugggccuggacaagggguggcccaucagcaagauggaccugggcgugccgcuccuggcccuggggugcuacucccaggucaacccccucacccugaccgccgccgugcugcuccuggugacgcacuacgccaucaucggccccggccugcaggcgaaggccacccgcgaggcccagaagcggaccgccgccgggaucaugaagaaccccaccgucgacggcaucaugacgaucgaccucgacccggugaucuacgacagcaaguucgagaagcagcugggccaggugaugcugcucguccugugcgcggugcagcugcuccugaugcgcaccuccugggccuucugcgaggcccugacccucgccaccggccccaucacgacccugugggagggcagccccgggaaguucuggaacaccaccaucgcgguguccauggccaacaucuuccggggcagcuaccuggccggggccggccucgccuucuccaucaugaaguccgucgggacgggcaagcgcggcaccgggucccagggcgagacccugggggagaaguggaagaagaagcugaaccagcucagccggaaggaguucgaccuguacaagaaguccggcaucaccgagguggaccgcacggaggcgaaggaggggcugaagcggggcgagaccacccaccacgccgugucccgcggcagcgccaagcuccagugguucgucgagcggaacauggugauccccgaggggcgcgugaucgaccugggcugcgggcggggcgggugguccuacuacugcgccggccugaagaaggucaccgaggugcgcggcuacaccaagggcgggccggggcacgaggagcccgugcccaugagcacguacggcuggaacaucgucaagcucauguccgggaaggacguguucuaccugcccccggagaagugcgacacccugcugugcgacaucggcgagagcucccccagccccaccguggaggagucccggaccauccgcguccucaagaugguggagcccuggcugaagaacaaccaguucugcaucaaggugcugaacccguacaugcccacggucaucgagcaccucgagcgccugcagcggaagcacggcgggaugcuggugcgcaacccccucagccggaacuccacccacgagauguacuggaucagcaacggcaccgggaacaucguguccagcgucaacauggugucccgccugcugcucaaccgguucaccaugacguaccgccggcccaccaucgagaaggacguggaccugggcgccggcacccgccacgucaacgcggagccggagacccccaacauggacgugaucggggagcggauccgccggaucaaggaggagcacagcuccacguggcacuacgacgacgagaaccccuacaagaccugggccuaccacggcagcuacgaggucaaggccaccggguccgccagcagcaugaucaacggcguggugaagcugcucaccaagccgugggacgucgugcccacggugacccagauggccaugaccgacaccacgcccuucgggcagcagcgcgucuucaaggagaagguggacacccggacccccaagccgaugcccggcacccgcaaggugauggagaucacggcgggcuggcuguggcggacccuggggcgcaacaagcggccccgccucugcacccgggaggaguucaccaagaagguccgcacgaacgccgccaugggcgccguguucaccgaggagaaccagugggacuccgcgcgcgccgccguggaggacgaggaguucuggaagcuggucgaccgggagcgcgagcugcacaagcaggggaagugcggcagcugcguguacaacaugauggggaagcgggagaagaagcucggcgaguucggcaaggccaaggggucccgcgccaucugguacauguggcugggcgcgcgguaccuggaguucgaggcccucggguuccugaacgaggaccacugguucagccgcgagaacuccuacagcggcguggagggggagggccugcacaagcucggcuacauccugcgggacaucuccaagauccccgggggcgccauguacgccgacgacaccgccgggugggacacccgcaucacggaggacgaccugcacaacgaggagaagaucacccagcagauggacccggagcaccggcagcucgcgaacgccaucuucaagcugaccuaccagaacaaggucgugaaggugcagcgccccacccccaagggcacggucauggacaucaucagccggaaggaccagcgcggcuccggccaggugggcaccuacgggcugaacaccuucaccaacauggaggcccagcucauccggcagauggagggcgagggggugcugagcaagaccgaccuggagaacccccaccuccuggagaagaagaucacgcaguggcuggagaccaagggcgucgagcgccucaagcggauggccaucuccggcgacgacugcguggugaagccgaucgacgaccgcuucgccaacgcgcugcuggcccucaacgacauggggaagguccggaaggacaucccccaguggcagcccagcaagggcuggcacgacuggcagcagguccccuucugcucccaccacuuccacgagcugaucaugaaggacgggcgcaagcugguggucccgugccggccccaggacgagcucaucggccgcgcccggaucagccagggggccggcuggucccugaaggagaccgccugccugggcaaggcguacgcccagaugugggcccucauguacuuccaccgccgcgaccugcggcuggccagcaacgcgaucugcuccgccgugcccgugcacuggguccccaccagccgcacgaccugguccauccacgcccaccaccaguggaugaccaccgaggacaugcucacgguguggaaccggguguggaucgaggacaacccguggauggaggacaagacccccgucaccaccugggaggacgugcccuaccuggggaagcgcgaggaccaguggugcggcagccugaucgggcucacgagccgggccaccugggcccagaacauccugaccgcgauccagcagguccgcucccugaucggcaacgaggaguuccucgacuacaugcccagcaugaagcgguuccgcaaggaggaggaguccgagggggccaucugguga

SEQ ID NO: 10391 - RNA, 9873 nt, Artificial Sequence
  derived and/or modified CDS sequence (opt1) from DENV-3__AY858045__SS-prME
accagccugugccucaugaugaugcugcccgccacccuggccuuccaccucaccagccgcgacggggagccccggaugaucguggggaagaacgagcgcggcaagagccugcuguucaagaccgccuccgggaucaacaugugcacccucaucgccauggaccugggggagaugugcgacgacaccaucaccuacaagugcccccugaucaccgagguggagcccgaggacaucgacugcuggugcaaccucaccagcaccugggugacguacgggaccugcaaccaggccggcgagcaccggcgcgacaagcgguccguggcccuggcgccccacgugggcauggggcuggacacccgcgcgcagaccuggaugagcgccgagggcgccuggcgccagguggagaagguggagacgugggccuuccgccaccccggguucaccauccucgcgcuguuccuggcccacuacaucggcaccucccucacccagaaggucgugaucuucauccugcugaugcucgugacgcccagcaugaccaugcggugcgucggggugggcaaccgcgacuucguggagggccuguccggggccaccugggucgacguggugcuggagcacggcgggugcgucaccacgauggccaagaacaagcccacccucgacaucgagcugcagaagaccgaggccacccagcuggcgacgcuccggaagcugugcaucgagggcaagaucaccaacgugaccaccgacagccgcugccccacgcagggcgaggccauccugccggaggagcaggaccagaacuacgugugcaagcacaccuacgucgaccggggguggggcaacgggugcggccucuucgggaagggcucccuggugaccugcgccaaguuccagugccuggagcucaucgagggcaaggugguccagcacgagaaccugaaguacaccgugaucaucacggugcacaccggggaccagcaccaggucggcaacgagacccagggggugaccgccgagaucacgccccaggccagcaccgucgaggcgauccugcccgaguacggcacccucgggcuggagugcagcccccggaccggccuggacuucaacgagaugauccuccugaccaugaagaacaaggccuggauggugcaccggcagugguucuucgaccugccgcuccccuggacgagcggcgccaccaccgagacccccacguggaacaagaaggagcugcuggugaccuucaagaacgcccacgccaagaagcaggaggucguggugcucgggucccaggagggcgcgaugcacaccgcccugaccggggccacggagauccagaccagcggcgggaccuccaucuucgccggccaccugaagugccgccucaagauggacaagcuggagcugaagggcaugagcuacgccaugugcuccaacgcguucguccucaagaaggaggugagcgagacccagcacgggacgauccugaucaagguggaguacaagggcgaggacgcccccugcaagaucccguucagcaccgaggacgggcagggcaaggcccacaacggccggcugaucaccgccaaccccgucgugaccaagaaggaggagcccgugaacaucgaggcggagcccccguucggggaguccaacaucaucaucggcaucggggacaaggcccugaagaucaacugguacaagaagggcagcuccaucgggaagauguucgaggccacggcccgcggcgcccggcgcauggcgauccucggcgacaccgccugggacuucgggagcgucggcggggugcugaacucccugggcaagauggugcaccagaucuucgggagcgccuacaccgccaucuucuccggcgucagcuggaucaugaagaucggcaucggggugcuccugaccuggaucggccugaacuccaagaacacgagcauguccuucagcugcaucgugaucgggaucaucacccucuaccugggcgccgucgugcaggcggacauggggugcgugaucaacuggaagggcaaggagcugaagugcggcuccgggaucuucgucaccaacgaggugcacaccuggacggagcaguacaaguuccaggccgacagccccaagcggcucgccaccgccaucgccggcgcgugggagaacggggugugcggcauccgcuccaccacccgcauggagaaccugcuguggaagcagaucgccaacgagcucaacuacauccugugggagaacaacaucaagcugacggucguggugggggacaucaucggcguccucgagcagggcaagcggacccugacgccccagcccauggagcugaaguacagcuggaagaccugggggaaggccaagaucgugacggccgagauccagaacuccagcuucaucaucgacggcccgaacacccccgagugccccaacgcgucccgcgccuggaacgugugggaggucgaggacuacggguucggcguguucaccaccaacaucuggcucaagcugcgggagauguacacgcagcugugcgaccaccgccucaugagcgccgccgugaaggacgagcgggccguccacgcggacaugggcuacuggaucgagagccagaagaacggguccuggaagcuggagaaggccagccugaucgaggugaagaccugcaccuggcccaagucccacacccucuggagcaacggcgugcuggaguccgacaugaucauccccaagucccuggccgggcccaucucccagcacaacuaccgccccggcuaccacacccagacggccgggccguggcaccucggcaagcuggagcuggacuucaacuacugcgagggcaccaccgucgugaucaccgagaacugcgggacgcggggccccagccuccgcaccaccaccguguccgggaagcugauccacgaguggugcugccggagcugcacgcugccgccccugcgcuacaugggcgaggacgggugcugguacggcauggagauccggccgaucaacgagaaggaggagaacauggucaagucccuggugagcgccggcuccgggaagguggacaacuucaccaugggcguccugugccucgcgauccuguucgaggaggugaugcgcgggaaguucggcaagaagcacaugaucgccggggugcuguucauguucguccuccugcugagcggccagaucaccuggcgggacauggcccgcacccucaucaugaucggcuccaacgccagcgaccggauggggaugggcgugacguaccuggcccugaucgcgaccuucgagauccagcccuuccucgcccugggguucuuccugcgcaagcucaccucccgggagaaccugcugcucggcgugggccuggccauggccaccacgcugcagcuccccgaggacaucgagcagauggcgaacgggaucgcccugggccugauggcccucaagcugaucacccaguucgagaccuaccagcuguggaccgcccucgucagccugacgugcagcaacaccaucuucacccugaccguggccuggcgcacggcgacccucauccuggccgggaucucccugcuccccgugugccagagcuccagcaugcggaagaccgacuggcugccgaugaccgucgccgccaugggcgugccgccccugccccucuucaucuucucccugaaggacacgcugaagcgccgcagcuggccgcucaacgagggggucauggccgugggccugguguccauccuggcgagcucccuccugcggaacgacguccccauggccggcccccugguggccgggggccuccugaucgccugcuacgugaucaccgggaccagcgccgaccugaccgucgagaaggcggccgacgugacgugggaggaggaggccgagcagaccggcgugucccacaaccucaugaucaccgucgacgacgacgggaccaugcgcaucaaggacgacgagacggagaacauccugaccgugcugcucaagaccgcccugcugaucgugagcggcaucuuccccuacuccaucccggccacccuccuggucuggcacaccuggcagaagcagacgcagcggagcggcgugcugugggacgugcccagcccgcccgagacccagaaggcggagcucgaggagggggucuaccgcaucaagcagcagggcaucuucgggaagacccaggugggcguggggguccagaaggagggcguguuccacaccauguggcacgugacgcggggcgccguccugaccuacaacgggaagcgccuggagccgaacugggccagcgugaagaaggaccucaucuccuacggcgggggcuggcggcugagcgcccaguggcagaagggggaggaggugcaggucaucgcgguggagcccggcaagaaccccaagaacuuccagaccaugcccggcaucuuccagaccacgaccggggagaucggcgccaucgcccuggacuucaagccggggaccuccggcagccccaucaucaaccgcgagggcaagguggucgggcuguacggcaacgggguggugaccaagaacggcggguacgucagcggcaucgcccagacgaacgccgagcccgacggcccgacccccgagcucgaggaggagauguucaagaagcggaaccugaccaucauggaccugcaccccggguccggcaagacccgcaaguaccuccccgcgaucgugcgggaggccaucaagcgccggcugcgcacgcugauccucgccccgacccggguggucgccgccgagauggaggaggcgcugaaggggcugcccauccgcuaccagaccaccgccaccaagagcgagcacaccggcaaggagaucguggaccucaugugccacgccaccuucaccaugcggcugcugucccccgugcgcguccccaacuacaaccucaucaucauggacgaggcccacuucacggacccggccagcaucgcggcccggggguacaucuccacccgcgugggcaugggcgaggccgccgcgaucuucaugaccgccacgccgcccgggacggccgacgccuucccccagagcaacgccccgauccaggacgaggagcgggacauccccgagcgcuccuggaacagcggcaacgacuggaucaccgacuucgcggggaagaccgugugguucguccccuccaucaaggccggcaacgacaucgccaacugccugcgcaagaacgggaagaaggugauccagcugagccggaagaccuucgacacggaguaccagaagaccaagcucaacgacugggacuucguggucaccaccgacaucuccgagaugggcgccaacuucaaggccgaccgcgugaucgacccccggcgcugccugaagccggugauccugacggacggccccgagcgggucauccucgcggggcccaugcccgugaccguggccagcgccgcccagcgccggggccgcgucgggcggaacccgcagaaggagaacgaccaguacaucuucaccggccagccccugaacaacgacgaggaccacgcccacuggaccgaggcgaagaugcugcucgacaacaucaacacgcccgaggggaucauccccgcccuguucgagccggagcgcgagaaguccgccgccaucgacggcgaguaccggcugaagggcgagagccgcaagaccuucguggagcucaugcggcgcggggaccugcccguguggcuggcgcacaaggucgccuccgagggcaucaaguacaccgaccggaaguggugcuucgacggggagcgcaacaaccagauccucgaggagaacauggacguggagaucuggaccaaggagggcgagaagaagaagcugcggccccgcuggcuggacgcccggaccuacagcgacccccucgcccugaaggaguucaaggacuucgccgcgggccgcaaguccaucgcccuggaccucgucacggagaucgggcgcgugccgagccaccuggcccaccggacccgcaacgcccuggacaaccucgugaugcugcacaccuccgagcacggcgggcgggccuaccgccacgcggucgaggagcugcccgagaccauggagacgcuccugcugcucggccugaugauccugcucaccgggggcgccaugcuguuccugaucagcggcaagggggugggcaagaccagcaucgggcucaucugcguggucgccuccagcggcaugcuguggauggccgacaucccccugcaguggaucgccuccgcgaucgugcucgaguucuucaugauggugcugcugaucccggagcccgagaagcagcggacgccccaggacaaccagcucgccuacgucgugaucgggauccugacgcuggccgccaucguggccgcgaacgagaugggccuccuggagaccaccaagcgcgaccugggcaugagcaaggagcccggggucguguccccgaccagcuaccucgacguggaccugcaccccgccuccgccuggacgcuguacgccgucgcgaccaccgugaucacccccaugcuccggcacacgaucgagaacagcaccgccaacgugucccuggccgccaucgccaaccaggcggucgugcugaugggccucgacaagggguggcccaucagcaagauggaccugggcgugccgcugcucgcccuggggugcuacucccaggucaacccccugacccucaccgccgccgugcugcugcucgugacgcacuacgccaucaucggccccggccugcaggcgaaggccacccgcgaggcccagaagcggaccgccgccgggaucaugaagaaccccaccgucgacggcaucaugacgaucgaccuggacccggugaucuacgacagcaaguucgagaagcagcucggccaggugaugcugcugguccucugcgcggugcagcugcugcucaugcgcaccuccugggccuucugcgaggcccugacccuggccaccggccccaucacgacccucugggagggcagccccgggaaguucuggaacaccaccaucgcgguguccauggccaacaucuuccggggcagcuaccuggccggggccggccuggccuucuccaucaugaaguccgucgggacgggcaagcgcggcaccgggucccagggcgagacccucggggagaaguggaagaagcggcugaaccagcugagccgcaaggaguucgaccucuacaagaaguccggcaucaccgagguggaccggacggaggcgaaggaggggcugaagcgcggcgagaucacccaccacgccgugucccggggcagcgccaagcugcagugguucgucgagcgcaacauggugauccccgaggggcgggugaucgaccucggcugcgggcgcggcgggugguccuacuacugcgccggccugaagaaggucaccgaggugcggggcuacaccaagggcgggccggggcacgaggagcccgugcccaugagcaccuacggcuggaacaucgucaagcugauguccgggaaggacguguucuaccucccgcccgagaagugcgacacgcugcugugcgacaucggcgagagcucccccagccccaccguggaggagucccgcaccauccgcguccugaagaugguggagcccuggcucaagaacaaccaguucugcaucaaggugcugaaccccuacaugcccaccgucaucgagcaccuggagcggcuccagcgcaagcacggcgggaugcuggugcggaacccccugagccgcaacuccacgcacgagauguacuggaucagcaacggcaccgggaacaucguguccagcgucaacauggugucccggcuccugcugaaccgcuucaccaugaccuaccggcgccccacgaucgagaaggacguggaccucggcgccggcacccggcacgucaacgcggagccggagacccccaacauggacgugaucggggagcgcauccggcgcaucaaggaggagcacagcuccaccuggcacuacgacgacgagaaccccuacaagacgugggccuaccacggcagcuacgaggucaaggccaccggguccgccagcagcaugaucaacggcguggugaagcugcugaccaagccgugggacgucgugcccaccgugacgcagauggccaugaccgacaccacccccuucgggcagcagcgggucuucaaggagaagguggacacgcgcacccccaagccgaugcccggcacccggaaggugauggagaucaccgcgggcuggcucuggcgcacgcuggggcggaacaagcgcccccggcugugcacccgcgaggaguucaccaagaagguccgcaccaacgccgccaugggcgccguguucacggaggagaaccagugggacuccgcgcgggccgccguggaggacgaggaguucuggaagcucgucgaccgcgagcgggagcugcacaagcaggggaagugcggcagcugcguguacaacaugauggggaagcgcgagaagaagcugggcgaguucggcaaggccaaggggucccgggccaucugguacauguggcucggcgcgcgcuaccuggaguucgaggcccugggguuccucaacgaggaccacugguucagccgggagaacuccuacagcggcguggagggggagggccugcacaagcugggcuacauccuccgcgacaucuccaagauccccgggggcgccauguacgccgacgacaccgccgggugggacacccggaucaccgaggacgaccugcacaacgaggagaagaucacgcagcagauggacccggagcaccgccagcuggcgaacgccaucuucaagcucaccuaccagaacaaggucgugaaggugcagcggcccacccccaagggcaccgucauggacaucaucagccgcaaggaccagcggggcuccggccaggugggcacguacgggcugaacaccuucaccaacauggaggcccagcugauccgccagauggagggcgagggggugcucagcaagaccgaccuggagaacccccaccuccucgagaagaagaucacccaguggcuggagacgaagggcgucgagcggcugaagcgcauggccaucuccggcgacgacugcguggugaagccgaucgacgaccgguucgccaacgcgcuccuggcccugaacgacauggggaagguccgcaaggacaucccccaguggcagcccagcaagggcuggcacgacuggcagcagguccccuucugcucccaccacuuccacgagcucaucaugaaggacgggcggaagcugguggucccgugccgcccccaggacgagcugaucggccgggcccgcaucagccagggggccggcuggucccucaaggagaccgccugccugggcaaggcguacgcccagaugugggcccugauguacuuccaccgccgggaccuccgccuggccagcaacgcgaucugcuccgccgugcccgugcacuggguccccaccagccggaccacgugguccauccacgcccaccaccaguggaugaccaccgaggacaugcugaccguguggaaccgcguguggaucgaggacaacccguggauggaggacaagacgcccgucaccaccugggaggacgugcccuaccucgggaagcgggaggaccaguggugcggcagccugaucgggcugaccagccgcgccacgugggcccagaacauccucaccgcgauccagcagguccggucccugaucggcaacgaggaguuccuggacuacaugcccagcaugaagcgcuuccggaaggaggaggaguccgagggggccaucugguga

SEQ ID NO: 10392 - RNA, 9873 nt, Artificial Sequence
  derived and/or modified CDS sequence (opt1) from DENV-3__AY858046__SS-prME
accagccugugccucaugaugaugcugcccgccacccuggccuuccaccucaccagccgcgacggggagccccggaugaucguggggaagaacgagcgcggcaagagccugcuguucaagaccgccuccgggaucaacaugugcacccucaucgccauggaccugggcgagaugugcgacgacaccaucaccuacaagugcccccugaucaccgagguggagcccgaggacaucgacugcuggugcaaccucaccagcaccugggugacguacgggaccugcaaccaggugggcgagcaccggcgcgacaagcgguccgucgcccuggcgccccacgugggcauggggcuggacacccgcgcccagaccuggaugagcgcggagggcgccuggcggcaggucgagaaggucgagacgugggccuuccgccaccccggguucaccauccucgcccuguuccuggcgcacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggccacgcuccggaagcugugcaucgagggcaagaucaccaacgugaccaccgacagccgcugccccacgcagggcgaggcgauccugccggaggagcaggaccagaacuacgucugcaagcacaccuacguggaccggggguggggcaacgggugcggccucuucgggaagggcucccuggugaccugcgccaaguuccagugccuggagcucaucgagggcaaggucgugcagcacgagaaccugaaguacaccgugaucaucacgguccacaccggggaccagcaccaggugggcaacgagacccagggggucaccgccgagaucacgccccaggccagcaccguggaggccauccugcccgaguacggcacccucgggcuggagugcagcccccgcaccggccuggacuucaacgagaugauccuccugaccaugaagaacaaggcguggauggugcaccggcagugguucuucgaccugccgcuccccuggacgagcggcgccaccaccgagacccccacguggaacaagaaggagcugcuggucaccuucaagaacgcccacgccaagaagcaggagguggugguccucgggucccaggagggcgccaugcacaccgcgcugaccggggccacggagauccagaccagcggcgggaccuccaucuucgccggccaccugaagugccgccucaagauggacaagcuggagcugaagggcaugagcuacgccaugugcuccaacgccuucgugcucaagaaggaggugagcgagacccagcacgggacgauccugaucaaggucgaguacaagggcgaggacgcgcccugcaagaucccguucagcaccgaggacgggcagggcaaggcccacaacggccggcugaucaccgccaaccccguggugaccaagaaggaggagcccgucaacaucgaggccgagcccccguucggggaguccaacaucaucaucggcaucggggacaaggcgcugaagaucaacugguacaagaagggcagcuccaucgggaagauguucgaggccacggcccgcggcgcccggcgcauggccauccucggcgacaccgcgugggacuucgggagcgugggcggggugcugaacucccugggcaagaugguccaccagaucuucgggagcgccuacaccgcccucuucuccggcgugagcuggaucaugaagaucggcaucggggugcugcugaccuggaucggccucaacuccaagaacacgagcauguccuucagcugcaucgucaucgggaucaucacccuguaccugggcgccguggugcaggccgacauggggugcgucaucaacuggaagggcaaggagcucaagugcggcuccgggaucuucgugaccaacgaggugcacaccuggacggagcaguacaaguuccaggcggacagccccaagcggcuggccaccgccaucgccggcgccugggagaacggggucugcggcauccgcuccaccacccgcauggagaaccugcucuggaagcagaucgcgaacgagcugaacuacauccugugggagaacaacaucaagcucacggugguggucggggacaucaucggcgugcuggagcagggcaagcggacccugacgccccagcccauggagcucaaguacagcuggaagaccugggggaaggccaagaucgugacggccgagauccagaacuccagcuucaucaucgacggcccgaacacccccgagugccccaacgccucccgcgcguggaacgucugggagguggaggacuacggguucggcguguucaccaccaacaucuggcugaagcugcgggagauguacacgcagcucugcgaccaccgccugaugagcgccgccgucaaggacgagcgggccgugcacgccgacaugggcuacuggaucgagagccagaagaacggguccuggaagcuggagaaggcgagccucaucgaggugaagaccugcaccuggcccaagucccacacccuguggagcaacggcguccuggaguccgacaugaucauccccaagucccucgccgggcccaucucccagcacaacuaccgccccggcuaccacacccagacggccgggccguggcaccugggcaagcuggagcucgacuucaacuacugcgagggcaccaccguggugaucaccgagaacugcgggacgcggggccccagccugcgcaccaccaccgucuccgggaagcugauccacgaguggugcugccggagcugcacgcugccgccccuccgcuacaugggcgaggacgggugcugguacggcauggagauccggccgaucaacgagaaggaggagaacauggugaagucccuggugagcgccggcuccgggaaggucgacaacuucaccaugggcgugcucugccuggccauccuguucgaggaggugaugcgcgggaaguucggcaagaagcacaugaucgcggggguccucuucauguucgugcugcugcucagcggccagaucaccuggcgggacauggcccgcacccugaucaugaucggcuccaacgccagcgaccggauggggaugggcgugacguaccuggcccucaucgccaccuucaagauccagcccuuccuggcgcugggguucuuccuccgcaagcugaccucccgggagaaccugcuccugggcgucggccuggccauggccaccacgcuccagcugcccgaggacaucgagcagauggccaacgggaucgcgcugggccucauggcccugaagcugaucacccaguucgagaccuaccagcucuggaccgcccuggugagccugacgugcagcaacaccaucuucacccucaccguggccuggcgcacggccacccugauccuggcggggaucucccuccugcccgucugccagagcuccagcaugcggaagaccgacuggcugccgaugaccguggccgccaugggcgugccgccccugccccuguucaucuucucccugaaggacacgcucaagcgccgcagcuggccgcugaacgagggggugauggccgugggccuggucuccauccucgccagcucccugcugcggaacgacgugcccauggcgggcccccucguggccgggggccugcugaucgccugcuacgucaucaccgggaccagcgccgaccucaccguggagaaggccgcggacgugacgugggaggaggaggccgagcagaccggcgucucccacaaccugaugaucaccguggacgacgacgggaccaugcgcaucaaggacgacgagacggagaacauccugaccgugcuccugaagaccgcccugcucaucgucagcggcaucuuccccuacuccaucccggccacccugcugguguggcacaccuggcagaagcagacgcagcggagcggcgugcucugggacguccccagcccgcccgagacccagaaggccgagcuggaggaggggguguaccgcaucaagcagcagggcaucuucgggaagacccaggugggcgucggggugcagaaggagggcguguuccacaccauguggcacgucacgcggggcgcggugcugaccuacaacgggaagcgccucgagccgaacugggccagcgugaagaaggaccugaucuccuacggcgggggcuggcggcugagcgcccaguggcagaagggggaggagguccaggugaucgccguggagcccggcaagaaccccaagaacuuccagaccaugcccggcaucuuccagaccacgaccggggagaucggcgcgaucgcccuggacuucaagccggggaccuccggcagccccaucaucaaccgcgagggcaaggucguggggcucuacggcaacgggguggucaccaagaacggcggguacgugagcggcaucgcccagacgaacgccgagcccgacggcccgacccccgagcuggaggaggagauguucaagaagcggaaccugaccaucauggaccuccaccccggguccggcaagacccgcaaguaccugcccgccaucgugcgggaggcgaucaagcgccggcugcgcacgcucauccuggccccgacccgggucguggccgccgagauggaggaggcccugaaggggcuccccauccgcuaccagaccaccgcgaccaagagcgagcacaccggcaaggagaucguggaccugaugugccacgccaccuucaccaugcggcugcucucccccguccgcgugcccaacuacaaccugaucaucauggacgaggcccacuucacggacccggccagcaucgccgcgcggggguacaucuccacccgcgugggcaugggcgaggccgccgccaucuucaugaccgcgacgccgcccgggacggccgacgccuucccccagagcaacgccccgauccaggacgaggagcgggacauccccgagcgcuccuggaacagcggcaacgacuggaucaccgacuucgccgggaagaccgucugguucgugcccuccaucaaggcgggcaacgacaucgccaacugccugcgcaagaacgggaagaaggugauccagcucagccggaagaccuucgacacggaguaccagaagaccaagcugaacgacugggacuucgucgugaccaccgacaucuccgagaugggcgccaacuucaaggccgaccgcgugaucgacccccggcgcugccugaagccggucauccucacggacggccccgagcgggugauccuggccgggcccaugcccgugaccgucgcgagcgccgcccagcgccggggccgcguggggcggaacccgcagaaggagaacgaccaguacaucuucaccggccagccccugaacaacgacgaggaccacgcccacuggaccgaggccaagaugcuccuggacaacaucaacacgcccgaggggaucauccccgcgcuguucgagccggagcgcgagaaguccgccgccaucgacggcgaguaccggcucaagggcgagagccgcaagaccuucguggagcugaugcggcgcggggaccugcccgucuggcucgcccacaagguggcguccgagggcaucaaguacaccgaccggaaguggugcuucgacggggagcgcaacaaccagauccuggaggagaacauggacgucgagaucuggaccaaggagggcgagaagaagaagcugcggccccgcuggcucgacgcccggaccuacagcgacccccuggcccugaaggaguucaaggacuucgccgccggccgcaaguccaucgcgcucgaccuggugacggagaucgggcgcgugccgagccaccuggcccaccggacccgcaacgcccucgacaaccuggucaugcugcacaccuccgagcacggcgggcgggccuaccgccacgccguggaggagcuccccgagaccauggagacgcugcugcuccugggccugaugauccuccugaccgggggcgcgaugcuguuccucaucagcggcaagggggugggcaagaccagcaucgggcugaucugcgucguggccuccagcggcaugcuguggauggccgacaucccccuccaguggaucgccuccgccaucgugcuggaguucuucaugaugguccugcucaucccggagcccgagaagcagcggacgccccaggacaaccagcuggcguacguggugaucgggauccugacgcucgccgccaucgucgccgccaacgagaugggcaugcuggagaccaccaagcgcgaccugggcaugagcaaggagcccggggugguguccccgaccagcuaccucgacgucgaccugcaccccgcguccgccuggacgcuguacgccguggccaccaccgugaucacccccaugcuccggcacacgaucgagaacagcaccgcgaacgucucccuggccgccaucgccaaccaggccguggugcugaugggccucgacaagggguggcccaucagcaagauggaccugggcgucccgcugcucgcgcuggggugcuacucccaggugaacccccugacccucaccgccgccgugcugcugcucgucacgcacuacgccaucaucggccccggccugcaggccaaggcgacccgcgaggcccagaagcggaccgccgccgggaucaugaagaaccccaccguggacggcaucaugacgaucgaccuggacccggugaucuacgacagcaaguucgagaagcagcucgggcaggucaugcugcuggugcucugcgccgugcagcugcugcucaugcgcaccuccugggcguucugcgaggcccugacccuggccaccggccccaucacgacccucugggagggcagccccgggaaguucuggaacaccaccaucgccgucuccauggcgaacaucuuccggggcagcuaccuggccggggccggccuggccuucuccaucaugaaguccguggggacgggcaagcgcggcaccgggucccagggcgagacccucggggagaaguggaagaagaagcugaaccagcugagccggaaggaguucgaccucuacaagaaguccggcaucaccgagguggaccgcacggaggccaaggaggggcugcggcgcggcgagaucacccaccacgcggucucccggggcagcgccaagcugcagugguucguggagcgcaacauggugauccccgaggggcgggucaucgaccucggcugcgggcgcggcgggugguccuacuacugcgccggccugaagaaggugaccgaggugcggggcuacaccaagggcgggccggggcacgaggagcccguccccaugagcaccuacggcuggaacaucgugaagcugauguccgggaaggacguguucuaccucccgcccgagaagugcgacacgcugcugugcgacaucggcgagagcucccccagccccaccgucgaggagucccgcaccauccgcgugcugaagaugguggagcccuggcucaagaacaaccaguucugcaucaagguccugaaccccuacaugcccaccgugaucgagcaccuggagcggcuccagcgcaagcacggcgggaugcuggugcggaacccccugagccgcaacuccacgcacgagauguacuggaucagcaacggcaccgggaacaucgucuccagcgugaacauggugucccggcuccugcugaaccgcuucaccaugaccuaccggcgccccacgaucgagaaggacgucgaccucggcgccggcacccggcacgugaacgccgagccggagacccccaacauggacgucaucggggagcgcauccggcgcaucaaggaggagcacagcuccaccuggcacuacgacgacgagaaccccuacaagacgugggcguaccacggcagcuacgaggugaaggccaccggguccgccagcagcaugaucaacggcguggucaagcugcugaccaagccgugggacguggugcccaccgucacgcagauggccaugaccgacaccacccccuucgggcagcagcggguguucaaggagaagguggacacgcgcacccccaagccgaugcccggcacccggaaggccauggagaucaccgcgggcuggcucuggcgcacgcuggggcggaacaagcgcccccggcugugcacccgcgaggaguucaccaagaagguccgcaccaacgccgccaugggcgccguguucacggaggagaaccagugggacuccgcgcgggccgccguggaggacgaggaguucuggaagcucgucgaccgcgagcgggagcugcacaagcaggggaagugcggcagcugcguguacaacaugauggggaagcgcgagaagaagcugggcgaguucggcaaggccaaggggucccgggccaucugguacauguggcucggcgcgcgcuaccuggaguucgaggcccugggguuccucaacgaggaccacugguucagccgggagaacuccuacagcggcguggagggggagggccugcacaagcugggcuacauccuccgcgacaucuccaagauccccgggggcgccauguacgccgacgacaccgccgggugggacacccggaucaccgaggacgaccugcacaacgaggagaagaucacgcagcagauggacccggagcaccgccagcuggcgaacgccaucuucaagcucaccuaccagaacaaggucgugaaggugcagcggcccacccccaagggcaccgucauggacaucaucagccgcaaggaccagcggggcuccggccaggugggcacguacgggcugaacaccuucaccaacauggaggugcagcugauccgccagauggagggcgaggggguccucagcaagaccgaccuggagaacccccaccuccucgagaagaagaucacccaguggcuggagacgaagggcguggagcggcugaagcgcauggccaucuccggcgacgacugcguggucaagccgaucgacgaccgguucgccaacgcccuccuggcgcugaacgacauggggaaggugcgcaaggacaucccccaguggcagcccagcaagggcuggcacgacuggcagcagguccccuucugcucccaccacuuccacgagcucaucaugaaggacgggcggaagcuggucgugccgugccgcccccaggacgagcugaucggccgggcccgcaucagccagggggccggcuggucccucaaggagaccgccugccugggcaaggccuacgcgcagaugugggcccugauguacuuccaccgccgggaccuccgccuggccagcaacgccaucugcuccgcggugcccguccacugggugcccaccagccggaccacgugguccauccacgcccaccaccaguggaugaccaccgaggacaugcugaccguguggaaccgcgucuggaucgaggacaacccguggauggaggacaagacgcccgugaccaccugggaggacgugcccuaccucgggaagcgggaggaccaguggugcggcagccugaucgggcugaccagccgcgccacgugggcccagaacauccucaccgccauccagcagguccggucccugaucggcaacgaggaguuccuggacuacaugcccagcaugaagcgcuuccggaaggaggaggaguccgagggggcgaucugguga

SEQ ID NO: 10393 - RNA, 9873 nt, Artificial Sequence
  derived and/or modified CDS sequence (opt1) from DENV-3__AY858047__SS-prME
accagccugugccucaugaugaugcugcccgccacccuggccuuccaccucaccagccgcgacggcgagccccggaugaucguggggaagaacgagcgcggcaagagccugcuguucaagaccgccuccgggaucaacaugugcacccucaucgccauggaccugggcgagaugugcgacgacaccgugaccuacaagugcccccugaucaccgagguggagcccgaggacaucgacugcuggugcaaccucaccagcaccugggugacguacgggaccugcaaccaggccggcgagcaccggcgcgacaagcgguccguggcccuggcgccccacgugggcauggggcuggacacccgcgcgcagaccuggaugagcgccgagggcgccuggcggcaggucgagaagguggagacgugggccuuccgccaccccggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacgugaccaccgacagccgcugccccacgcagggcgaggccauccugcccgaggagcaggaccagaacuacgucugcaagcacaccuacguggaccggggguggggcaacgggugcggccucuucgggaagggcucccuggugaccugcgccaaguuccagugccuggagcucaucgagggcaaggucgugcagcacgagaaccugaaguacaccgugaucaucacgguccacaccggggaccagcaccaggugggcaacgagacccagggggucaccgccgagaucacgccccaggccagcaccguggaggcgauccugcccgaguacggcacccucgggcuggagugcagcccccggaccggccuggacuucaacgagaugauccuccugaccaugaagaacaaggccuggauggugcaccggcagugguucuucgaccugccgcuccccuggacgagcggcgccaccaccgagacccccacguggaacaagaaggagcugcuggucaccuucaagaacgcccacgccaagaagcaggagguggugguccucgggucccaggagggcgcgaugcacaccgcccugaccggggccacggagauccagaccagcggcgggaccuccaucuucgccggccaccugaagugccgccucaagauggacaagcuggagcugaagggcaugagcuacgccaugugcuccaacgcguucgugcucaagaaggaggugagcgagacccagcacgggacgauccugaucaaggucgaguacaagggcgaggacgcccccugcaagauccccuucagcaccgaggacgggcagggcaaggcccacaacggccggcugaucaccgccaaccccguggugaccaagaaggaggagcccgucaacaucgaggcggagcccccguucggggaguccaacaucaucaucggcaucggggacaaggcccugaagaucaacugguacaagaagggcagcuccaucgggaagauguucgaggccacggcccgcggcgcccggcgcauggcgauccucggcgacaccgccugggacuucgggagcgugggcggggugcugaacucccugggcaagaugguccaccagaucuucgggagcgccuacaccgcccucuucuccggcgugagcuggaucaugaagaucggcaucggggugcugcugaccuggaucggccucaacuccaagaacacgagcauguccuucagcugcaucgucaucgggaucaucacccuguaccugggcgccguggugcaggcggacauggggugcgucaucaacuggaagggcaaggagcucaagugcggcuccgggaucuucgugaccaacgaggugcacaccuggacggagcaguacaaguuccaggccgacagccccaagcggcuggccaccgccaucgccggcgcgugggagaacggggucugcggcauccgcuccaccacccgcauggagaaccugcucuggaagcagaucgccaacgagcugaacuacauccugugggagaacaacaucaagcucacggugguggucggggacaucaucggcauccuggagcagggcaagcggacccugacgccccagcccauggagcucaaguacagcuggaagaccugggggaaggccaagaucgugacggccgagauccagaacuccagcuucaucaucgacggcccgaacacccccgagugccccaacgcgucccgcgccuggaacgugugggaggucgaggacuacggguucggcguguucaccaccaacaucuggcugaagcugcgggagauguacagccagcucugcgaccaccgccugaugagcgccgccgugaaggacgagcgggccguccacgcggacaugggcuacuggaucgagucccagaagaacgggagcuggaagcuggagaaggccucccucaucgaggugaagacgugcaccuggcccaagagccacacccugugguccaacggcgugcuggagagcgacaugaucaucccgaagucccucgccgggcccaucagccagcacaacuaccgccccggcuaccacacccagaccgccgggccguggcaccugggcaagcuggagcucgacuucaacuacugcgagggcacgaccgucgugaucaccgagaacugcgggacccggggccccucccugcgcacgaccaccgugagcgggaagcugauccacgaguggugcugccgguccugcacccugccgccccuccgcuacaugggcgaggacgggugcugguacggcauggagauccggccgaucaacgagaaggaggagaacauggucaagagccugguguccgccggcagcgggaagguggacaacuucacgaugggcguccucugccuggcgauccuguucgaggaggugaugcgcgggaaguucggcaagaagcacaugaucgccgggguccucuucaccuucguccugcugcucuccggccagaucaccuggcgggacauggcccgcacccugaucaugaucggcagcaacgccuccgaccggauggggaugggcgugacguaccuggcccucaucgcgaccuucaagauccagcccuuccuggcccugggguucuuccuccgcaagcugaccagccgggagaaccugcuccugggcgugggccuggccauggccaccacgcuccagcugcccgaggacaucgagcagauggcgaacgggaucgcccugggccucauggcccugaagcugaucacccaguucgagaccuaccagcucuggaccgcccuggucagccugaugugcuccaacacgaucuucacccucaccguggccuggcgcaccgcgacgcugauccuggccgggaucagccuccugccccugugccaguccagcuccaugcggaagaccgacuggcucccgaugaccguggccgccaugggcgugccgccccugccccuguucaucuucagccucaaggacacccugaagcgccgcuccuggccgcugaacgagggggugauggccgucggccucgugagcauccuggcguccagccugcuccggaacgacgugcccauggccggcccccuggucgccgggggccugcucaucgccugcuacgugaucacggggaccuccgccgaccugaccguggagaaggcggccgacgucaccugggaggaggaggccgagcagacgggcgugagccacaaccugaugaucaccguggacgacgacgggaccaugcgcaucaaggacgacgagaccgagaacauccucacgguccugcugaagaccgcccuccugaucguguccggcaucuuccccuacagcaucccggccacccugcucguguggcacaccuggcagaagcggacccagcgcuccggcguccugugggacgugcccuccccgcccgagacgcagaaggcggagcuggaggaggggguguaccggaucaagcagcagggcauccucgggaagacccaggucggcgugggggugcagaaggagggcgucuuccacaccauguggcacgugacccgcggcgccgugcugacguacaacgggaagcggcuggagccgaacugggccuccgucaagaaggaccugaucagcuacggcgggggcuggcgccucuccgcccaguggcagaagggggaggagguccaggugaucgcggucgagcccggcaagaaccccaagaacuuccagaccaugcccggcaucuuccagaccaccacgggggagaucggcgccaucgcccuggacuucaagccggggaccagcggcagccccaucaucaaccgggagggcaaggugguggggcuguacggcaacggggucgugaccaagaacggcggguacguguccggcaucgcccagaccaacgccgagcccgacggcccgacgcccgagcucgaggaggagauguucaagaagcgcaaccugaccaucauggaccugcaccccgggagcggcaagacccggaaguaccuccccgcgaucguccgcgaggccaucaagcggcgccugcggacccugauccucgccccgacgcgcgugguggccgccgagauggaggaggcgcugaaggggcugcccauccgguaccagaccaccgccaccaaguccgagcacacgggcaaggagaucgucgaccucaugugccacgccaccuucaccaugcgccugcugagccccgugcgggugcccaacuacaaccucaucaucauggacgaggcccacuucaccgacccggccuccaucgcggcccgcggguacaucagcacgcgggucggcaugggcgaggccgccgcgaucuucaugaccgccacgccgcccgggaccgccgacgccuucccccaguccaacgccccgauccaggacgaggagcgcgacauccccgagcgcagcuggaacuccggcaacgacuggaucacggacuucgcggggaagaccgugugguucgugcccagcaucaaggccggcaacgacaucgccaacugccugcggaagaacgggaagaaggucauccagcugucccgcaagaccuucgacaccgaguaccagaagacgaagcucaacgacugggacuucguggugaccaccgacaucagcgagaugggcgccaacuucaaggccgaccgggucaucgacccccgccggugccugaagccggugauccugaccgacggccccgagcgcgugauccucgcggggcccaugcccgucacgguggccuccgccgcccagcggcgcggccggguggggcgcaacccgcagaaggagaacgaccaguacaucuucaccggccagccccugaacaacgacgaggaccacgcccacuggaccgaggcgaagaugcugcucgacaacaucaacacccccgaggggaucauccccgcccuguucgagccggagcgggagaaguccgccgccaucgacggcgaguaccgccugaagggcgagucccggaagacguucgucgagcucaugcgccgcggggaccugcccguguggcuggcgcacaagguggccagcgagggcaucaaguacaccgaccgcaaguggugcuucgacggggagcggaacaaccagauccucgaggagaacauggacgucgagaucuggaccaaggagggcgagaagaagaagcugcgcccccgguggcuggacgcccgcaccuacuccgacccccucgcccugaaggaguucaaggacuucgccgcgggccgcaagagcaucgcccuggaccucgugaccgagaucgggcgggucccgucccaccuggcccaccgcacgcggaacgcccuggacaaccucgugaugcugcacaccagcgagcacggcgggcgcgccuaccggcacgcgguggaggagcugcccgagaccauggagacccuccugcugcucggccugaugauccugcucaccggcggggucaugcuguuccugaucagcgggaagggggugggcaagaccuccaucgggcucaucugcguggucgccagcuccggcaugcuguggauggccgacaucccccugcaguggaucgccagcgccaucgugcucgaguucuucaugauggugcugcugaucccggagcccgagaagcagcgcacgccccaggacaaccagcucgcguacgucgugaucgggauccugacccuggccgccaucguggccgccaacgagaugggccuccuggagacgaccaagcgggaccugggcauguccaaggagcccggggucgcgagcccgaccuccuaccucgacguggaccugcaccccgccagcgccuggacccuguacgccguggcgacgaccgucaucacccccaugcuccgccacaccaucgagaacuccacggccaacgugagccuggccgccaucgccaaccaggcggugguccugaugggccucgacaagggguggcccaucuccaagauggaccugggcgugccgcugcucgcccuggggugcuacagccaggugaacccccugacccucaccgccgccguccugcugcucgugacccacuacgccaucaucggccccggccugcaggcgaaggccacgcgggaggcccagaagcgcaccgccgccgggaucaugaagaaccccaccguggacggcaucaugaccaucgaccuggacccggucaucuacgacuccaaguucgagaagcagcucggccaggugaugcugcuggugcucugcgcgguccagcugcugcucaugcggacgagcugggccuucugcgaggcccugacccuggccaccggccccaucaccacgcucugggagggcucccccgggaaguucuggaacaccaccaucgcggugagcauggccaacaucuuccgcggcuccuaccuggccggggccggccuggccuucagcaucaugaaguccguggggaccggcaagcggggcacggggagccagggcgagacccucggggagaaguggaagaagaagcugaaccagcugagccgcaaggaguucgaccucuacaagaaguccggcaucaccgaggucgaccggaccgaggcgaaggaggggcugaagcgcggcgagaucacgcaccacgccgugagccggggcuccgccaagcugcagugguucguggagcgcaacauggucauccccgaggggcgggugaucgaccucggcugcgggcgcggcggguggagcuacuacugcgccggccugaagaaggugaccgagguccggggcuacaccaagggcgggccggggcacgaggagcccgugcccauguccaccuacggcuggaacaucgugaagcugaugagcgggaaggacgucuucuaccugcccccggagaagugcgacacccuccugugcgacaucggcgaguccagccccucccccacgguggaggagagccgcaccauccgcgugcugaagauggucgagcccuggcucaagaacaaccaguucugcaucaaggugcugaacccguacaugcccgccgugaucgagcaccuggagcggcuccagcgcaagcacggcgggaugcugguccggaacccccugucccgcaacagcacccacgagauguacuggaucuccaacggcaccgggaacaucgugagcuccgugaacauggucagccggcuccugcugaaccgcuucacgaugaccuaccggcgccccaccaucgagaaggacguggaccucggcgcgggcacccggcacgugaacgccgagccggagacgcccaacauggacgucaucggggagcgcauccggcgcaucaaggaggagcacuccagcaccuggcacuacgacgacgagaaccccuacaagaccugggccuaccacggcuccuacgaggugaaggccaccgggagcgccagcuccaugaucaacggcgucgugaagcugcugacgaagccgugggacgugguccccaccgugacccagauggcgaugaccgacacgacccccuucgggcagcagcggguguucaaggagaaggucgacacccgcacccccaagccgaugcccggcacgcggaaggugauggagaucaccgccgaguggcucuggcgcacccugggccggaacaagcgcccccggcugugcacccgcgaggaguucacgaagaaggugcgcaccaacgccgccaugggggcggucuucaccgaggagaaccagugggacagcgccaaggccgccguggaggacgaggaguucuggaagcucguggaccgggagcgcgagcugcacaagcugggcaagugcggguccugcgucuacaacaugaugggcaagcgggagaagaagcucggggaguucggcaaggccaagggcagccgcgcgaucugguacauguggcugggggcccgguaccuggaguucgaggcccucggcuuccugaacgaggaccacugguucucccgcgagaacagcuacuccgggguggagggcgaggggcugcacaagcucggcuacauccugcgggacaucagcaagauccccggcggggccauguacgccgacgacaccgcgggcugggacacgcgcaucaccgaggacgaccugcacaacgaggagaagaucacccagcagauggacccggagcaccggcagcucgccaacgccaucuucaagcugaccuaccagaacaagguggucaaggugcagcgccccacgcccaaggggaccgugauggacaucaucucccggaaggaccagcgcggcagcggccaggucgggaccuacggccugaacaccuucacgaacauggaggcccagcucauccggcagauggagggggagggcgugcuguccaagaccgaccuggagaacccccaccuccuggagaagaagaucacccaguggcuggagaccaaggggguggagcgccucaagcggauggccaucagcggcgacgacugcgucgugaagccgaucgacgaccgcuucgcgaacgcccugcuggcccucaacgacaugggcaaggugcggaaggacaucccccaguggcagcccuccaagggguggcacgacuggcagcagguccccuucugcagccaccacuuccacgagcugaucaugaaggacggccgcaagcugguggugccgugccggccccaggacgagcucaucgggcgcgcccggaucucccagggcgccggguggagccugaaggagaccgcgugccugggcaaggccuacgcccagaugugggcccucauguacuuccaccgccgcgaccugcggcuggcguccaacgccaucugcagcgccguccccgugcacugggugcccacgucccgcaccaccuggagcauccacgcccaccaccaguggaugaccacggaggacaugcucaucgucuggaaccggguguggaucgaggacaacccguggauggaggacaagacccccgugaccaccugggaggacguccccuaccugggcaagcgcgaggaccaguggugcgggagccugaucggccucacgucccgggccaccugggcgcagaacauccugaccgccauccagcagguccgcagccugaucgggaacgaggaguuccucgacuacaugcccuccaugaagcgguuccgcaaggaggaggagagcgagggcgccaucugguga

SEQ ID NO: 10394 - RNA, 9873 nt, Artificial Sequence
  derived and/or modified CDS sequence (opt1) from DENV-3__HQ332170__SS-prME
accagccugugccucaugaugauccugcccgccgcccuggcguuccaccucaccagccgggacggggagccgcggaugaucguggggaagaacgagcggggcaagagccugcuguucaagaccgccuccgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggaccugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcgcaccggccuggacuucaacgagaugauccugcucacgaugaagaacaaggccuggauggugcaccggcagugguucuucgaccugccccugcccuggaccagcggcgccaccaccgagacgcccaccuggaaccgcaaggagcuccuggugaccuucaagaacgcccacgccaagaagcaggaggucguggugcuggggucccaggagggcgcgaugcacaccgcccucacgggggccaccgagauccagaacagcggcgggaccuccaucuucgccggccaccugaagugccggcugaagauggacaagcucgagcugaagggcaugagcuacgccaugugcaccaacacguucguccugaagaaggagguguccgagacccagcacgggaccauccucaucaagguggacuacaagggcgaggacgucccgugcaagauccccuucagcaccgaggacgggcagggcaaggcgcacaacggccgccugaucacggccaaccccguggugaccaagaaggaggagcccgucaacaucgaggccgagccgcccuucggggagagcaacaucgugaucggcaucggggacaacgcccugaagaucaacugguacaagaagggcuccagcaucgggaagauguucgaggcgaccgcccggggcgcccgccggauggccauccugggcgacaccgccugggacuucggguccgugggcgggguccucaacagccugggcaagauggugcaccagaucuucggguccgcguacacggcccuguucagcggcguguccugggucaugaagaucggcaucggggugcuccugaccuggaucggccugaacagcaagaacaccuccaugagcuucuccugcaucgccaucgggaucaucacccucuaccugggcgccgugguccaggccgacacggggugcgugaucaacuggaagggcaaggagcugaagugcggcagcgggaucuucgugaccaacgagguccacaccuggaccgagcaguacaaguuccaggcggacucccccaagcgccucgccacggccaucgccggcgccugggagaacggggugugcggcauccgcagcaccacccggauggagaaccugcuguggaagcagaucgcgaacgagcucaacuacauccugugggagaacaacaucaagcugaccguggucgugggggacaucaucggcgugcucgagcagggcaagcgcacgcugacgccccagccgauggagcugaaguacuccuggaagaccugggggaaggccaagaucgucaccgccgagacgcagaacagcuccuucaucaucgacggccccaacacccccgagugccccagcgccucccgggcguggaacgugugggagguggaggacuacggguucggcgucuucaccaccaacaucuggcucaagcugcgcgagguguacacccagcagugcgaccaccggcugaugagcgccgccgugaaggacgagcgcgccguccacgccgacaugggcuacuggaucgagagccagaagaacggguccuggaagcucgagaaggcgagccugaucgaggugaagacgugcaccuggccgaagucccacacccuguggagcaacggcgugcucgaguccgacaugaucauccccaagagccuggccgggcccaucucccagcacaacuaccggccgggcuaccacacccagacggccgggcccuggcaccugggcaagcucgagcuggacuucaacuacugcgagggcaccaccgucgugaucaccgagaacugcgggacgcgcggccccagccugcggaccaccaccguguccgggaagcucauccacgaguggugcugccgcagcugcacgcugcccccgcugcgguacaugggcgaggacgggugcugguacggcauggagauccgccccaucuccgagaaggaggagaacauggucaagagccucguguccgccggcagcggggagguggacaacuucaccaugggcguccugugccuggccauccucuucgaggaggugaugcgggggaaguucggcaagaagcacaugaucgcggggguguucuucaccuucguccugcugcucuccggccagaucaccuggcgcgacauggcccacacgcugaucaugaucggcagcaacgccuccgaccggauggggaugggcgugaccuaccuggcccucaucgccaccuucaagauccagcccuuccuggcgcugggguucuuccuccgcaagcugaccagccgggagaaccugcuccugggcgugggccuggccauggccacgacccuccagcugcccgaggacaucgagcagauggccaacgggaucgcgcugggccucauggcccugaagcugaucacccaguucgagaccuaccagcucuggacggcccugaucagccugaccugcuccaacaccaucuucacccucacggucgccuggcgcaccgccacccugauccuggcgggggugagccuccugccggucugccaguccagcuccaugcggaagaccgacuggcugcccaugacgguggccgccaugggcgugccgccccucccgcuguucaucuucagccugaaggacacccucaagcgccgcuccuggccccugaacgagggggucauggccgugggccuggugagcauccucgccuccagccugcugcggaacgacguccccauggcgggcccccucguggccgggggccugcugaucgccugcuacgugaucaccgggaccuccgccgaccucacggucgagaaggccgcggacgugaccugggaggaggaggccgagcagaccggcgugagccacaaccugaugaucaccgucgacgacgacgggaccaugcgcaucaaggacgacgagacggagaacauccugaccgugcuccugaagaccgcccugcucaucguguccggcaucuucccguacagcauccccgccacccugcuggucuggcacacguggcagaagcagacccagcgguccggcgugcucugggacgugcccagcccgcccgagacccagaaggccgagcuggaggagggggucuaccgcaucaagcagcagggcaucuucgggaagacccaggugggcguggggguccagaaggagggcguguuccacacgauguggcacgugacccggggcgcgguccugaccuacaacgggaagcgccucgagcccaacugggccuccgugaagaaggaccugaucagcuacggcgggggcuggcggcuguccgcccaguggcagaagggggaggaggugcaggucaucgccguggagcccggcaagaaccccaagaacuuccagaccaugcccggcacguuccagaccaccaccggggagaucggcgcgaucgcccucgacuucaagcccgggacgagcggcagccccaucaucaaccgcgagggcaagguggucgggcuguacggcaacgggguggugaccaagaacggcggguacgucuccggcaucgcccagaccaacgccgagccggacggccccacccccgagcuggaggaggagauguucaagaagcggaaccugacgaucauggaccuccaccccgggagcggcaagacccgcaaguaccugccggccaucgugcgggaggcgaucaagcgccggcugcgcacccucauccuggcccccacccggguggucgccgccgagauggaggaggcccugaaggggcuccccauccgcuaccagacgaccgcgaccaaguccgagcacaccggccgggagaucguggaccugaugugccacgccacguucaccaugcgccugcucagccccgugcgggucccgaacuacaaccugaucaucauggacgaggcccacuucaccgaccccgccuccaucgccgcgcgcggguacaucagcacccgggugggcaugggcgaggccgccgccaucuucaugacggcgacgccgcccgggaccgccgacgccuucccgcaguccaacgcccccauccaggacgaggagcgcgacauccccgagcgcagcuggaacuccggcaacgaguggaucaccgacuucgccgggaagacggugugguucguccccagcaucaaggcgggcaacgacaucgccaacugccugcggaagaacgggaagaaggugauccagcucucccgcaagaccuucgacaccgaguaccagaagaccaagcugaacgacugggacuucguggucacgaccgacaucagcgagaugggcgccaacuucaaggccgaccgggugaucgacccgcgccggugccugaagcccgugauccucaccgacggccccgagcgcgucauccuggccgggcccaugccggugaccgcggccuccgccgcccagcggcgcggccggguggggcgcaacccccagaaggagaacgaccaguacaucuucaccggccagccccugaacaacgacgaggaccacgcccacuggacggaggcgaagaugcuccuggacaacaucaacacccccgaggggaucaucccggcccuguucgagcccgagcgggagaaguccgccgccaucgacggcgaguaccgccucaagggcgagucccggaagaccuucgucgagcugaugcgccgcggggaccugcccguguggcucgcgcacaaggucgccagcgagggcaucaaguacaccgaccgcaaguggugcuucgacgggcagcggaacaaccagauccuggaggagaacauggacguggagaucuggacgaaggagggcgagaagaagaagcugcgcccccgguggcucgacgcccgcaccuacuccgacccgcuggcccugaaggaguucaaggacuucgccgcgggccgcaagagcaucgcccucgaccuggugaccgagaucgggcggguccccucccaccuggcccaccgcacccggaacgcccucgacaaccuggugaugcugcacacgagcgagcacggcgggaaggccuaccgccacgcgguggaggagcuccccgagaccauggagacccugcugcuccugggccugaugauccuccugaccgggggcgccaugcuguuccucaucagcggcaaggggaucggcaagacguccaucgggcugaucugcgucaucgccagcuccggcaugcuguggauggccgagaucccgcuccaguggaucgccagcgcgaucgugcuggaguucuucaugauggugcugcucauccccgagcccgagaagcagcggacgccccaggacaaccagcuggccuacgucgugaucgggauccugacccucgccgccaucaucgccgcgaacgagaugggccugcuggagaccacgaagcgcgaccucggcauguccaaggagccggggguggucagccccaccuccuaccuggacguggaccugcaccccgccagcgccuggacccucuacgccguggcgaccacggucaucacccccaugcugcggcacaccaucgagaacuccaccgccaacgugagccuggccgccaucgccaaccaggcggugguccucaugggccuggacaagggguggccgaucuccaagauggaccugggcgugccccuccuggcccuggggugcuacagccaggugaacccccucacgcugaccgccgccguccugcuccugaucacccacuacgccaucaucggccccggccugcaggcgaaggccacccgcgaggcccagaagcggacggccgccgggaucaugaagaacccgaccguggacggcaucaugaccaucgaccucgaccccgugaucuacgacuccaaguucgagaagcagcuggggcaggucaugcugcucgugcugugcgcggugcagcugcuccugaugcgcaccagcugggcccugugcgaggcccucacgcuggccaccggccccaucaccacccugugggagggcucccccgggaaguucuggaacacgaccaucgcggucagcauggccaacaucuuccggggcuccuaccucgccggggccggccuggccuucagcaucaugaaguccguggggaccggcaagcgcggcaccgggagccagggcgagacccugggggagaaguggaagaagaagcucaaccagcugagccggaaggaguucgaccuguacaagaaguccggcaucacggagguggaccgcaccgaggcgaaggaggggcucaagcggggcgagaucacccaccacgccgucagccgcggcuccgccaagcugcagugguucguggagcggagcauggugaucccggaggggcgcgucaucgaccugggcugcgggcggggcgggugguccuacuacugcgccggccucaagaaggugaccgaggugcgcggcuacacgaagggcgggcccgggcacgaggagcccguccccaugagcaccuacggcuggaacaucgugaagcugauguccgggaaggacguguucuaccugccgcccgagaagugcgacacccuccugugcgacaucggcgagagcucccccagccccaccgucgaggagucccggacgauccgcgugcugaagaugguggagccguggcugaagaacaaccaguucugcaucaagguccucaaccccuacaugcccaccgugaucgagcaccuggagcgccugcagcggaagcacggcgggaugcucgugcgcaacccccugagccggaacuccacccacgagauguacuggaucagcaacggcaccgggaacaucgucgccuccgugaacauggugagccgccugcuccugaaccgguucacgaugacccaccgccggccgaccaucgagaaggacgucgaccugggcgcgggcacccgccacgugaacgccgagcccgagacgcccaacauggacgugaucggggagcggaucaagcgcaucaaggaggagcacaacuccaccuggcacuacgacgacgagaacccguacaagaccugggccuaccacggcagcuacgaggucaaggccaccggguccgccagcagcaugaucaacggcguggucaagcuccugacgaagcccugggacguggugcccauggucacccagauggcgaugaccgacaccacgcccuucgggcagcagcggguguucaaggagaagguggacacccgcaccccgcgguccaugcccggcacccgccgggucaugggcaucacggccgaguggcuguggcgcacccucgggcggaacaagaagccccgccugugcacccgggaggaguucaccaagaaggugcgcacgaacgccgccaugggcgcgguguucaccgaggagaaccagugggacagcgccaaggccgccgucgaggacgaggacuucuggaagcugguggaccgcgagcgggagcuccacaagcuggggaagugcggcuccugcguguacaacaugauggggaagcgcgagaagaagcugggcgaguucggcaaggccaaggggagccgggcgaucugguacauguggcucggcgcccgcuaccuggaguucgaggcccugggguuccucaacgaggaccacugguucucccgggagaacagcuacuccggcgucgagggggagggccugcacaagcugggcuacauccuccgcgacaucagcaagauccccgggggcgccauguacgccgacgacaccgcggggugggacacccggaucacggaggacgaccugcacaacgaggagaagaucacccagcagauggacccggagcacaagcagcuggccaacgccaucuucaagcucaccuaccagaacaagguggugaagguccagcgccccacccccaccggcacggugauggacaucaucucccggaaggaccagcgcggcagcggccaggugggcaccuacgggcugaacaccuucaccaacauggaggcccagcugauccggcagauggagggcgaggggguccucuccaaggccgaccuggagaacccccaccuccccgagaagaagaucacgcaguggcuggagaccaagggcguggagcgccugaagcggauggcgaucagcggcgacgacugcguggucaagcccaucgacgaccgcuucgccaacgcccugcucgcccugaacgacauggggaaggugcggaaggacaucccccaguggcagcccuccaagggcuggcacgacuggcagcaggucccguucugcagccaccacuuccacgagcugaucaugaaggacgggcgcaagcucgucgugcccugccggccccaggacgagcugaucggccgcgcccggaucucccagggggcgggcuggagccugcgcgagaccgccugccucggcaaggccuacgcccagauguggucccugauguacuuccaccggcgcgaccugcgccucgcgagcaacgccaucugcuccgccgugcccguccacugggugccgaccagccggacgaccuggagcauccacgcccaccaccaguggaugaccaccgaggacaugcugacgguguggaaccgcgucuggaucgaggacaaccccuggauggaggacaagacccccgugaccaccugggagaacgugcccuaccuggggaagcgggaggaccaguggugcggcucccucaucgggcugacgagccgcgccaccugggcgcagaacaucccgaccgccauccagcagguccggucccugaucggcaacgaggaguuccucgacuacaugcccagcaugaagcgcuuccggaaggaggaggaguccgagggggccaucugguga

SEQ ID NO: 10395 - RNA, 9873 nt, Artificial Sequence
  derived and/or modified CDS sequence (opt1) from DENV-3__AY858038__SS-prME
accagccugugccucaugaugaugcugcccgccacccuggccuuccaccucaccagccgggacggcgagccgcggaugaucguggggaagaacgagcggggcaagagccugcuguucaagaccgccuccgggaucaacaugugcacccucaucgccauggaccugggcgagaugugcgacgacaccgugacguacaagugcccccugaucaccgagguggagcccgaggacaucgacugcuggugcaaccucaccagcaccugggugacguacgggaccugcaaccaggccggcgagcaccggcgcgacaagcgguccguggcccuggcgccccacgugggcauggggcuggacacccgcacccagacguggaugagcgcggagggcgccuggcgccagguggagaagguggagaccugggccuuccgccacccgggguucaccauccucgcccuguuccuggcgcacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacgugaccacggacagccgcugccccacccagggcgaggcgauccugccggaggagcaggaccagaacuacgucugcaagcacaccuacguggaccggggguggggcaacgggugcggccucuucgggaagggcucccuggugaccugcgccaaguuccagugccuggagagcaucgagggcaaggucgugcagcacgagaaccucaaguacacggugaucaucaccguccacaccggggaccagcaccaggugggcaacgagacccagggggucacggccgagaucacgccccaggccuccaccguggaggccauccugcccgaguacggcacccuggggcucgagugcagcccccgcaccggccuggacuucaacgagaugauccugcucacgaugaagaacaaggcguggauggugcaccggcagugguucuucgaccugccgcugcccuggaccuccggcgccaccaccgagacgcccaccuggaacaagaaggagcuccuggucaccuucaagaacgcccacgccaagaagcaggagguggugguccuggggagccaggagggcgccaugcacaccgcgcucacgggggccaccgagauccagaccuccggcgggaccagcaucuucgccggccaccugaagugccgccugaagauggacaagcucgagcugaagggcauguccuacgccaugugccugaacgccuucgugcucaagaaggaggugagcgagacgcagcacgggaccauccugaucaaggucgaguacaagggcgaggacgcgcccugcaagaucccguucagcaccgaggacgggcagggcaaggcccacaacggccggcugaucaccgccaaccccguggugacgaagaaggaggagcccgucaacaucgaggccgagcccccguucggggaguccaacaucgugaucggcaucggggacaaggcgcugaagaucaacugguacaagaagggcagcuccaucgggaagauguucgaggccaccgcccgcggcgcccggcgcauggccauccucggcgacaccgcgugggacuucgggagcgugggcgggguccugaacucccugggcaagauggugcaccagaucuucgggagcgccuacaccgcccucuucuccggcgugagcuggaucaugaagaucggcaucgggguccugcugacguggaucggccucaacuccaagaacaccagcauguccuucagcugcaucgccaucgggaucaucacccuguaccugggcgccguggugcaggcggacauggggugcgucaucaacuggaagggcaaggagcucaagugcggcuccgggaucuucgugaccaacgaggugcacacguggaccgagcaguacaaguuccaggccgacagccccaagcggcuggccaccgccaucgccggcgcgugggagaacggggucugcggcauccgcuccaccacgcgcauggagaaccugcucuggaagcagaucgccaacgagcugaacuacauccugugggagaacaacauccggcucaccgugguggucggggacaccaucggcgugcugcagcagggcaagcgcacccugccgccccagccgauggagcucaaguacagcuggaagacgugggggaaggccaagaucgugaccgccaagacccagaacuccagcuucaucaucgacggccccaacacccccgaguggcccuccgcgagccgggccuggaacgucugggagguggaggacuacggguucggcguguucacgaccaacaucuggcugaagcugcgcgagauguacacccagcucugcgaccaccggcugaugagcgccgccgucaaggacgagcgcgccgugcacgcggacaugggcuacuggaucgagucccagaagaacgggagcuggaagcuggagaaggccucccucaucgaggugaagaccugcaccuggcccaagagccacacgcugugguccaacggcguccuggagagcgacaugaucauccccaagucccucgccgggcccaucagccagcacaacuaccggccgggcuaccacacccagaccgccgggcccuggcaccugggcaagcuggagcucgacuucaacuacugcgagggcaccacgguggugaucaccgagaacugcgggacccgcggccccucccugcggaccacgaccgucagcgggaagcugauccacgaguggugcugccgcuccugcacccugccgccccugcgguacaugggcgaggacgggugcugguacggcauggagauccgccccaucaacgagaaggaggagaacauggucaagagccugguguccgccggcagcgggaaggucgacaacuucaccaugggcgugcucugccuggcgauccuguucgaggaggugaugcgggggaaguucggcaagaagcacaugaucgccgggguccucuucacguucgugcugcugcucuccggccagaucaccuggcgcgacauggcccggacccugaucaugaucggcagcaacgccuccgaccgcauggggaugggcgugaccuaccuggcccucaucgcgacguucaagauccagcccuuccuggcccugggguucuuccuccggaagcugaccagccgcgagaaccugcuccugggcgucggccuggccauggccaccacccuccagcugcccgaggacaucgagcagauggcgaacgggaucgcccugggccucauggcccugaagcuggugacgcaguucgagaccuaccagcucuggaccgcccuggugagccugaugugcuccaacaccaucuucacgcucaccgucgccuggcggaccgcgacccugauccuggccgggaucagccuccugcccgugugccaguccagcuccaugcgcaagacggacuggcugcccaugaccgucgccgccaugggcgugccgccccucccgcuguucaucuucagccugaaggacacccucaagcgccgguccuggccccugaacgagggggugauggccgucggccuggugagcauccucgcguccagccugcugcgcaacgacgugcccauggccggcccccucgucgccgggggccugcugaucgccugcuacgugaucaccgggacguccgccgaccucaccguggagaaggcggccgacgucaucugggaggaggaggccgagcagaccggcgugagccacaaccugaugaucaccguggacgacgacgggacgaugcggaucaaggacgacgagaccgagaacauccugaccguccuccugaagaccgcccugcucaucguguccggcaucuucccguacagcauccccgccacccugcugguguggcacacguggcagaagcagacccagcgcuccggcguccucugggacgugcccagcccgcccgagacccagaaggcggagcuggaggaggggguguaccggaucaagcagcagggcaucuucgggaagacccaggucggcgugggggugcagaaggagggcgucuuccacacgauguggcacgugacccgcggcgccgugcugacccacaacgggaagcggcucgagcccaacugggccuccgucaagaaggaccugaucagcuacggcgggggcuggcgccuguccgcccaguggcagaagggggaggagguccaggugaucgcggucgagcccggcaagaaccccaagaacuuccagaccaugcccggcaucuuccagacgaccaccggggagaucggcgccaucgcccuggacuucaagcccgggaccagcggcagccccaucaucaaccgggagggcaaggugguggggcucuacggcaacggggucgugacgaagaacggcggguacguguccggcaucgcccagaccaacgccgagccggacggccccacccccgagcuggaggaggagauguucaagaagcgcaaccugaccaucauggaccuccaccccgggagcggcaagacgcggaaguaccugccggcgaucauccgcgaggccaucaagcggcgccugcggacccucauccuggcccccacccgcgucguggccgccgagauggaggaggcgcugaaggggcuccccauccgguaccagaccacggccaccaaguccgagcacaccggcaaggagaucguggaccugaugugccacgccaccuucacgaugcgccugcucagccccguccgggugccgaacuacaaccugaucaucauggacgaggcccacuucaccgaccccgccuccaucgcggcccgcggguacaucagcacccgggugggcaugggcgaggccgccgcgaucuucaugaccgccacgccgcccgggaccgccgacgccuucccgcaguccaacgcccccauccaggacgaggagcgcgacauccccgagcgcagcuggaacuccggcaacgacuggaucaccgacuucgcggggaagaccgucugguucgugcccagcaucaaggccggcaacgacaucgccaacugccugcggaagaacgggaagaaggugauccagcucucccgcaagacguucgacaccgaguaccagcggaccaagcugaacgacugggacuucgucgugaccacggacaucagcgagaugggcgccaacuucaaggccgaccgcgugaucgacccgcggcgcugccugaagcccgucauccucaccgacggccccgagcgggugauccuggcggggcccaugccggugaccgucgccuccgccgcccagcgccggggccgcguggggcggaacccccagaaggagaacgaccaguacaucuucaccggccagccccugaacaacgacgaggaccacgcccacuggacggaggcgaagaugcuccuggacaacaucaacacccccgaggggaucaucccggcccuguucgagcccgagcgcgagaaguccgccgccaucgacggcgaguaccggcucaagggcgagucccgcaagaccuucguggagcugaugcggcgcggggaccugcccgucuggcucgcgcacaagguggccagcgagggcaucaaguacaccgaccggaaguggugcuucgacggggagcgcaacaaccagauccuggaggagaacauggacgucgagaucuggaccaaggagggcgagaagaagaagcugcggccccgcuggcucgacgcccgcacguacuccgacccgcuggcccugaaggaguucaaggacuucgccgcgggccgcaagagcaucgcccucgaccuggugaccgagaucgggcgcgugcccucccaccuggcccaccggacccgcaacgcccucgacaaccuggucaugcugcacaccagcgagcacggcgggcgggccuaccgccacgcgguggaggagcuccccgagacgauggagacccugcugcuccugggccugaugauccuccugaccgggggcgccaugcuguuccucaucagcggcaaggggaucggcaagaccuccaucgggcugaucugcguggucgccagcuccggcaugcuguggauggccgacgugccgcuccaguggaucgccagcgcgaucgugcuggaguucuucaugaugguccugcucauccccgagcccgagaagcagcggacgccccaggacaaccagcuggccuacguggugaucgggauccugacccucgccgccaucgucgccgcgaacgagaugggccugcuggagaccaccaagcgcgaccucggcauguccaaggagccggggguggugagccccacguccuaccuggacgucgaccugcaccccgccagcgccuggacccucuacgccguggcgaccaccgugaucacgcccaugcugcggcacaccaucgagaacuccaccgccaacgucagccuggccgccaucgccaaccaggcgguggugcucaugggccuggacaagggguggccgaucuccaagauggaccugggcgucccccuccuggcccuggggugcuacagccaggugaacccccucacccugacggccgccgugcugcuccuggucacccacuacgccaucaucggccccggccugcaggcgaaggccacccgcgaggcccagaagcggaccgccgccgggaucaugaagaacccgacgguggacggcaucaugaccaucgaccucgaccccgugaucuacgacuccaaguucgagaagcagcuggggcaggucaugcugcucgugcugugcgcggugcagcugcuccugaugcgcaccagcugggccuucugcgaggcccugacccucgccacgggccccaucaccacccugugggagggcucccccgggaaguucuggaacaccacgaucgcggucagcauggccaacaucuuccggggcuccuaccuggccggggccggccucgccuucagcaucaugaaguccguggggaccggcaagcgcggcaccgggagccagggcgagacccugggggagaaguggaagaagaagcugaaccagcucagccggaaggaguucgaccuguacaagaaguccggcaucacggagguggaccgcaccgaggcgaaggaggggcugaagcggggcgagaucacccaccacgccgucagccgcggcuccgccaagcuccagugguucguggagcggaacauggugaucccggaggggcgcgucaucgaccugggcugcgggcggggcggguggagcuacuacugcgccggccugaagaaggugaccgaggugcgcggcuacaccaagggcgggcccgggcacgaggagcccguccccauguccacguacggcuggaacaucgugaagcucaugagcgggaaggacguguucuaccugccgcccgagaagugcgacacccugcugugcgacaucggcgaguccagccccucccccaccgucgaggagagccgcaccauccgggugcucaagaugguggagccguggcugaagaacaaccaguucugcaucaagguccugaaccccuacaugcccacggugaucgagcaccucgagcgccugcagcggaagcacggcgggaugcuggugcgcaacccccucucccggaacagcacccacgagauguacuggaucuccaacggcaccgggaacaucgucagcuccgugaacauggugagccgccugcugcucaaccgguucaccaugacgcaccgccggccgaccaucgagaaggacgucgaccugggcgccggcacccgccacgugaacgcggagcccgagacccccaacauggacgucaucggggagcggauccgccggaucaaggaggagcacuccagcacguggcacuacgacgacgagaacccguacaagaccugggccuaccacggcuccuacgaggugaaggccaccgggagcgccagcuccaugaucaacggcguggucaagcugcucaccaagcccugggacguggugcccacggucacccagauggccaugaccgacaccacgcccuucgggcagcagcgcguguucaaggagaagguggacacccggaccccgcgccccaugcccggcacccggaaggucauggagaucacggcggaguggcuguggcgcacccugggccggaacaagcgcccccgccucugcacccgggaggaguucaccaagaaggugcgcacgaacgccgccaugggggccguguucaccgaggagaaccagugggacagcgcgcgggccgccgucgaggacgaggaguucuggaagcugguggaccgcgagcgggagcugcacaagcucggcaagugcggguccugcguguacaacaugaugggcaagcgcgagaagaagcugggggaguucggcaaggccaagggcagccgggccaucugguacauguggcugggggcgcgcuaccucgaguucgaggcccugggcuuccugaacgaggaccacugguucucccgggagaacagcuacuccggggucgagggcgaggggcuccacaagcugggcuacauccugcgcgacaucagcaagaucccgggcggggccauguacgccgacgacaccgccggcugggacacccggaucacggaggacgaccuccacaacgaggagaagaucacccagcagauggaccccgagcaccgccagcuggcgaacgccaucuucaagcugaccuaccagaacaagguggugaagguccagcggcccacccccaaggggacggugauggacaucaucucccgcaaggaccagcggggcagcggccagguggggaccuacggccucaacaccuucaccaacauggaggcccagcugauccgccagauggagggggagggcguccuguccaaggccgaccucgagaacccgcaccuccuggagaagaagaucacccaguggcucgagacgaaggggguggagcggcugaagcgcauggccaucagcggcgacgacugcguggucaagcccaucgacgaccgguucgcgaacgcccugcucgcccugaacgacaugggcaaggugcgcaaggacaucccccaguggcagcccuccaagggguggcacgacuggcagcaggucccguucugcagccaccacuuccacgagcugaucaugaaggacggccggaagcucgucgugcccugccgcccccaggacgagcugaucgggcgcgcccggaucucccagggcgccggguggagccugaaggagaccgcgugccucggcaaggccuacgcccagaugugggcccugauguacuuccaccgccgggaccugcgccucgcguccaacgccaucugcagcgccgugcccguccacugggugccgaccucccggaccacguggagcauccacgcccaccaccaguggaugaccaccgaggacaugcugaccguguggaaccgcgucuggaucgaggacaaccccuggauggaggacaagacgcccgugaccaccugggaggacgugcccuaccugggcaagcgggaggaccaguggugcgggagccucaucggccugaccucccgcgccacgugggcgcagaacauccugaccgccauccagcagguccggagccucaucgggaacgaggaguuccuggacuacaugccguccaugaagcgcuuccggaaggaggaggagagcgagggcgccaucugguga

SEQ ID NO: 10396 - RNA, 9873 nt, Artificial Sequence
  derived and/or modified CDS sequence (opt1) from DENV-3__AY858039__SS-prME
accagccugugccucaugaugaugcugcccgccacccuggccuuccaccucaccagccgcgacggcgagccccggaugaucguggggaagaacgagcgcggcaagagccugcuguucaagaccgccuccgggaucaacaugugcacccucaucgccauggaccugggcgagaugugcgacgacaccgugaccuacaagugcccccugaucaccgagguggagcccgaggacaucgacugcuggugcaaccucaccagcaccugggugaccuacgggaccugcaaccaggccggcgagcaccggcgcgacaagcgguccgucgcccuggcgccccacgugggcauggggcuggacacccgcgcgcagaccuggaugagcgccgagggcgccuggcggcaggucgagaaggucgagacgugggccuuccgccaccccggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacgugaccaccgacagccgcugccccacgcagggcgaggccauccugccggaggagcaggaccagaacuacgucugcaagcacaccuacguggaccggggguggggcaacgggugcggccucuucgggaagggcucccuggugaccugcgccaaguuccagugccuggagcucaucgagggcaaggucgugcagcacgagaaccugaaguacaccgugaucaucacgguccacaccggggaccagcaccaggugggcaacgagacccagggggucaccgccgagaucacgccccaggccagcaccguggaggcgauccugcccgaguacggcacccucgggcuggagugcagcccccggaccggccuggacuucaacgagaugauccuccugaccaugaagaacaaggccuggauggugcaccggcagugguucuucgaccugccgcuccccuggacgagcggcgccaccaccgagacccccacguggaacaagaaggagcugcuggucaccuucaagaacgcccacgccaagaagcaggagguggugguccucgggucccaggagggcgcgaugcacaccgcccugaccggggccacggagauccagaccagcggcgggaccuccaucuucgccggccaccugaagugccgccucaagauggacaagcuggagcugaagggcaugagcuacgccaugugcuccaacgcguucgugcucaagaaggaggugagcgagacccagcacgggacgauccugaucaaggucgaguacaagggcgaggacgcccccugcaagaucccguucagcaccgaggacgggcagggcaaggcccacaacggccggcugaucaccgccaaccccguggugaccaagaaggaggagcccgucaacaucgaggcggagcccccguucggggaguccaacaucaucaucggcaucggggacaaggcccugaagaucaacugguacaagaagggcagcuccaucgggaagauguucgaggccacggcccgcggcgcccggcgcauggcgauccucggcgacaccgccugggacuucgggagcgugggcggggugcugaacucccugggcaagaugguccaccagaucuucgggagcgccuacaccgcccucuucuccggcgugagcuggaucaugaagaucggcaucggggugcugcugaccuggaucggccucaacuccaagaacacgagcauguccuucagcugcaucgucaucgggaucaucacccuguaccugggcgccguggugcaggcggacauggggugcgucaucaacuggaagggcaaggagcucaagugcggcuccgggaucuucgugaccaacgaggugcacaccuggacggagcaguacaaguuccaggccgacagccccaagcggcuggccaccgccaucgccggcgcgugggagaacggggucugcggcauccgcuccaccacccgcauggagaaccugcucuggaagcagaucgccaacgagcugaacuacauccugugggagaacaacaucaagcucacggugguggucggggacaucaucggcgugcuggagcagggcaagcggacccugacgccccagcccauggagcucaaguacagcuggaagaccugggggaaggccaagaucgugacggccgagauccagaacuccagcuucaucaucgacggcccgaacacccccgagugccccaacgcgucccgcgccuggaacgucugggagguggaggacuacggguucggcguguucaccaccaacaucuggcugaagcugcgggagauguacacgcagcucugcgaccaccgccugaugagcgccgccgucaaggacgagcgggccgugcacgcggacaugggcuacuggaucgagagccagaagaacggguccuggaagcuggagaaggccagccucaucgaggugaagaccugcaccuggcccaagucccacacccuguggagcaacggcguccuggaguccgacaugaucauccccaagucccucgccgggcccaucucccagcacaacuaccgccccggcuaccacacccagacggccgggccguggcaccugggcaagcuggagcucgacuucaacuacugcgagggcaccaccguggugaucaccgagaacugcgggacgcggggccccagccugcgcaccaccaccgucuccgggaagcugauccacgaguggugcugccggagcugcacgcugccgccccuccgcuacaugggcgaggacgggugcugguacggcauggagauccggccgaucaacgagaaggaggagaacauggugaagucccuggugagcgccggcuccgggaaggucgacaacuucaccaugggcgugcucugccuggcgauccuguucgaggaggugaugcgcgggaaguucggcaagaagcacaugaucgccgggguccucuucaucuucgugcugcugcucagcggccagaucaccuggcgggacauggcccgcacccugaucaugaucggcuccaacgccagcgaccggauggggaugggcgugacguaccuggcccucaucgcgaccuucaagauccagcccuuccuggcccugggguucuuccuccgcaagcugaccucccgggagaaccugcuccugggcgucggccuggccauggccaccacgcuccagcugcccgaggacaucgagcagauggcgaacgggaucgcccugggccucauggcccugaagcugaucacccaguucgagaccuaccagcucuggaccgcccuggugagccugacgugcagcaacaccaucuucacccucaccguggccuggcgcacggcgacccugauccuggccgggaucucccuccugcccgucugccagagcuccagcaugcggaagaccgacuggcugccgaugaccguggccgccaugggcgugccgcccagcccccucuucaucuucagccugaaggacacgcugaagcgccgcuccuggccgcucaacgagggggugauggccgugggccuggucagcauccuggcguccagccuccugcggaacgacgugcccauggccggcccccugguggccgggggccuccugaucgccugcuacgucaucaccgggaccuccgccgaccugaccguggagaaggcggccgacgugacgugggaggaggaggccgagcagaccggcgucagccacaaccucaugaucaccguggacgacgacgggaccaugcgcaucaaggacgacgagacggagaacauccugaccgugcugcucaagaccgcccugcugaucgucuccggcaucuuccccuacagcaucccggccacccuccugguguggcacaccuggcagaagcagacgcagcgguccggcgugcugugggacguccccuccccgcccgagacccagaaggcggagcucgaggaggggguguaccgcaucaagcagcggggcaucuucgggaagacccaggugggcgucggggugcagaaggagggcguguuccacaccauguggcacgucacgcgcggcgccgugcugaccuacaacgggaagcggcuggagccgaacugggccuccgugaagaaggaccucaucagcuacggcgggggcuggcgccuguccgcccaguggcagaagggggaggagguccaggugaucgcgguggagcccggcaagaaccccaagaacuuccagaccaugcccggcaucuuccagaccacgaccggggagaucggcgccaucgcccuggacuucaagccggggaccagcggcagccccaucaucaaccgggagggcaaggucguggggcuguacggcaacgggguggucaccaagaacggcggguacguguccggcaucgcccagacgaacgccgagcccgacggcccgacccccgagcucgaggaggagauguucaagaagcgcaaccugaccaucauggaccugcaccccgggagcggcaagacccggaaguaccuccccgcgaucgugcgcgaggccaucaagcggcgccugcggacgcugauccucgccccgacccgcgucguggccgccgagauggaggaggcgcugaaggggcugcccauccgguaccagaccaccgccacgaaguccgagcacaccggcaaggagaucguggaccucaugugccacgccaccuucaccaugcgccugcugagccccguccgggugcccaacuacaaccucaucaucauggacgaggcccacuucacggacccggccuccaucgcggcccgcggguacaucagcacccgggugggcaugggcgaggccgccgcgaucuucaugaccgccacgccgcccgggacggccgacgccuucccccaguccaacgccccgauccaggacgaggagcgcgacauccccgagcgcagcuggaacuccggcaacgacuggaucaccgacuucgcggggaagaccgucugguucgugcccagcaucaaggccggcaacgacaucgccaacugccugcggaagaacgggaagaaggugauccagcugucccgcaagaccuucgacacggaguaccagaagaccaagcucaacgacugggacuucgucgugaccaccgacaucagcgagaugggcgccaacuucaaggccgaccgggugaucgacccccgccggugccugaagccggucauccugacggacggccccgagcgcgugauccucgcggggcccaugcccgugaccgucgccuccgccgcccagcggcgcggccggguggggcgcaacccgcagaaggagaacgaccaguacaucuucaccggccagccccugaacaacgacgaggaccacgcccacuggaccgaggcgaagaugcugcucgacaacaucaacacgcccgaggggaucauccccgcccuguucgagccggagcgggagaaguccgccgccaucgacggcgaguaccgccugaagggcgagucccggaagaccuucguggagcucaugcgccgcggggaccugcccgucuggcuggcgcacaagguggccagcgagggcaucaaguacaccgaccgcaaguggugcuucgacggggagcggaacaaccagauccucgaggagaacauggacgucgagaucuggaccaaggagggcgagaagaagaagcugcgcccccgguggcuggacgcccgcaccuacuccgacccccucgcccugaaggaguucaaggacuucgccgcgggccgcaagagcaucgcccuggaccucgugacggagaucgggcgggugccgucccaccuggcccaccgcacccggaacgcccuggacaaccucgucaugcugcacaccagcgagcacggcgggcgcgccuaccggcacgcgguggaggagcugcccgagaccauggagacgcuccugcugcucggccugaugauccugcucaccgggggcgccaugcuguuccugaucagcggcaagggggugggcaagaccuccaucgggcucaucugcgucguggccagcuccggcaugcuguggauggccgacaucccccugcaguggaucgccagcgcgaucgugcucgaguucuucaugaugguccugcugaucccggagcccgagaagcagcgcacgccccaggacaaccagcucgccuacguggugaucgggauccugacgcuggccgccaucgucgccgcgaacgagaugggccuccuggagaccaccaagcgggaccugggcauguccaaggagcccgggguggugagcccgaccuccuaccucgacgucgaccugcaccccgccagcgccuggacgcuguacgccguggcgaccaccgugaucacccccaugcuccgccacacgaucgagaacuccaccgccaacgucagccuggccgccaucgccaaccaggcgguggugcugaugggccucgacaagggguggcccaucuccaagauggaccugggcgucccgcugcucgcccuggggugcuacagccaggugaacccccugacccucaccgccgccgugcugcugcucgucacgcacuacgccaucaucggccccggccugcaggcgaaggccacccgggaggcccagaagcgcaccgccgccgggaucaugaagaaccccaccguggacggcaucaugacgaucgaccuggacccggugaucuacgacuccaaguucgagaagcagcucgggcaggucaugcugcuggugcucugcgcggugcagcugcugcucaugcggaccagcugggccuucugcgaggcccugacccuggccaccggccccaucacgacccucugggagggcucccccgggaaguucuggaacaccaccaucgcggucagcauggccaacaucuuccgcggcuccuaccuggccggggccggccuggccuucagcaucaugaaguccguggggacgggcaagcggggcaccgggagccagggcgagacccucggggagaaguggaagaagaagcugaaccagcugagccgcaaggaguucgaccucuacaagaaguccggcaucaccgagguggaccggacggaggcgaaggaggggcugaagcgcggcgagaucacccaccacgccgucagccggggcuccgccaagcugcagugguucguggagcgcaacauggugauccccgaggggcgggucaucgaccucggcugcgggcgcggcggguggagcuacuacugcgccggccugaagaaggugaccgaggugcggggcuacaccaagggcgggccggggcacgaggagcccguccccauguccaccuacggcuggaacaucgugaagcugaugagcgggaaggacguguucuaccucccgcccgagaagugcgacacgcugcugugcgacaucggcgaguccagccccucccccaccgucgaggagagccgcaccauccgcgugcugaagaugguggagcccuggcucaagaacaaccaguucugcaucaagguccugaaccccuacaugcccaccgugaucgagcaccuggagcggcuccagcgcaagcacggcgggaugcuggugcggaacccccugucccgcaacagcacgcacgagauguacuggaucuccaacggcaccgggaacaucgucagcuccgugaacauggugagccggcuccugcugaaccgcuucaccaugaccuaccggcgccccacgaucgagaaggacgucgaccucggcgccggcacccggcacgugaacgcggagccggagacccccaacauggacgucaucggggagcgcauccggcgcaucaaggaggagcacuccagcaccuggcacuacgacgacgagaaccccuacaagacgugggccuaccacggcuccuacgaggugaaggccaccgggagcgccagcuccaugaucaacggcguggucaagcugcugaccaagccgugggacguggugcccaccgucacgcagauggccaugaccgacaccacccccuucgggcagcagcggguguucaaggagaagguggacacgcgcacccccaagccgaugcccggcacccggaaggucauggagaucaccgcggaguggcucuggcgcacgcugggccggaacaagcgcccccggcugugcacccgcgaggaguucaccaagaaggugcgcaccaacgccgccaugggggccguguucacggaggagaaccagugggacagcgcgcgggccgccgucgaggacgaggaguucuggaagcucguggaccgcgagcgggagcugcacaagcugggcaagugcggguccugcguguacaacaugaugggcaagcgcgagaagaagcucggggaguucggcaaggccaagggcagccgggccaucugguacauguggcugggggcgcgcuaccuggaguucgaggcccucggcuuccugaacgaggaccacugguucucccgggagaacagcuacuccggggucgagggcgaggggcugcacaagcucggcuacauccugcgcgacaucagcaagauccccggcggggccauguacgccgacgacaccgccggcugggacacccggaucaccgaggacgaccugcacaacgaggagaagaucacgcagcagauggacccggagcaccgccagcucgcgaacgccaucuucaagcugaccuaccagaacaagguggugaagguccagcggcccacccccaaggggaccgugauggacaucaucucccgcaaggaccagcggggcagcggccagguggggacguacggccugaacaccuucaccaacauggaggcccagcucauccgccagauggagggggagggcguccuguccaagaccgaccuggagaacccccaccuccuggagaagaagaucacccaguggcuggagacgaaggggguggagcggcucaagcgcauggccaucagcggcgacgacugcguggucaagccgaucgacgaccgguucgccaacgcgcugcuggcccucaacgacaugggcaaggugcgcaaggacaucccccaguggcagcccuccaagggguggcacgacuggcagcagguccccuucugcagccaccacuuccacgagcugaucaugaaggacggccggaagcuggucgugccgugccgcccccaggacgagcucaucgggcgggcccgcaucucccagggcgccggguggagccugaaggagaccgccugccugggcaaggcguacgcccagaugugggcccucauguacuuccaccgccgggaccugcgccuggccuccaacgcgaucugcagcgccgugcccguccacugggugcccaccucccggaccacguggagcauccacgcccaccaccaguggaugaccaccgaggacaugcucaccguguggaaccgcgucuggaucgaggacaacccguggauggaggacaagacgcccgugaccaccugggaggacgugcccuaccugggcaagcgggaggaccaguggugcgggagccugaucggccucaccucccgcgccacgugggcccagaacauccugaccgcgauccagcagguccggagccugaucgggaacgaggaguuccucgacuacaugcccuccaugaagcgcuuccggaaggaggaggagagcgagggcgccaucugguga

SEQ ID NO: 10397 - RNA, 9873 nt, Artificial Sequence
  derived and/or modified CDS sequence (opt1) from DENV-3__JN368477__SS-prME
accagccugugccucaugaugaugcugcccgcgacccuggccuuccaccucaccagccgggacggcgagccgcggaugaucguggggaagaacgagcgcggcaagagccugcuguucaagaccgcguccgggaucaacaugugcacccucaucgccauggaccugggcgagaugugcgacgacaccgucaccuacaagugcccccugaucgccgagguggagcccgaggacaucgacugcuggugcaaccucaccagcaccugggugaccuacgggacgugcaaccaggccggcgagcaccggcgcgacaagcgguccgucgcccuggcgccccacgugggcauggggcuggacacccgcacccagaccuggaugagcgccgagggcgccuggcgccagguggagaaggucgagacgugggcccuccgccacccgggguucaccauccuggcgcuguuccucgcccacuacaucggcaccucccugacccagaagguggugaucuucauccugcucaugcuggucacgcccagcaugaccaugcggugcgugggggugggcaaccgcgacuucgucgagggccuguccggggccaccuggguggacgugguccucgagcacggcgggugcgugaccacgauggccaagagcaagcccacccuggacaucgagcugcagaagaccgaggccacccagcucgcgacgcugcggaagcugugcaucgagggcaagaucaccaacaucaccaccgacucccgcugccccacgcagggcgaggccacccucccggaggagcaggaccagaacuacgugugcaagcacaccuacgucgaccggggguggggcaacgggugcggccuguucgggaagggcagccuggugaccugcgccaaguuccagugccucgagcccaucgagggcaaggugguccaguacgagaaccugaaguacacggugaucaucaccgugcacaccggggaccagcaccaggucggcaacgacacccagggggugacggucgagaucacgccccaggccuccaccguggaggccgugcugcccgaguacggcacccucgggcuggagugcagcccgcgcaccggccuggacuucaacgagaugauccuccugacgaugaagaacaaggcguggaugguccaccggcagugguucuucgaccugccccuccccuggaccuccggcgccaccaccgagacgcccaccuggaaccgcaaggagcugcuggugaccuucaagaacgcccacgccaagaagcaggagguggucgugcucgggagccaggagggcgccaugcacaccgcgcugacgggggccaccgagauccagaacuccggcgggaccagcaucuucgccggccaccugaagugccggcucaagauggacaagcuggagcugaagggcauguccuacgccaugugccucaacaccuucgugcugaagaaggaggucagcgagacgcagcacgggaccauccugaucaagguggaguacaagggcgaggacgccccgugcaagauccccuucagcaccgaggacgggcagggcaaggcgcacaacggccgccugaucaccgccaaccccguggucacgaagaaggaggagcccgugaacaucgaggccgagccgcccuucggggaguccaacaucgugaucggcaucggggacaaggcccucaagaucaacugguacaagaagggcagcuccaucgggaagauguucgaggcgaccgcccggggcgcccgccggauggccauccugggcgacaccgccugggacuucgggagcgucggcggggugcugaacucccucggcaagauggugcaccagaucuucgggagcgcguacaccgcccuguucuccggcgucagcuggaucaugaagaucggcaucggggugcugcucacguggaucggccugaacuccaagaacaccagcauguccuucagcugcaucgugaucgggaucaucacccuguaccucggcgccgucgugcaggccgacauggggugcgugaucaacuggaagggcaaggagcugaagugcggcaacgggaucuucgucaccaacgaggugcacacguggaccgagcaguacaaguuccaggccgacucccccaagcgccuggcgaccgccaucgccggcgccugggagaacggggugugcggcauccgcagcaccacgcggauggagaaccuccuguggaagcagaucgccaacgagcugaacuacauccucugggagaacaacaucaagcugaccgucguggugggggacaucaucggcguccuggagcagggcaagcgcacccucacgccccagccgauggagcugaaguacuccuggaagacgugggggaaggcgaagaucgugaccgccgagacccagaacagcuccuucaucaucgacggccccaacacccccgagugccccagcgccucccgggccuggaacgugugggaggucgaggacuacggguucggcguguucacgaccaacaucuggcugaagcuccgcgagguguacacccagagcugcgaccaccggcugaugagcgcggccaucaaggacgagcgcgccguccacgccgacaugggcuacuggaucgagucccagaagaacgggagcuggaagcuggagaaggccuccuucaucgaggugaagaccugcaccuggcccaagagccacacgcucugguccaacggcgugcuggagagcgacaugaucauccccaagucccuggcggggcccaucagccagcacaaccaccggccgggcuaccacacccagaccgccgggcccuggcaccucggcaagcuggagcuggacuucaacuacugcgagggcaccacggucgugaucgccgagaacugcgggacccgcggccccucccuccggaccaccacggugagcgggaagcugauccacgaguggugcugccgcuccugcacccugcccccgcuccgguacaugggcgaggacgggugcugguacggcauggagauccgccccaucaacgagaaggaggagaacauggucaagagccugguguccgccggcagcgggaagguggacaacuucaccaugggcguccugugccucgccauccuguucgaggaggugaugcgggggaaguucggcaagaagcacaugaucgcgggggugcuguucaccuucguccuccugcuguccggccagaucacguggcgcgacauggcccacacccucaucaugaucggcagcaacgccuccgaccggauggggaugggcgugacccaccuggcccugaucgccaccuucaagauccagcccuuccucgcgcugggguucuuccugcgcaagcucacgagccgggagaaccugcugcucggcgugggccuggccauggccaccacccugcagcuccccgaggacaucgagcagauggccaacgggaucgcgcugggccugaugacccucaagcugaucacgcaguucgagaccuaccagcuguggaccgcccucgucagccugaccugcuccaacacgaucuucacccugaccguggccuggcgcaccgccacgcucauccuggccggggucagccugcucccgcugugccaguccagcuccaugcggaagaccgacuggcugcccaugaccguggcggccaugggcgugccgccccugccgcuguucaucuucagccugaaggacacccccaagcgccgcuccuggccccucaacgagggggucauggccgugggccuggugagcauccuggccuccagccuccugcggaacgacguccccauggccggcccgcugguggccggcgggcuccugaucgccugcuacgugaucacggggaccuccgccgaccugaccgucgagaaggccgccgacgugaccugggaggaggaggcggagcagacgggggugagccacaaccucaugaucaccgucgacgacgacgggaccaugcgcaucaaggacgacgagaccgagaacauccugaccgugcugcucaagacggcccugcugaucguguccggcaucuuccccuacagcauccccgccacccuccuggucuggcacaccuggcagaagcagacccagcgguccggcgugcugugggacgugcccagcccgcccgagacgcagaaggccgagcucgaggagggggucuaccgcaucaagcagcagggcaucuucgggaagacccaggugggcguggggguccagaaggagggcguguuccacaccauguggcacgugacccggggcgccguccugacgcacaacgggaagcgccuggagcccaacugggcguccgugaagaaggaccucaucagcuacggcgggggcuggcggcuguccgcccaguggcagaagggggaggaggugcaggucaucgccguggagcccggcaagaacccgaagaacuuccagaccaugcccggcaucuuccagaccaccacgggggagaucggcgccaucgcgcuggacuucaagcccgggaccagcggcagcccgaucaucaaccgcgagggcaagguggucgggcuguacggcaacgggguggugaccaagaacggcggguacgucuccggcaucgcccagaccaacgccgagcccgacggccccacgcccgagcucgaggaggagauguucaagaagcggaaccugaccaucauggaccugcacccggggagcggcaagacccgcaaguaccuccccgccaucgugcgggaggccaucaagcgccggcugcgcacccugauccucgcgcccacgcggguggucgccgccgagauggaggaggcccugaaggggcugcccauccgcuaccagaccaccgccaccaaguccgagcacacgggccgggagaucguggaccucaugugccacgcgaccuucaccaugcgccugcugagcccggugcggguccccaacuacaaccucgugaucauggacgaggcccacuucaccgaccccgccuccaucgccgcccgcggguacaucagcacgcgggugggcaugggcgaggcggccgccaucuucaugaccgccacgccgcccgggaccgcggaggccuucccccaguccaacgcccccauccaggacgaggagcgcgacauccccgagcgcagcuggaacuccggcaacgaguggaucacggacuucgucgggaagaccgugugguucgugcccagcaucaaggccggcaacgacaucgccaacugccugcggaagaacgggaagaaggucauccagcugucccgcaagaccuucgacaccgaguaccagaagacgcggcucaacgacugggacuucguggugaccaccgacaucagcgagaugggcgcgaacuucaaggccgaccgcgucaucgacccccggcgcugccugaagcccgugauccugaccgacggccccgagcgggugauccucgccgggccgaugcccgucacggccgccuccgcggcccagcgccggggccgcguggggcggaacccccagaaggagaacgaccaguacaucuucaccggccagccccugaacaacgacgaggaccacgcccacuggaccgaggccaagaugcugcucgacaacaucaacaccccggaggggaucauccccgcccuguucgagcccgagcgcgagaaguccgcggccaucgacggcgaguaccggcugaagggcgagucccgcaagaccuucgucgagcucaugcggcgcggggaccugcccguguggcuggcccacaagguggccagcgagggcaucaaguacacggaccggaaguggugcuucgacggggagcgcaacaaccagauccucgaggagaacauggacgucgagaucuggaccaaggagggcgagcggaagaagcugcgcccgcgcuggcuggacgcgcggaccuacuccgacccccucgcccugaaggaguucaaggacuucgccgccggccgcaagagcaucgcccuggaccucgugaccgagaucgggcgggugcccucccaccuggcgcaccgcacgcggaacgcccuggacaaccucgucaugcugcacaccagcgagcacggcgggcgcgccuaccggcacgccguggaggagcugccggagaccauggagacccuccugcugcucggccugaugauccugcucaccggcggggccaugcuguuccugaucagcgggaaggggaucggcaagaccuccaucgggcucaucugcgugaucgucagcuccggcaugcuguggauggcggacgugccccugcaguggaucgccagcgccaucgugcucgaguucuucaugaugguccugcugauccccgagcccgagaagcagcgcaccccgcaggacaaccagcucgccuacguggugaucgggauccugacccuggccgcgaucgucgccgccaacgagaugggccuccuggagacgaccaagcgggaccugggcauguccaaggagcccgggguggugagccccaccuccuaccucgacgucgaccugcaccccgccagcgccuggacccuguacgcgguggccacgaccgugaucaccccgaugcuccgccacaccaucgagaacuccacggccaacgucagccuggccgcgaucgccaaccaggccguggugcugaugggccucgacaagggguggcccaucuccaagauggaccugggcgucccccugcucgcccuggggugcuacagccaggugaacccccugacccucaccgccgcggugcugcugcucgucacccacuacgccaucaucggcccgggccugcaggccaaggccacgcgggaggcccagaagcgcaccgcggccgggaucaugaagaaccccaccguggacggcaucaugaccaucgaccuggaccccgugaucuacgacuccaaguucgagaagcagcucgggcaggucaugcugcuggugcucugcgccgugcagcugcugcucaugcggacgagcugggcccugugcgaggcccugacccucgcgaccggccccaucaccacgcugugggagggcuccccggggaaguucuggaacaccaccaucgccgucagcauggccaacaucuuccgcggcuccuaccuggccggggcgggccucgccuucagcaucaugaaguccguggggaccggccggcgcggcacggggagccagggcgagacccugggggagaaguggaagaagaagcugaaccagcucagccggaaggaguucgaccuguacaagaaguccggcaucaccgagguggaccgcaccgaggccaaggaggggcugaagcggggcgagaccacgcaccacgccgucagccgcggcuccgccaagcuccagugguucguggagcggaacauggugauccccgaggggcgcgucaucgaccugggcugcgggcgcggcggguggagcuacuacugcgcgggccugaagaaggugaccgaggugcggggcuacaccaagggcggccccgggcacgaggagcccgucccgauguccaccuacggcuggaacaucgugaagcucaugagcgggaaggacguguucuaccugccgcccgagaagugcgacacgcugcugugcgacaucggcgaguccagccccuccccgaccgucgaggagagccgcaccauccgggugcucaagaugguggagcccuggcugcgcaacaaccaguucugcaucaagguccugaaccccuacaugcccaccgugaucgagcaccucgagcggcugcagcgcaaguacggcgggaugcuggugcggaacccgcucucccgcaacagcacgcacgagauguacuggaucuccaacggcaccgggaacaucgucagcuccgugaacauggucagccggcugcugcucaaccgcuucaccaugacccaccggcgccccacgaucgagaaggacguggaccugggcgccggcacccggcacgugaacgccgagcccgagaccccgaacauggacgucaucggggagcgcaucaagcggaucaaggaggagcacuccagcaccuggcacuacgacgacgagaaccccuacaagacgugggccuaccacggcuccuacgaggugaaggccaccgggagcgcgagcuccaugaucaacggcguggucaagcugcucaccaagcccugggacguggugcccauggucacccagauggccaugacggacaccaccccguucgggcagcagcgcguguucaaggagaagguggacacccggacgccccgccccaugcccggcacccggaaggucauggagaucaccgccgaguggcuguggcgcacccugggccgcaacaagaagccgcggcucugcacgcgcgaggaguucaccaagaaggugcggaccaacgccgccaugggggcgguguucaccgaggagaaccagugggacagcgcccgcgccgccgucgaggacgaggaguucuggaagcugguggacaaggagcgggagcugcacaagcucggcaagugcggguccugcguguacaacaugaugggcaagcgcgagaagaagcugggggaguucggcaaggcgaagggcagccgggccaucugguacauguggcugggggcccgcuaccucgaguucgaggcccugggcuuccugaacgaggaccacugguucucccgggagaacagcuacuccggggucgagggcgaggggcuccacaagcugggcuacauccugcgcgacaucagcaagauccccggcggggccauguacgcggacgacacggccggcugggacacccggaucaccgaggacgaccuccacaacgaggagaagaucacccagcagauggaccccgggcaccgccagcuggccaacgccaucuucaagcugacguaccagaacaagguggugaagguccagcggcccaccccgaagggcaccgugauggacaucaucucccgcaaggaccagcggggcagcggccaggugggcaccuacgggcucaacaccuucacgaacauggaggcccagcugguccgccagauggagggcgagggggugcuguccaaggcggaccucgagaacccccaccuccuggagaagaagaucacccaguggcucgagaccaagggcguggagcggcugaagcgcauggccaucagcggcgacgacugcgucgugaagcccaucgacgaccgguucgccaacgcccugcucgcccugaacgacauggggaaggugcgcaaggacaucccccaguggcagccguccaagggcuggcacgacuggcagcagguccccuucugcagccaccacuuccacgagcugaucaugaaggacgggcggaagcucguggugcccugccgcccccaggacgagcugaucggccgcgcgcggaucucccagggggccggcuggagccugaaggagaccgccugccucggcaaggccuacgcccagauguggucccugauguacuuccaccgccgggaccugcgccucgcgagcaacgccaucugcuccgccgucccggugcacuggauccccacgagccggaccaccuggagcauccacgcccaccaccaguggaugaccacggaggacaugcugaccguguggaaccgcgucuggaucgaggacaaccccuggauggaggacaagacccccgugaccacgugggaggacgugccguaccuggggaagcgggaggaccaguggugcggcucccucaucgggcugaccagccgcgcgaccugggcccagaacauccugaccgccauccagcagguccggucccucaucggcgacgaggaguuccuggacuacaugcccagcaugaagcgcuuccggaaggaggaggagacggagggggccaucugguga

SEQ ID NO: 10398 - RNA, 9873 nt, Artificial Sequence
  derived and/or modified CDS sequence (opt1) from DENV-3__EF643017__SS-prME
accagccugugccucaugaugauccugcccgccgcccuggcguuccaccucaccagccgggacggggagccccggaugaucguggggaagaacgagcgcggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcggcgccgggacaagcgcagcguggcccucgcgccccacgugggcauggggcuggacacccggacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccgugcugccggaggagcaggaccagaacuacgucugcaagcacaccuacguggaccgcggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcaccaccgaggcgauccugcccgaguacggcacccuggggcucgagugcuccccgcggaccggccuggacuucaacgagaugauccugcucacgaugaagaacaaggccuggauggugcaccgccagugguucuucgaccugccccugcccuggaccagcggcgccaccaccgagacgcccaccuggaaccggaaggagcuccuggugaccuucaagaacgcccacgccaagaagcaggaggucguggugcuggggucccaggagggcgcgaugcacaccgcccucacgggggccaccgagauccagaacagcggcgggaccuccaucuucagcggccaccugaagugccgccugaagauggacaagcucgagcugaagggcauguccuacgccaugugcaccaacacguucguccugaagaaggaggugagcgagacccagcacgggaccauccucaucaagguggaguaccggggcgaggacgccccgugcaagauccccuucagcaccgaggacgggcagggcaaggcgcacaacggccgccugaucacggccaaccccgucgugaccaagaaggaggagcccgugaacaucgaggccgagccgcccuucggggaguccaacaucgucaucggcaucggggacaacgcccugaagaucaacugguacaagaagggcagcuccaucgggaagauguucgaggcgaccgcccggggcgcccgccgcauggccauccugggcgacaccgccugggacuucgggagcgugggcggggugcucaacucccugggcaagaugguccaccagaucuucgggagcgcguacacggcccuguucuccggcgugagcugggugaugaagaucggcaucgggguccuccugaccuggaucggccugaacuccaagaacaccagcauguccuucagcugcaucgccaucgggaucaucacccucuaccugggcgccguggugcaggccgacauggggugcgucaucaacuggaagggcaaggagcugaagugcggcuccgggaucuucgugacgaacgaggugcacaccuggaccgagcaguacaaguuccaggcggacagccccaagcggcucgccaccgccaucgccggcgccugggagaacggggucugcggcauccgcuccacgacccggauggagaaccugcuguggaagcagaucgcgaacgagcucaacuacauccugugggagaacaacaucaagcugaccgugguggucggggacaucaucggcgugcucgagcagggcaagcgcacccugacgccccagccgauggagcugaaguacagcuggaagaccugggggaaggccaagaucgugaccgccgagacccagaacuccagcuucaucaucgacggccccaacacgcccgagugccccuccgccagccgggcguggaacgucugggagguggaggacuacggguucggcguguucaccaccaacaucuggcucaagcugcgcgaggucuacacccagcugugcgaccaccggcucaugagcgccgccgugaaggacgagcgcgccgugcacgccgacaugggcuacuggaucgagucccagaagaacgggagcuggaagcuggagaaggcgucccugaucgaggucaagaccugcacguggcccaagucccacacccucugguccaacggcgugcuggagagcgacaugaucacccccaagucccuggccgggcccaucagccagcacaaccaccggccgggcuaccacacccagacggccgggcccuggcaccucggcaagcuggagcuggacuucaacuacugcgagggcaccaccguggucaucaccgagaacugcgggacgcgcggccccucccuccggaccaccaccgugagcgggaagcugauccacgaguggugcugccgcuccugcacgcugcccccgcuccgguacaugggcgaggacgggugcugguacggcauggagauccgccccaucagcgagaaggaggagaacauggugaagucccuggucagcgccggcuccgggaagguggacaacuucaccaugggcgugcugugccucgccauccuguucgaggaggucaugcgggggaaguucggcaagaagcacaugaucgcggggguguucuucaccuucgugcugcuccugagcggccagaucaccuggcgcgacaugacgcacacccugaucaugaucggcuccaacgccagcgaccggauggggaugggcgucaccuaccucgcccugaucgccaccuucaagauccagcccuuccuggcccucggguucuuccugcgcaagcugacgagccgggagaaccuccugcugggcgugggccucgcgauggccaccacccugcagcugcccgaggacaucgagcagauggccaacgggaucgcccucggccugauggcgcugaagcucaucacccaguucgagacguaccagcuguggaccgcccugaucucccugaccugcagcaacaccauguucacgcugaccguggccuggcgcaccgccacccugauccucgccggggucucccugcugccggugugccagagcuccagcaugcgcaagacggacuggcuccccauggcggucgccgccaugggcgugagcccccucccccuguucaucuucagccucaaggacacccugaagcggcgcuccuggccgcugaacgagggggugauggccgucggccucgugagcauccuggccuccagccugcuccggaacgacgugcccauggcgggcccccuggucgccgggggccugcucaucgccugcuacgugaucaccgggaccuccgccgaccugacgguggagaaggccgcggacaucacccgcgaggaggaggccgagcagaccggcgucagccacaaccugaugaccaccguggacgacgacgggacgaugcggaucaaggacgacgagaccgagaacauccucaccgugcugcugaagaccgcccuccugaucgucuccggcguguuccccuacagcaucccggccacgcugcucguguggcacaccuggcagaagcagacccagcgcuccggcguccugugggacgugcccuccccgcccgagacccagaaggccgagcuggaggaggggguguaccggaucaagcagcagggcaucuucgggaagacgcaggucggcgugggggugcagaaggagggcgucuuccacaccauguggcacgugacccgcggcgcggugcucaccuacaacgggaagcggcuggagccgaacugggccuccgucaagaaggaccugaucagcuacggcgggggcuggcgccucagcgcccaguggcagaagggggaggagguccaggugaucgccgucgagcccggcaagaaccccaagaacuuccagacgaugcccggcaccuuccagaccaccacgggggagaucggcgcgaucgcccuggacuucaagccggggaccuccggcagccccaucaucaaccgggagggcaaggugguggggcuguacggcaacggggucgugaccaagaacggcggguacguguccggcaucgcccagaccaacgccgagcccgacggcccgacgcccgagcuggaggaggagauguucaagaagcgcaaccucaccaucauggaccugcaccccgggagcggcaagacccggaaguaccugcccgccaucguccgcgaggcgaucaagcggcgccuccggacccugauccuggccccgacgcgcgugguggccgccgagauggaggaggcccucaaggggcugcccauccgguaccagaccaccgcgaccaaguccgagcacacgggccgcgagaucgucgaccugaugugccacgccaccuucaccaugcggcuccugagccccgugcgcgugcccaacuacaaccugaucaucauggacgaggcccacuucaccgacccggccuccaucgccgcgcgcggguacaucagcacgcgggucggcaugggcgaggccgccgccaucuucaugaccgcgacgccgcccgggaccgccgacgccuucccccaguccaacgccccgauccaggacgaggagcgcgacauccccgagcggagcuggaacuccggcaacgaguggaucacggacuucgccgggaagaccgugugguucgugcccagcaucaaggcgggcaacgacaucgccaacugccuccgcaagaacgggaagaaggucauccagcugucccggaagaccuucgacaccgaguaccagaagacgaagcugaacgacugggacuucguggugaccaccgacaucagcgagaugggcgccaacuucaaggccgaccgcgucaucgacccccggcgcugccucaagccggugauccugaccgacggccccgagcgggugauccuggccgggcccaugcccgucaccgcggccuccgccgcccagcgccggggccgcguggggcggaacccgcagaaggagaacgaccaguacaucuucacgggccagccccucaacaacgacgaggaccacgcccacuggaccgaggcgaagaugcugcuggacaacaucaacacccccgaggggaucauccccgcccucuucgagccggagcgcgagaaguccgccgccaucgacggcgaguaccggcugaagggcgagucccgcaagaccuucguggagcugaugcggcgcggggaccuccccgucuggcuggcgcacaagguggccagcgagggcaucaaguacacggaccggaaguggugcuucgacgggcagcgcaacaaccagauccuggaggagaacauggacgucgagaucuggaccaaggagggcgagaagaagaagcuccgcccccgguggcuggacgcccgcaccuacuccgacccccuggcccucaaggaguucaaggacuucgccgcgggccgcaagagcaucgcccuggaccuggugaccgagaucgggcgcgugccgagccaccucgcccaccggacgcgcaacgcccuggacaaccuggucaugcuccacaccuccgagcacggcgggcgggccuaccgccacgcgguggaggagcugcccgagaccauggagacccugcuccugcugggccucaugauccugcugaccggcggggccaugcuguuccugaucagcgggaaggggaucggcaagaccuccaucgggcugaucugcgugaucgccagcuccggcaugagcuggauggccgagaucccccuccaguggaucgccuccgcgaucguccuggaguucuucaugauggugcugcucaucccggagcccgagaagcagcggacgccccaggacaaccagcuggccuacguggucaucgggauccugacccucgccgccaucaucgccgcgaacgagaugggccugcuggagacgaccaagcgcgaccucggcaugagcaaggagcccggggugguguccccgaccagcuaccuggacgucgaccugcaccccgccuccgccuggacccucuacgccguggcgacgaccgugaucacccccaugcugcggcacaccaucgagaacagcacggccaacgucucccuggccgccaucgccaaccaggcgguggugcucaugggccuggacaagggguggcccaucagcaagauggaccugggcgucccgcuccuggcccuggggugcuacucccaggugaacccccucacccugaccgccgccgugcugcuccugaucacccacuacgccaucaucggccccggccugcaggcgaaggccacgcgcgaggcccagaagcggaccgccgccgggaucaugaagaaccccaccgucgacggcaucaugaccaucgaccucgacccggugaucuacgacagcaaguucgagaagcagcugggccaggugaugcugcucguccugugcgcggugcagcugcuccugaugcgcacguccugggcccugugcgaggcccucacccuggccaccggccccaucaccacgcugugggagggcagccccgggaaguucuggaacaccaccaucgcgguguccauggccaacaucuuccggggcagcuaccucgccggggucggccuggccuucagcaucaugaaguccguggggaccggcaagcgcggcaccgggagccagggcgagacgcugggggagaaguggaagaagaagcucaaccagcugucccggaaggaguucgaccuguacaagaaguccggcaucaccgagguggaccgcaccgaggccaaggaggggcucaagcggggcgagaucacccaccacgcggucucccgcggcagcgccaagcugcagugguucguggagcggaacauggugauccccgaggggcgcgucaucgaccugggcugcgggcgcggcgggugguccuacuacugcgccggccucaagaaggugacggaggugcggggcuacaccaagggcgggccggggcacgaggagcccguccccaugagcaccuacggcuggaacaucgugaagcugauguccgggaaggacguguucuaccugcccccggagaagugcgacacccuccugugcgacaucggcgagagcucccccagccccacggucgaggagucccgcaccauccgggugcugaagaugguggagcccuggcugaagaacaaccaguucugcaucaagguccucaacccguacaugcccaccgugaucgagcaccuggagcgccugcagcggaagcacggcgggaugcucgugcgcaacccccugagccggaacuccacccacgagauguacuggaucagcaacggcacggggaacaucgucgccuccgugaacauggugagccgccugcuccugaaccgguucaccaugacccaccgccggcccaccaucgagaaggacgucgaccugggcgccggcacgcgccacgugaacgcggagccggagacccccaacauggacgugaucggggagcggaucaagcgcaucaaggaggagcacaacuccaccuggcacuacgacgacgagaaccccuacaagaccugggccuaccacggcagcuacgaggucaaggccacggggagcgccuccagcaugaucaacggcguggucaagcuccugaccaagccgugggacguggugcccauggucacccagauggccaugaccgacacgacccccuucgggcagcagcggguguucaaggagaagguggacacccgcacgccccgguccaugccgggcacgcgccgggucaugggcaucaccgcggaguggcuguggcgcacccucgggcgcaacaagaagccccggcugugcacccgcgaggaguucacgaagaaggugcggaccaacgccgccaugggcgccguguucaccgaggagaaccagugggacagcgcgaaggccgccgucgaggacgaggacuucuggaagcugguggaccgcgagcgggagcuccacaagcuggggaagugcggcuccugcguguacaacaugauggggaagcgcgagaagaagcugggcgaguucggcaaggccaaggggagccgggccaucugguacauguggcucggcgcgcgcuaccuggaguucgaggcccugggguuccucaacgaggaccacugguucucccgggagaacagcuacuccggcgucgagggggagggccugcacaagcugggcuacauccuccgcgacaucagcaagauccccgggggcgccauguacgccgacgacaccgccgggugggacacgcggaucaccgaggacgaccugcacaacgaggagaagaucacccagcagauggaccccgagcaccgccagcuggcgaacgccaucuucaagcucaccuaccagaacaagguggugaagguccagcggccgacccccacgggcaccgugauggacaucaucucccgcaaggaccagcggggcagcggccaggugggcaccuacgggcugaacaccuucacgaacauggaggcccagcugauccgccagauggagggcgaggggguccucuccaaggccgaccuggagaacccccaccuccccgagaagaagaucacccaguggcucgagaccaagggcguggagcggcugaagcgcauggccaucagcggcgacgacugcguggucaagccgaucgacgaccgguucgcgaacgcccugcucgcccugaacgacaccgggaaggugcgcaaggacaucccccaguggcagcccuccaagggcuggcacgacuggcagcagguccccuucugcagccaccacuuccacgagcugaucaugaaggacgggcggaagcucgucgugccgugccgcccccaggacgagcugaucggccgcgcccggaucucccagggggccggcuggagccugcgcgagacggcgugccucggcaaggccuacgcccagauguggucccugauguacuuccaccggcgcgaccugcggcucgccagcaacgcgaucugcagcgccgugcccguccacugggugcccaccucccgcaccaccuggagcauccacgcccaccaccaguggaugacgaccgaggacaugcugaccguguggaaccgggucuggaucgaggacaacccguggauggaggacaagacccccgugacgaccugggagaacgugcccuaccuggggaagcgcgaggaccaguggugcggcucccucaucgggcugaccagccgggccaccugggcccagaacauccccacggcgauccagcagguccgcucccugaucggcaacgaggaguuccucgacuacaugccgagcaugaagcgguuccgcaaggaggaggaguccgagggggccaucugguga

SEQ ID NO: 10399 - RNA, 9873 nt, Artificial Sequence
  derived and/or modified CDS sequence (opt1) from DENV-3__DQ675519__SS-prME
accuccaucugccugaugaugaugcuccccgccacccuggccuuccaccugaccucccgcgacggcgagccccggaugaucguggggaagaacgagcgcggcaagagccuccuguucaagaccgccuccgggaucaacaugugcacccugaucgccauggaccucggcgagaugugcgacgacaccgugaccuacaagugcccccugaucaccgagguggagcccgaggacaucgacugcuggugcaaccugaccagcaccugggugacguacgggaccugcaaccaggccggcgagcaccggcgcgacaagcgguccguggcccucgcgccccacgugggcauggggcuggacacccgcacccagacguggaugagcgcggagggcgccuggcggcaggucgagaagguggagaccugggccuuccgccaccccggguucaccauccuggcccucuuccuggcgcacuacaucggcaccucccugacgcagaagguggugaucuucauccuccugaugcuggucacccccagcaugaccaugcggugcgugggggugggcaaccgcgacuucgucgagggccucuccggggccaccuggguggacgugguccuggagcacggcgggugcgugacgaccauggccaagaacaagcccacccuggacaucgagcuccagaagaccgaggccacgcagcuggccacccugcggaagcucugcaucgagggcaagaucaccaacgugaccacggacagccgcugccccacccagggcgaggcgauccugccggaggagcaggaccagaacuacgucugcaagcacaccuacguggaccggggguggggcaacgggugcggccuguucgggaagggcucccucgugaccugcgccaaguuccagugccuggagagcaucgagggcaaggucgugcagcacgagaaccugaaguacacggugaucaucaccguccacaccggggaccagcaccaggugggcaacgagacccagggggucacggccgagaucacgccccaggccuccaccguggaggccauccuccccgaguacggcacccuggggcuggagugcagcccccgcaccggccucgacuucaacgagaugauccugcugacgaugaagaacaaggcguggauggugcaccggcagugguucuucgaccucccgcugcccuggaccuccggcgccaccaccgagacgcccaccuggaacaagaaggagcugcucgucaccuucaagaacgcccacgccaagaagcaggagguggugguccuggggagccaggagggcgccaugcacaccgcgcugacgggggccaccgagauccagaccuccggcgggaccagcaucuucgccggccaccucaagugccgccugaagauggacaagcuggagcucaagggcauguccuacgccaugugccugaacgccuucgugcugaagaaggaggugagcgagacgcagcacgggaccauccucaucaaggucgaguacaagggcgaggacgcgcccugccggaucccguucagcaccgaggacgggcagggcaaggcccacaacggccgccugaucaccgccaaccccguggugacgaagaaggaggagcccgucaacaucgaggccgagcccccguucggggaguccaacaucgugaucggcaucggggacaaggcgcugaagaucaacugguacaagaagggcagcuccaucgggaagauguucgaggccaccgcccggggcgcccgccggauggccauccugggcgacaccgcgugggacuucgggagcgugggcgggguccucaacucccugggcaagauggugcaccagaucuucgggagcgccuacaccgcccuguucuccggcgugagcuggaucaugaagaucggcaucgggguccuccugacguggaucggccugaacuccaagaacaccagcauguccuucagcugcaucgugaucgggaucaucacccucuaccugggcgccgugguccaggccgacauggggugcgugaucaacuggaagggcaaggagcugaagugcggcaacgggaucuucgugaccaacgagguccacacguggaccgagcaguacaaguuccaggcggacucccccaagcgccucgccaccgccaucgccggcgccugggagaacggggugugcggcauccgcagcaccacgcggauggagaaccugcuguggaagcagaucgcgaacgagcucaacuacauccugugggagaacaacaucaagcugaccguggucgugggggacaucaucggcgugcucgagcagggcaagcgcacccugacgccccagcccauggagcugaaguacuccuggaagacgugggggaaggccaagaucgucaccgccgagacccagaacagcuccuucaucaucgacggcccgaacacccccgagugccccagcgccucccgggcguggaacgugugggagguggaggacuacggguucggcgucuucacgaccaacaucuggcucaagcugcgcgagguguacacccagcugugcgaccaccggcucaugagcgccgccgugaaggacgagcgcgccguccacgccgacaugggcuacuggaucgagagccagaagaacggguccuggaagcuggagaaggcgagccugaucgaggugaagaccugcaccuggcccaagucccacacgcucuggagcaacggcgugcuggaguccgacaugaucauccccaagagccuggccgggcccaucucccagcacaaccaccggcccggcuaccacacccagaccgccgggccguggcaccucggcaagcuggagcuggacuucaacuacugcgagggcaccacggucgugaucaccgagaacugcgggacccgcggccccagccuccggaccacgaccguguccgggaagcugauccacgaguggugcugccgcagcugcacccugccgccccuccgguacaugggcgaggacgggugcugguacggcauggagauccgcccgaucaacgagaaggaggagaacauggucaagucccuggugagcgccggcuccgggaagguggacaacuucaccaugggcguccugugccucgccauccuguucgaggaggugaugcgggggaaguucggcaagaagcacaugaucgcgggggugcuguucacguucguccuccugcugagcggccagaucaccuggcgcgacauggcccacacccucaucaugaucggcuccaacgccagcgaccggauggggaugggcgugaccuaccuggcccugaucgccacguucaagauccagcccuuccucgcgcugggguucuuccugcgcaagcucaccucccgggagaaccugcugcucggcgugggccuggccauggccaccacccugcagcuccccgaggacaucgagcagauggccaacggggucgcgcugggccugauggcccucaagcugaucacgcaguucgagaccuaccagcuguggaccgcccucgugagccugaugugcagcaacaccaucuucacgcugaccgucgccuggcgcaccgccacccucauccuggcggggaucucccugcuccccgugugccagagcuccagcaugcggaagacggacuggcugccgaugaccguggccgccaugggcgugccgccccugccccucuucaucuucucccugaaggacacccugaagcgccgcagcuggccgcucaacgagggggugauggccaucggccugguguccauccuggccagcucccuccugcggaacgacguccccauggcgggcccccugguggccgggggccuccugaucgccugcuacgugaucaccgggacgagcgccgaccugaccgucgagaaggccgcggacgugaccugggaggaggaggccgagcagaccggcgugucccacaaccucaugaucacggucgacgacgacgggaccaugcgcaucaaggacgacgagaccgagaacauccugaccgugcugcucaagaccgcccugcugaucgugagcggcaucuuccccuacuccaucccggccacgcuccuggucuggcacaccuggcagaagcagacccagcggagcggcgugcugugggacgugcccagcccgcccgagacccagaaggccgagcucgaggagggggucuaccgcaucaagcagcagggcaucuucgggaagacccaggugggcguggggauccagaaggagggcgucuuccacaccauguggcacgugacccggggcgcggugcugacccacaacgggaagcgccuggagccgaacugggccagcgucaagaaggaccucaucuccuacggcgggggcuggcggcugagcgcccaguggcagaagggggaggagguccaggugaucgccgucgagcccggcaagaaccccaagaacuuccagacgaugcccggcaucuuccagaccaccaccggggagaucggcgcgaucgcccuggacuucaagccggggacguccggcagccccaucaucaaccgcgagggcaaggugguggggcuguacggcaacggggucgugaccaagaacggcggguacgugagcggcaucgcccagaccaacgccgagcccgacggcccgacccccgagcucgaggaggagauguucaagaagcggaaccugacgaucauggaccugcaccccggguccggcaagacccgcaaguaccuccccaccaucguccgggaggccaucaagcgccggcugcgcacccugauccucgcgccgacgcgggugguggccgccgagauggaggaggcccugaaggggcugcccauccgcuaccagaccaccgccaccaagagcgagcacacgggcaaggagaucgucgaccucaugugccacgcgaccuucaccaugcggcugcugucccccgugcgcgugcccaacuacaaccucaucaucauggacgaggcccacuucaccgacccggccagcaucgccgcccggggguacaucuccacgcgcgucggcaugggcgaggcggccgccaucuucaugaccgccacgccgcccgggaccgcggacgccuucccccagagcaacgccccgauccaggacgaggagcgggacauccccgagcgcuccuggaacagcggcaacgaguggaucacggacuucguggggaagaccgugugguucguccccuccaucaaggccggcaacgacaucgccaacugccugcgcaagaacgggaagaaggugauccagcugagccggaagaccuucgacaccgaguaccagaagacgaagcucaacgacugggacuucguggucaccaccgacaucuccgagaugggcgcgaacuucaaggccgaccgcgugaucgacccccggcgcugccugaagccggugauccugaccgacggccccgagcgggucauccucgccgggcccaugcccgugacgguggccagcgccgcgcagcgccggggccgcgucgggcggaacccgcagaaggagaacgaccaguacaucuucaccggccagccccugaacaacgacgaggaccacgcccacuggaccgaggccaagaugcugcucgacaacaucaacacccccgaggggaucauccccgcccuguucgagccggagcgcgagaaguccgccgcgaucgacggcgaguaccggcugaagggcgagagccgcaagaccuucguggagcucaugcggcgcggggaccugcccgucuggcuggcccacaagguggccuccgagggcaucaaguacacggaccggaaguggugcuucgacggggagcgcaacaaccagauccucgaggagaacauggacguggagaucuggaccaaggagggcgagaagaagaagcugcggccccgcuggcuggacgcccggaccuacagcgacccccucgcgcugaaggaguucaaggacuucgccgccggccgcaaguccaucgcccuggaccucgucaccgagaucgggcgcgugccgagccaccuggccuaccggacgcgcuccgcgcuggacaaccucgugaugcugcacaccagcgagcacggcgggcgggccuaccgccacgccgucgaggagcugcccgagaccauggagacccuccugcugcucggccugaugauccugcucaccggcggggccaugcuguuccugaucagcgggaaggggaucggcaagaccuccaucgggcucaucugcgugguggccagcuccggcaugcuguggauggcggacgucccccugcaguggaucgccagcgccaucgugcucgaguucuucaugauggugcugcugaucccggagcccgagaagcagcggacgccccaggacaaccagcucgccuacgucgugaucgggauccugacccuggccgcgaucguggccgccaacgagaugggccuccuggagacgaccaagcgcgaccugggcauguccaaggagcccggggucgugagcccgaccuccuaccucgacguggaccugcaccccgccagcgccuggacccuguacgcggucgccacgaccgugaucacccccaugcuccggcacaccaucgagaacuccacggccaacgugagccuggccgcgaucgccaaccaggccgucgugcugaugggccucgacaagggguggcccaucuccaagauggaccugggcgugccgcugcucgcccuggggugcuacagccaggucaacccccugacccucaccgccgcggugcugcugcucgugacccacuacgccaucaucggccccggccugcaggccaaggccacgcgcgaggcccagaagcggaccgcggccgggaucaugaagaaccccaccgucgacggcaucaugaccaucgaccuggacccggugaucuacgacuccaaguucgagaagcagcucggccaggugaugcugcugguccucugcgccgugcagcugcugcucaugcgcacgagcugggccuucugcgaggcccugacccuggcgaccggccccaucaccacgcucugggagggcucccccgggaaguucuggaacaccaccaucgccgugagcauggccaacaucuuccggggcuccuaccuggccggggcgggccuggccuucagcaucaugaaguccgucgggaccggcaagcgcggcacggggagccagggcgagacccucggggagaaguggaagaagaagcugaaccagcugagccggaaggaguucgaccucuacaagaaguccggcaucaccgagguggaccgcaccaaggccaaggaggggcugaagcggggcgagaccacgcaccacgccgugagccgcggcuccgccaagcugcagugguucgucgagcggaacauggugauccccgaggggcgcgugaucgaccucggcugcgggcggggcggguggagcuacuacugcgcgggccugaagaaggucaccgaggugcgcggcuacaccaagggcgggccggggcacgaggagcccgugcccauguccaccuacggcuggaacaucgucaagcugaugagcgggaaggacguguucuaccucccgcccgagaagugcgacacgcugcugugcgacaucggcgaguccagccccucccccaccguggaggagagccggaccauccgcguccugaagaugguggagcccuggcucaagaacaaccaguucugcaucaaggugcugaaccccuacaugcccaccgucaucgagcaccuggagcgccuccagcggaagcacggcgggaugcuggugcgcaacccccugucccggaacagcacgcacgagauguacuggaucuccaacggcaccgggaacaucgugagcuccgucaacauggugagccgccuccugcugaaccgguucaccaugacccaccgccggcccacgaucgagaaggacgucgaccucggcgccggcacccgccacgugaacgccgagccggagacccccaacauggacgugaucggggagcggauccgccggaucaaggaggagcacuccagcaccuggcacuacgacgacgagaaccccuacaagacgugggccuaccacggcuccuacgaggucaaggccaccgggagcgcgagcuccaugaucaacggcguggugaagcugcugaccaagccgugggacgucgugcccaccgugacgcagauggccaugaccgacaccacccccuucgggcagcagcgcgucuucaaggagaagguggacacgcggacgccccgcccgaugcccggcacccggaaggugauggagaucaccgccgaguggcucuggcgcacccugggccggaacaagcgcccccggcugugcacccgcgaggaguucaccaagaagguccgcaccaacgccgccaugggggcgguguucacggaggagaaccagugggacagcgcccgggccgccguggaggacgaggaguucuggaagcucgucgaccgcgagcgggagcugcacaagcugggcaagugcggguccugcguguacaacaugaugggcaagcgcgagaagaagcucggggaguucggcaaggcgaagggcagccgggccaucugguacauguggcugggggcccgcuaccuggaguucgaggcccucggcuuccugaacgaggaccacugguucucccgggagaacagcuacuccgggguggagggcgaggggcugcacaagcucggcuacauccugcgcgacaucagcaagacccccggcggggccauguacgcggacgacaccgccggcugggacacccggaucacggaggacgaccugcacaacgaggagaagaucacccagcagauggacccggagcaccgccagcucgccaacgccaucuucaagcugaccuaccagaacaaggucgugaaggugcagcggcccacccccaaggggaccgucauggacaucaucucccgcaaggaccagcggggcagcggccagguggggacguacggccugaacaccuucaccaacauggaggcccagcucauccgccagauggagggggagggcgugcuguccaaggcggaccuggagaacccccaccucccggagaagaagaucacccaguggcuggagacgaagggggucgagcggcugaagcgcauggccaucagcggcgacgacugcguggugaagcccaucgacgaccgguucgccaacgcccuccuggcccugaacgacaugggcaagguccgcaaggacaucccccaguggcagcccuccaagggguggcacgacuggcagcaggucccguucugcagccaccacuuccacgagcucaucaugaaggacggccggaagcuggugguccccugccgcccccaggacgagcugaucgggcgggcgcgcaucucccagggcgccggguggagccucaaggagaccgccugccugggcaaggccuacgcccagauguggucccugauguacuuccaccgccgggaccuccgccuggcgagcaacgccaucugcuccgccgugcccgugcacugggucccgaccagccggaccacguggagcauccacgcccaccaccaguggaugaccaccgaggacaugcugaccguguggaaccgcguguggaucgaggacaaccccuggauggaggacaagacgcccgucaccaccugggaggacgugcccuaccucggcaagcgggaggaccaguggugcgggucccugaucggccugaccagccgcgcgacgugggcccagaacauccucaccgccauccagcagguccggucccugaucgggaacgaggaguuccuggacuacaugccgagcaugaagcgcuuccggaaggaggaggaguccgagggcgccaucugguga

SEQ ID NO: 10400 - RNA, 9873 nt, Artificial Sequence
  derived and/or modified CDS sequence (opt1) from DENV-3__DQ675521__SS-prME
accagcuucugccugaugaugaugcuccccgccacccuggccuuccaccugacgucccgcgacggcgagccgcggaugaucguggggaagaacgagcgcggcaagagccuccuguucaagaccgcguccgggaucaacaugugcacccugaucgccauggaccucggcgagaugugcgacgacaccgucacguacaagugcccccugaucgccgagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccauccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacaccgugaucaucacggugcacaccggggaccagcaccaggucggcaacgacacccagggggugaccgucgagaucacgccccaggccagcaccguggaggccgugcugcccgaguacggcacccuggggcucgagugcuccccgcgcaccggccuggacuucaacgagaugauccugcucaccaugaagaacaaggcguggaugguccaccggcagugguucuucgaccugccccugcccuggacgagcggcgccaccaccgagacccccacguggaaccgcaaggagcuccuggugaccuucaagaacgcccacgccaagaagcaggagguggucgugcuggggucccaggagggcgccaugcacaccgcgcucaccggggccacggagauccagaacagcggcgggaccuccaucuucgccggccaccugaagugccggcugaagauggacaagcucgagcugaagggcaugagcuacgccaugugccugaacaccuucgugcucaagaaggaggucuccgagacccagcacgggacgauccugaucaagguggaguacaagggcgaggacgccccgugcaagauccccuucagcaccgaggacgggcagggcaaggcgcacaacggccgccugaucaccgccaaccccguggucaccaagaaggaggagcccgugaacaucgaggccgagccgcccuucggggagagcaacaucgugaucggcaucggggacaaggcccugaagaucaacugguacaagaagggcuccagcaucgggaagauguucgaggcgacggcccggggcgcccgccggauggccauccucggcgacaccgccugggacuucggguccgucggcggggugcugaacagccugggcaagauggugcaccagaucuucggguccgcguacaccgcccucuucagcggcgucuccuggaucaugaagaucggcaucggggugcugcugaccuggaucggccucaacagcaagaacacguccaugagcuucuccugcaucgugaucgggaucaucacccuguaccugggcgccgucgugcaggccgacauggggugcgugaucaacuggaagggcaaggagcucaagugcggcagcgggaucuucgucaccaacgaggugcacaccuggacggagcaguacaaguuccaggccgacucccccaagcgccuggcgaccgccaucgccggcgccugggagaacggggugugcggcauccgcagcaccacccggauggagaaccugcucuggaagcagaucgccaacgagcugaacuacauccugugggagaacaacaucaagcucacggucguggugggggacaucaucggcguccuggagcagggcaagcgcacccugaccccccagccgauggagcucaaguacuccuggaagaccugggggaaggcgaagaucgugacggccgagauccagaacagcuccuucaucaucgacggccccaacacccccgagugccccagcgccucccgggccuggaacgugugggaggucgaggacuacggguucggcguguucaccaccaacaucuggcugaagcugcgcgagauguacacgcagagcugcgaccaccggcucaugagcgcggccaucaaggacgagcgcgccgugcacgccgacaugggcuacuggaucgagucccagaagaacgggagcuggaagcuggagaaggccuccuucaucgaggucaagaccugcaccuggccgaagagccacacccugugguccaacggcgugcucgagagcgacaugaucauccccaagucccuggcggggcccaucagccagcacaaccaccggccgggcuaccacacccagacggccgggcccuggcaccugggcaagcucgagcuggacuucaacuacugcgagggcaccaccguggucaucaccgagaacugcgggacgcgcggccccucccugcggaccaccaccgugagcgggaagcucauccacgaguggugcugccgcuccugcacgcugcccccgcugcgguacaugggcgaggacgggugcugguacggcauggagauccgccccaucaacgagaaggaggagaacauggugaagagccucgucuccgccggcagcgggaagguggacaacuucaccaugggcgugcugugccuggccauccucuucgaggaggucaugcgggggaaguucggcaagaagcacaugaucgugggggugcuguucaccuucguccugcuccuguccggccagaucaccuggcgcgacauggcccacacgcugaucaugaucggcagcaacgcguccgaccggauggggaugggcgugaccuaccucgcccugaucgccaccuucaagauccagcccuuccuggcccucggguucuuccugcgcaagcugaccagccgggagaaccuccugcugggcgugggccucgccauggcgacgacccugcagcugcccgaggacaucgagcagauggccaacgggaucgcccucggccugaugacccugaagcucaucacccaguucgagacguaccagcuguggaccgcccuggucagccucaccugcuccaacaccaucuucacgcugaccguggcguggcgcaccgccacccugauccucgccggggucagccugcugccgcucugccaguccagcuccaugcggaagacggacuggcugcccaugaccguggccgccaugggcgugcccccccugccgcucuucaucuucagccugaaggacacccccaagcgccgcuccuggccccugaacgagggggucauggcggugggccucgugagcauccuggccuccagccugcuccggaacgacguccccauggccggcccgcugguggccgggggccugcucaucgccugcuacgugaucaccgggacguccgcggaccugaccgucgagaaggccgccgacgugaccugggaggaggaggccgagcagaccggcgugagccacaaccugaugaucacggucgacgacgacgggaccaugcgcaucaaggacgacgagaccgagaacauccucaccgugcugcugaagaccgcccuccugaucguguccggcaucuuccccuacagcauccccgcgacgcugcucgucuggcacaccuggcagaagcagacccagcgguccggcgugcugugggacgugcccagcccgcccgagacccagaaggccgagcuggaggagggggucuaccgcaucaagcagcagggcaucuucgggaagacgcaggugggcguggggguccagaaggagggcguguuccacaccauguggcacgugacccggggcgccguccucacccacaacgggaagcgccuggagcccaacugggccuccgugaagaaggaccugaucagcuacggcgggggcuggcggcucuccgcccaguggcagaagggggaggaggugcaggucaucgcgguggagcccggcaagaacccgaagaacuuccagacgaugcccggcaucuuccagaccaccaccggggagaucggcgccaucgcccuggacuucaagcccgggacgagcggcagcccgaucaucaaccgcgagggcaagguggucgggcuguacggcaacgggguggugaccaagaacggcggguacgucuccggcaucgcccagaccaacgcggagcccgacggccccacccccgagcuggaggaggagauguucaagaagcggaaccucacgaucauggaccugcacccggggagcggcaagacccgcaaguaccugcccgccaucgugcgggaggccaucaagcgccggcuccgcacccugauccuggcccccacccggguggucgccgcggagauggaggaggcccucaaggggcugcccauccgcuaccagacgaccgccaccaaguccgagcacaccggccgggagaucguggaccugaugugccacgccacguucaccaugcgccuccugagcccggugcggguccccaacuacaaccugaucaucauggacgaggcccacuucaccgaccccgcguccaucgccgcccgcggguacaucagcacccgggugggcaugggcgaggccgccgcgaucuucaugacggccacccccccggggaccgccgaggccuucccccaguccaacgcgcccauccaggacgaggagcgcgacauccccgagcgcagcuggaacuccggcaacgaguggaucaccgacuucguggggaagacggucugguucgugccgagcaucaaggccggcaacgacaucgccaacugccuccggaagaacgggaagaaggugauccagcugucccgcaagaccuucgacaccgaguaccagaagacccggcugaacgacugggacuucgucgugacgaccgacaucagcgagaugggcgccaacuuccgcgccgaccgggugaucgacccccgccggugccucaagcccgucauccugaccgacggccccgagcgcgugauccuggcggggccgaugcccgugaccgccgccuccgccgcccagcggcgcggccgggucgggcgcaacccccagaaggagaacgaccaguacaucuucacgggccagccccucaacaacgacgaggaccacgcgcacuggaccgaggccaagaugcugcuggacaacaucaacaccccggaggggaucauccccgcccucuucgagcccgagcgggagaagagcgccgccaucgacggcgaguaccgccugaagggcgagucccggaagaccuucguggagcugaugcgccggggggaccuccccgucuggcuggcgcacaagguggccagcgagggcaucaaguacaccgaccgcaaguggugcuucgacggggagcggaacaaccagauccuggaggagaacauggacguggagaucuggacgaaggagggcgagcgcaagaagcuccgcccgcgguggcuggacgcccgcaccuacuccgacccccuggcccucaaggaguucaaggacuucgcggccggccggaagagcaucgcccuggaccuggucaccgagaucgggcgcgugcccucccaccucgcccaccggacccgcaacgcccuggacaaccuggugaugcuccacacgagcgagcacggcgggcgggcguaccgccacgccgucgaggagcugccggagaccauggagacccugcuccugcugggccucaugauccugcugaccgggggcgccaugcucuuccugaucagcggcaaggggaucggcaagacguccaucgggcugaucugcgugaucgugagcuccggcaugcucuggauggccgacgucccccugcaguggaucgccagcgcgaucgugcuggaguucuucaugauggugcuccugauccccgagcccgagaagcagcggaccccgcaggacaaccagcuggccuacgucgugaucgggauccucacccuggccgccaucguggccgcgaacgagaugggccugcucgagaccacgaagcgcgaccugggcauguccaaggagcccggggucgugagccccaccuccuaccuggacguggaccuccaccccgccagcgccuggacccuguacgccgucgccaccacggugaucaccccgaugcugcggcacaccaucgagaacuccaccgcgaacgugagccucgccgccaucgccaaccaggcggucgugcugaugggccuggacaagggguggcccaucuccaagauggaccucggcgugccccugcuggcccucgggugcuacagccaggucaacccccugacgcugaccgccgccgugcuccugcuggugacccacuacgccaucaucggcccgggccuccaggcgaaggccacccgcgaggcccagaagcggacggccgccgggaucaugaagaaccccaccgucgacggcaucaugaccaucgaccuggaccccgugaucuacgacuccaaguucgagaagcagcuggggcaggugaugcuccugguccugugcgcggugcagcuccugcugaugcgcaccagcugggcccucugcgaggcccugacgcuggccaccggccccaucaccacccucugggagggcuccccggggaaguucuggaacacgaccaucgccgugagcauggcgaacaucuuccggggcuccuaccuggccggggccggccuggccuucagcaucaugaaguccgucgggaccggccgccggggcaccgggagccagggcgagacgcucggggagaaguggaagaagaagcugaaccagcugagccgcaaggaguucgaccucuacaagaaguccggcaucaccgagguggaccggaccgaggcgaaggaggggcugaagcgcggcgagaccacccaccacgccgugagccggggcuccgccaagcugcagugguucgucgagcgcaacauggugauccccgaggggcgcgugaucgaccucggcugcgggcggggcggguggagcuacuacugcgccggccugaagaaggucacggaggugcgcggcuacaccaaggggggccccgggcacgaggagcccgugccgauguccaccuacggcuggaacaucgucaagcugaugagcgggaaggacguguucuaccucccccccgagaagugcgacacccugcugugcgacaucggcgaguccagccccuccccgacgguggaggagagccggaccauccgcguccugaagaugguggagcccuggcucaagaacaaccaguucugcaucaaggugcugaaccccuacaugcccaccgucaucgagcaccuggagcggcuccagcgcaaguacggcgggaugcuggugcggaacccgcugucccgcaacagcacccacgagauguacuggaucuccaacggcacggggaacaucgugagcuccgucaacauggugagccggcuccugcugaaccgcuucaccaugacccaccggcgccccaccaucgagaaggacgucgaccucggcgccggcacgcggcacgugaacgcggagcccgagaccccgaacauggacgugaucggggagcgcaucaagcggaucaaggaggagcacuccagcaccuggcacuacgacgacgagaaccccuacaagaccugggccuaccacggcuccuacgaggucaaggccacggggagcgccagcuccaugaucaacggcguggugaagcugcugaccaagcccugggacgucgugcccauggugacccagauggccaugaccgacacgaccccguucgggcagcagcgcgucuucaaggagaagguggacacccggaccccccgccccaugcccggcacgcggaaggugauggagaucaccgcggaguggcucuggcgcacccugggccgcaacaagaagccgcggcugugcacccgcgaggaguucacgaagaagguccggaccaacgccgccaugggggccguguucaccgaggagaaccagugggacagcgcccgcgcggccguggaggacgaggaguucuggaagcucgucgaccgggagcgcgagcugcacaagcugggcaagugcggguccugcguguacaacaugaugggcaagcgggagaagaagcucggggaguucggcaaggccaagggcagccgcgccaucugguacauguggcugggggcgcgguaccuggaguucgaggcccucggcuuccugaacgaggaccacugguucucccgcgagaacagcuacuccgggguggagggcgaggggcugcacaagcucggcuacauccugcgggacaucagcaagauccccggcggggccauguacgccgacgacaccgccggcugggacacgcgcaucaccgaggacgaccugcacaacgaggagaagaucacccagcagauggaccccgagcaccggcagcucgcguccgccaucuucaagcugaccuaccagaacaaggucgugaaggugcagcgccccacgccgaaggggaccgucauggacaucaucagccggaaggaccagcgcggcuccggccagguggggaccuacggccugaacaccuucaccaacauggaggcccagcucgugcggcagauggagggggagggcguccugagcaaggccgaccuggagaacccccaccuccuggagaagaagaucacgcaguggcuggagaccaaggggguggagcgccucaagcggauggccaucuccggcgacgacugcguggucaagcccaucgacgaccgcuucgcgaacgcccugcuggcccucaacgacaugggcaaggugcggaaggacaucccccaguggcagccgagcaagggguggcacgacuggcagcaggugcccuucugcucccaccacuuccacgagcugaucaugaaggacggccgcaagcuggucgugcccugccgcccccaggacgagcucaucgggcgggcccgcaucagccagggcgccggguggucccugaaggagaccgcgugccugggcaaggccuacgcccagauguggagccucauguacuuccaccggcgcgaccugcggcuggccuccaacgccaucugcagcgcggugccgguccacugggugcccaccagccgcacgaccugguccauccacgcccaccaccaguggaugaccaccgaggacaugcucacgguguggaaccgggucuggaucgaggacaaccccuggauggaggacaagacccccgugaccaccugggaggacgugccguaccugggcaagcgcgaggaccaguggugcgggagccugaucggccucacgucccgggccaccugggcccagaacauccugaccgcgauccagcagguccgcagccugaucggggacgaggaguuccucgacuacaugcccuccaugaagcgguuccgcaaggaggaggagagcgagggcgccaucugguga

SEQ ID NO: 10401 - RNA, 9873 nt, Artificial Sequence
  derived and/or modified CDS sequence (opt1) from DENV-3__DQ675522__SS-prME
accagcuucugccugaugaugaugcuccccgccacccuggccuuccaccugacgucccgcgacggcgagccgcggaugaucguggggaagaacgagcgcggcaagagccuccuguucaagaccgcguccgggaucaacaugugcacccugaucgccauggaccucggcgagaugugcgacgacaccgucacguacaagugcccccugaucgccgagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccauccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacaccgugaucaucacggugcacaccggggaccagcaccaggucggcaacgacacccagggggugaccgucgagaucacgccccaggccagcaccguggaggccgugcugcccgaguacggcacccuggggcucgagugcuccccgcgcaccggccuggacuucaacgagaugauccugcucaccaugaagaacaaggcguggaugguccaccggcagugguucuucgaccugccccugcccuggacgagcggcgccaccaccgagacccccacguggaaccgcaaggagcuccuggugaccuucaagaacgcccacgccaagaagcaggagguggucgugcuggggucccaggagggcgccaugcacaccgcgcucaccggggccacggagauccagaacagcggcgggaccuccaucuucgccggccaccugaagugccggcugaagauggacaagcucgagcugaagggcaugagcuacgccaugugccugaacaccuucgugcucaagaaggaggucuccgagacccagcacgggacgauccugaucaagguggaguacaagggcgaggacgccccgugcaagauccccuucagcaccgaggacgggcagggcaaggcgcacaacggccgccugaucaccgccaaccccguggucaccaagaaggaggagcccgugaacaucgaggccgagccgcccuucggggagagcaacaucgugaucggcaucggggacaaggcccugaagaucaacugguacaagaagggcuccagcaucgggaagauguucgaggcgacggcccggggcgcccgccggauggccauccucggcgacaccgccugggacuucggguccgucggcggggugcugaacagccugggcaagauggugcaccagaucuucggguccgcguacaccgcccucuucagcggcgucuccuggaucaugaagaucggcaucggggugcugcugaccuggaucggccucaacagcaagaacacguccaugagcuucuccugcaucgugaucgggaucaucacccuguaccugggcgccgucgugcaggccgacauggggugcgugaucaacuggaagggcaaggagcucaagugcggcagcgggaucuucgucaccaacgaggugcacaccuggacggagcaguacaaguuccaggccgacucccccaagcgccuggcgaccgccaucgccggcgccugggagaacggggugugcggcauccgcagcaccacccggauggagaaccugcucuggaagcagaucgccaacgagcugaacuacauccugugggagaacaacaucaagcucacggucguggugggggacaucaucggcguccuggagcagggcaagcgcacccugaccccccagccgauggagcucaaguacuccuggaagaccugggggaaggcgaagaucgugacggccgagauccagaacagcuccuucaucaucgacggccccaacacccccgagugccccagcgccucccgggccuggaacgugugggaggucgaggacuacggguucggcguguucaccaccaacaucuggcugaagcugcgcgagauguacacgcagagcugcgaccaccggcucaugagcgcggccaucaaggacgagcgcgccgugcacgccgacaugggcuacuggaucgagucccagaagaacgggagcuggaagcuggagaaggccuccuucaucgaggucaagaccugcaccuggccgaagagccacacccugugguccaacggcgugcucgagagcgacaugaucauccccaagucccuggcggggcccaucagccagcacaaccaccggccgggcuaccacacccagacggccgggcccuggcaccugggcaagcucgagcuggacuucaacuacugcgagggcaccaccguggucaucaccgagaacugcgggacgcgcggccccucccugcggaccaccaccgugagcgggaagcucauccacgaguggugcugccgcuccugcacgcugcccccgcugcgguacaugggcgaggacgggugcugguacggcauggagauccgccccaucaacgagaaggaggagaacauggugaagagccucgucuccgccggcagcgggaagguggacaacuucaccaugggcgugcugugccuggccauccucuucgaggaggucaugcgggggaaguucggcaagaagcacaugaucgugggggugcuguucaccuucguccugcuccuguccggccagaucaccuggcgcgacauggcccacacgcugaucaugaucggcagcaacgcguccgaccggauggggaugggcgugaccuaccucgcccugaucgccaccuucaagauccagcccuuccuggcccucggguucuuccugcgcaagcugaccagccgggagaaccuccugcugggcgugggccucgccauggcgacgacccugcagcugcccgaggacaucgagcagauggccaacgggaucgcccucggccugaugacccugaagcucaucacccaguucgagacguaccagcuguggaccgcccuggucagccucaccugcuccaacaccaucuucacgcugaccguggcguggcgcaccgccacccugauccucgccggggucagccugcugccgcucugccaguccagcuccaugcggaagacggacuggcugcccaugaccguggccgccaugggcgugcccccccugccgcucuucaucuucagccugaaggacacccccaagcgccgcuccuggccccugaacgagggggucauggcggugggccucgugagcauccuggccuccagccugcuccggaacgacguccccauggccggcccgcugguggccgggggccugcucaucgccugcuacgugaucaccgggacguccgcggaccugaccgucgagaaggccgccgacgugaccugggaggaggaggccgagcagaccggcgugagccacaaccugaugaucacggucgacgacgacgggaccaugcgcaucaaggacgacgagaccgagaacauccucaccgugcugcugaagaccgcccuccugaucguguccggcaucuuccccuacagcauccccgcgacgcugcucgucuggcacaccuggcagaagcagacccagcgguccggcgugcugugggacgugcccagcccgcccgagacccagaaggccgagcuggaggagggggucuaccgcaucaagcagcagggcaucuucgggaagacgcaggugggcguggggguccagaaggagggcguguuccacaccauguggcacgugacccggggcgccguccucacccacaacgggaagcgccuggagcccaacugggccuccgugaagaaggaccugaucagcuacggcgggggcuggcggcucuccgcccaguggcagaagggggaggaggugcaggucaucgcgguggagcccggcaagaacccgaagaacuuccagacgaugcccggcaucuuccagaccaccaccggggagaucggcgccaucgcccuggacuucaagcccgggacgagcggcagcccgaucaucaaccgcgagggcaagguggucgggcuguacggcaacgggguggugaccaagaacggcggguacgucuccggcaucgcccagaccaacgcggagcccgacggccccacccccgagcuggaggaggagauguucaagaagcggaaccucacgaucauggaccugcacccggggagcggcaagacccgcaaguaccugcccgccaucgugcgggaggccaucaagcgccggcuccgcacccugauccuggcccccacccggguggucgccgcggagauggaggaggcccucaaggggcugcccauccgcuaccagacgaccgccaccaaguccgagcacaccggccgggagaucguggaccugaugugccacgccacguucaccaugcgccuccugagcccggugcggguccccaacuacaaccugaucaucauggacgaggcccacuucaccgaccccgcguccaucgccgcccgcggguacaucagcacccgggugggcaugggcgaggccgccgcgaucuucaugacggccacccccccggggaccgccgaggccuucccccaguccaacgcgcccauccaggacgaggagcgcgacauccccgagcgcagcuggaacuccggcaacgaguggaucaccgacuucguggggaagacggucugguucgugccgagcaucaaggccggcaacgacaucgccaacugccuccggaagaacgggaagaaggugauccagcugucccgcaagaccuucgacaccgaguaccagaagacccggcugaacgacugggacuucgucgugacgaccgacaucagcgagaugggcgccaacuucaaggccgaccgcgugaucgacccccggcgcugccucaagcccgucauccugaccgacggccccgagcgggugauccuggcggggccgaugcccgugaccgccgccuccgccgcccagcgccggggccgcgucgggcggaacccccagaaggagaacgaccaguacaucuucacgggccagccccucaacaacgacgaggaccacgcgcacuggaccgaggccaagaugcugcuggacaacaucaacaccccggaggggaucauccccgcccucuucgagcccgagcgcgagaagagcgccgccaucgacggcgaguaccggcugaagggcgagucccgcaagaccuucguggagcugaugcggcgcggggaccuccccgucuggcuggcgcacaagguggccagcgagggcaucaaguacaccgaccggaaguggugcuucgacggggagcgcaacaaccagauccuggaggagaacauggacguggagaucuggacgaaggagggcgagcggaagaagcuccgcccgcgcuggcuggacgcccggaccuacuccgacccccuggcccucaaggaguucaaggacuucgcggccggccgcaagagcaucgcccuggaccuggucaccgagaucgggcgggugcccucccaccucgcccaccgcacccggaacgcccuggacaaccuggugaugcuccacacgagcgagcacggcgggcgcgcguaccggcacgccgucgaggagcugccggagaccauggagacccugcuccugcugggccucaugauccugcugaccgggggcgccaugcucuuccugaucagcggcaaggggaucggcaagacguccaucgggcugaucugcgugaucgugagcuccggcaugcucuggauggccgacgucccccugcaguggaucgccagcgcgaucgugcuggaguucuucaugauggugcuccugauccccgagcccgagaagcagcgcaccccgcaggacaaccagcuggccuacgucgugaucgggauccucacccuggccgccaucguggccgcgaacgagaugggccugcucgagaccacgaagcgggaccugggcauguccaaggagcccggggucgugagccccaccuccuaccuggacguggaccuccaccccgccagcgccuggacccuguacgccgucgccaccacggugaucaccccgaugcugcgccacaccaucgagaacuccaccgcgaacgugagccucgccgccaucgccaaccaggcggucgugcugaugggccuggacaagggguggcccaucuccaagauggaccucggcgugccccugcuggcccucgggugcuacagccaggucaacccccugacgcugaccgccgccgugcuccugcuggugacccacuacgccaucaucggcccgggccuccaggcgaaggccacccgggaggcccagaagcgcacggccgccgggaucaugaagaaccccaccgucgacggcaucaugaccaucgaccuggaccccgugaucuacgacuccaaguucgagaagcagcuggggcaggugaugcuccugguccugugcgcggugcagcuccugcugaugcggaccagcugggcccucugcgaggcccugacgcuggccaccggccccaucaccacccucugggagggcuccccggggaaguucuggaacacgaccaucgccgugagcauggcgaacaucuuccgcggcuccuaccuggccggggccggccuggccuucagcaucaugaaguccgucgggaccggccggcgcggcaccgggagccagggcgagacgcucggggagaaguggaagaagaagcugaaccagcugagccggaaggaguucgaccucuacaagaaguccggcaucaccgagguggaccgcaccgaggcgaaggaggggcugaagcggggcgagaccacccaccacgccgugagccgcggcuccgccaagcugcagugguucgucgagcggaacauggugauccccgaggggcgcgugaucgaccucggcugcgggcgcggcggguggagcuacuacugcgccggccugaagaaggucacggaggugcggggcuacaccaaggggggccccgggcacgaggagcccgugccgauguccaccuacggcuggaacaucgucaagcugaugagcgggaaggacguguucuaccucccccccgagaagugcgacacccugcugugcgacaucggcgaguccagccccuccccgacgguggaggagagccgcaccauccggguccugaagaugguggagcccuggcucaagaacaaccaguucugcaucaaggugcugaaccccuacaugcccaccgucaucgagcaccuggagcgccuccagcggaaguacggcgggaugcuggugcgcaacccgcugucccggaacagcacccacgagauguacuggaucuccaacggcacggggaacaucgugagcuccgucaacauggugagccgccuccugcugaaccgguucaccaugacccaccgccggcccaccaucgagaaggacgucgaccucggcgccggcacgcgccacgugaacgcggagcccgagaccccgaacauggacgugaucggggagcggaucaagcgcaucaaggaggagcacuccagcaccuggcacuacgacgacgagaaccccuacaagaccugggccuaccacggcuccuacgaggucaaggccacggggagcgccagcuccaugaucaacggcguggugaagcugcugaccaagcccugggacgucgugcccauggugacccagauggccaugaccgacacgaccccguucgggcagcagcgggucuucaaggagaagguggacacccgcaccccccggcccaugcccggcacgcgcaaggugauggagaucaccgcggaguggcucuggcggacccugggccgcaacaagaagccgcgccugugcacccgggaggaguucacgaagaagguccgcaccaacgccgccaugggggccguguucaccgaggagaaccagugggacagcgcccgggcggccguggaggacgaggaguucuggaagcucgucgaccgcgagcgggagcugcacaagcugggcaagugcggguccugcguguacaacaugaugggcaagcgcgagaagaagcucggggaguucggcaaggccaagggcagccgggccaucugguacauguggcugggggcgcgcuaccuggaguucgaggcccucggcuuccugaacgaggaccacugguucucccgggagaacagcuacuccgggguggagggcgaggggcugcacaagcucggcuacauccugcgcgacaucagcaagauccccggcggggccauguacgccgacgacaccgccggcugggacacgcggaucaccgaggacgaccugcacaacgaggagaagaucacccagcagauggaccccgagcaccgccagcucgcguccgccaucuucaagcugaccuaccagaacaaggucgugaaggugcagcggcccacgccgaaggggaccgucauggacaucaucagccgcaaggaccagcggggcuccggccagguggggaccuacggccugaacaccuucaccaacauggaggcccagcucgugcgccagauggagggggagggcguccugagcaaggccgaccuggagaacccccaccuccuggagaagaagaucacgcaguggcuggagaccaaggggguggagcggcucaagcgcauggccaucuccggcgacgacugcguggucaagcccaucgacgaccgguucgcgaacgcccugcuggcccucaacgacaugggcaaggugcgcaaggacaucccccaguggcagccgagcaagggguggcacgacuggcagcaggugcccuucugcucccaccacuuccacgagcugaucaugaaggacggccggaagcuggucgugcccugccgcccccaggacgagcucaucgggcgcgcccggaucagccagggcgccggguggucccugaaggagaccgcgugccugggcaaggccuacgcccagauguggagccucauguacuuccaccgccgggaccugcgccuggccuccaacgccaucugcagcgcggugccgguccacugggugcccaccagccggacgaccugguccauccacgcccaccaccaguggaugaccaccgaggacaugcucacgguguggaaccgcgucuggaucgaggacaaccccuggauggaggacaagacccccgugaccaccugggaggacgugccguaccugggcaagcgggaggaccaguggugcgggagccugaucggccucacgucccgcgccaccugggcccagaacauccugaccgcgauccagcagguccggagccugaucggggacgaggaguuccucgacuacaugcccuccaugaagcgcuuccggaaggaggaggagagcgagggcgccaucugguga

SEQ ID NO: 10402 - RNA, 9873 nt, Artificial Sequence
  derived and/or modified CDS sequence (opt1) from DENV-3__DQ675527__SS-prME
accagcuucugccugaugaugaugcuccccgccacccuggccuuccaccugacgucccgcgacggcgagccgcggaugaucguggggaagaacgagcgcggcaagagccuccuguucaagaccgcguccgggaucaacaugugcacccugaucgccauggaccucggcgagaugugcgacgacaccgucacguacaagugcccccugaucgccgagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccauccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacaccgugaucaucacggugcacaccggggaccagcaccaggucggcaacgacacccagggggugaccgucgagaucacgccccaggccagcaccguggaggccgugcugcccgaguacggcacccuggggcucgagugcuccccgcgcaccggccuggacuucaacgagaugauccugcucaccaugaagaacaaggcguggaugguccaccggcagugguucuucgaccugccccugcccuggacgagcggcgccaccaccgagacccccacguggaaccgcaaggagcuccuggugaccuucaagaacgcccacgccaagaagcaggagguggucgugcuggggucccaggagggcgccaugcacaccgcgcucaccggggccacggagauccagaacagcggcgggaccuccaucuucgccggccaccugaagugccggcugaagauggacaagcucgagcugaagggcaugagcuacgccaugugccugaacaccuucgugcucaagaaggaggucuccgagacccagcacgggacgauccugaucaagguggaguacaagggcgaggacgccccgugcaagauccccuucagcaccgaggacgggcagggcaaggcgcacaacggccgccugaucaccgccaaccccguggucaccaagaaggaggagcccgugaacaucgaggccgagccgcccuucggggagagcaacaucgugaucggcaucggggacaaggcccugaagaucaacugguacaagaagggcuccagcaucgggaagauguucgaggcgacggcccggggcgcccgccggauggccauccucggcgacaccgccugggacuucggguccgucggcggggugcugaacagccugggcaagauggugcaccagaucuucggguccgcguacaccgcccucuucagcggcgucuccuggaucaugaagaucggcaucggggugcugcugaccuggaucggccucaacagcaagaacacguccaugagcuucuccugcaucgugaucgggaucaucacccuguaccugggcgccgucgugcaggccgacauggggugcgugaucaacuggaagggcaaggagcucaagugcggcagcgggaucuucgucaccaacgaggugcacaccuggacggagcaguacaaguuccaggccgacucccccaagcgccuggcgaccgccaucgccggcgccugggagaacggggugugcggcauccgcagcaccacccggauggagaaccugcucuggaagcagaucgccaacgagcugaacuacauccugugggagaacaacaucaagcucacggucguggugggggacaucaucggcguccuggagcagggcaagcgcacccugaccccccagccgauggagcucaaguacuccuggaagaccugggggaaggcgaagaucgugacggccgagauccagaacagcuccuucaucaucgacggccccaacacccccgagugccccagcgccucccgggccuggaacgugugggaggucgaggacuacggguucggcguguucaccaccaacaucuggcugaagcugcgcgagauguacacgcagagcugcgaccaccggcucaugagcgcggccaucaaggacgagcgcgccgugcacgccgacaugggcuacuggaucgagucccagaagaacgggagcuggaagcuggagaaggccuccuucaucgaggucaagaccugcaccuggccgaagagccacacccugugguccaacggcgugcucgagagcgacaugaucauccccaagucccuggcggggcccaucagccagcacaaccaccggccgggcuaccacacccagacggccgggcccuggcaccugggcaagcucgagcuggacuucaacuacugcgagggcaccaccguggucaucaccgagaacugcgggacgcgcggccccucccugcggaccaccaccgugagcgggaagcucauccacgaguggugcugccgcuccugcacgcugcccccgcugcgguacaugggcgaggacgggugcugguacggcauggagauccgccccaucaacgagaaggaggagaacauggugaagagccucgucuccgccggcagcgggaagguggacaacuucaccaugggcgugcugugccuggccauccucuucgaggaggucaugcgggggaaguucggcaagaagcacaugaucgugggggugcuguucaccuucguccugcuccuguccggccagaucaccuggcgcgacauggcccacacgcugaucaugaucggcagcaacgcguccgaccggauggggaugggcgugaccuaccucgcccugaucgccaccuucaagauccagcccuuccuggcccucggguucuuccugcgcaagcugaccagccgggagaaccuccugcugggcgugggccucgccauggcgacgacccugcagcugcccgaggacaucgagcagauggccaacgggaucgcccucggccugaugacccugaagcucaucacccaguucgagacguaccagcuguggaccgcccuggucagccucaccugcuccaacaccaucuucacgcugaccguggcguggcgcaccgccacccugauccucgccggggucagccugcugccgcucugccaguccagcuccaugcggaagacggacuggcugcccaugaccguggccgccaugggcgugcccccccugccgcucuucaucuucagccugaaggacacccccaagcgccgcuccuggccccugaacgagggggucauggcggugggccucgugagcauccuggccuccagccugcuccggaacgacguccccauggccggcccgcugguggccgggggccugcucaucgccugcuacgugaucaccgggacguccgcggaccugaccgucgagaaggccgccgacgugaccugggaggaggaggccgagcagaccggcgugagccacaaccugaugaucacggucgacgacgacgggaccaugcgcaucaaggacgacgagaccgagaacauccucaccgugcugcugaagaccgcccuccugaucguguccggcaucuuccccuacagcauccccgcgacgcugcucgucuggcacaccuggcagaagcagacccagcgguccggcgugcugugggacgugcccagcccgcccgagacccagaaggccgagcuggaggagggggucuaccgcaucaagcagcagggcaucuucgggaagacgcaggugggcguggggguccagaaggagggcguguuccacaccauguggcacgugacccggggcgccguccucacccacaacgggaagcgccuggagcccaacugggccuccgugaagaaggaccugaucagcuacggcgggggcuggcggcucuccgcccaguggcagaagggggaggaggugcaggucaucgcgguggagcccggcaagaacccgaagaacuuccagacgaugcccggcaucuuccagaccaccaccggggagaucggcgccaucgcccuggacuucaagcccgggacgagcggcagcccgaucaucaaccgcgagggcaagguggucgggcuguacggcaacgggguggugaccaagaacggcggguacgucuccggcaucgcccagaccaacgcggagcccgacggccccacccccgagcuggaggaggagauguucaagaagcggaaccucacgaucauggaccugcacccggggagcggcaagacccgcaaguaccugcccgccaucgugcgggaggccaucaagcgccggcuccgcacccugauccuggcccccacccggguggucgccgcggagauggaggaggcccucaaggggcugcccauccgcuaccagacgaccgccaccaaguccgagcacaccggccgggagaucguggaccugaugugccacgccacguucaccaugcgccuccugagcccggugcggguccccaacuacaaccugaucaucauggacgaggcccacuucaccgaccccgcguccaucgccgcccgcggguacaucagcacccgggugggcaugggcgaggccgccgcgaucuucaugacggccacccccccggggaccgccgaggccuucccccaguccaacgcgcccauccaggacgaggagcgcgacauccccgagcgcagcuggaacuccggcaacgaguggaucaccgacuucguggggaagacggucugguucgugccgagcaucaaggccggcaacgacaucgccaacugccuccggaagaacgggaagaaggugauccagcugucccgcaagaccuucgacaccgaguaccagaagacccggcugaacgacugggacuucgucgugacgaccgacaucagcgagaugggcgccaacuucaaggccgaccgcgugaucgacccccggcgcugccucaagcccgucauccugaccgacggccccgagcgggugauccuggcggggccgaugcccgugaccgccgccuccgccgcccagcgccggggccgcgucgggcggaacccccagaaggagaacgaccaguacaucuucacgggccagccccucaacaacgacgaggaccacgcgcacuggaccgaggccaagaugcugcuggacaacaucaacaccccggaggggaucauccccgcccucuucgagcccgagcgcgagaagagcgccgccaucgacggcgaguaccggcugaagggcgagucccgcaagaccuucguggagcugaugcggcgcggggaccuccccgucuggcuggcgcacaagguggccagcgagggcaucaaguacaccgaccggaaguggugcuucgacggggagcgcaucaaccagauccuggaggagaacauggacguggagaucuggacgaaggagggcgagcggaagaaccuccgcccgcgcuggcuggacgcccggaccuacuccgacccccuggcccucaaggaguucaaggacuucgcggccggccgcaagagcaucgcccuggaccuggucaccgagaucgggcgggugcccucccaccucgcccaccgcacccggaacgcccuggacaaccuggugaugcuccacacgagcgagcacggcgggcgcgcguaccggcacgccgucgaggagcugccggagaccauggagacccugcuccugcugggccucaugauccugcugaccgggggcgccaugcucuuccugaucagcggcaaggggaucggcaagacguccaucgggcugaucugcgugaucgugagcuccggcaugcucuggauggccgacgucccccugcaguggaucgccagcgcgaucgugcuggaguucuucaugauggugcuccugauccccgagcccgagaagcagcgcaccccgcaggacaaccagcuggccuacgucgugaucgggauccucacccuggccgccaucguggccgcgaacgagaugggccugcucgagaccacgaagcgggaccugggcauguccaaggagcccggggucgugagccccaccuccuaccuggacguggaccuccaccccgccagcgccuggacccuguacgccgucgccaccacggugaucaccccgaugcugcgccacaccaucgagaacuccaccgcgaacgugagccucgccgccaucgccaaccaggcggucgugcugaugggccuggacaagggguggcccaucuccaagauggaccucggcgugccccugcuggcccucgggugcuacagccaggucaacccccugacgcugaccgccgccgugcuccugcuggugacccacuacgccaucaucggcccgggccuccaggcgaaggccacccgggaggcccagaagcgcacggccgccgggaucaugaagaaccccaccgucgacggcaucaugaccaucgaccuggaccccgugaucuacgacuccaaguucgagaagcagcuggggcaggugaugcuccugguccugugcgcggugcagcuccugcugaugcggaccagcugggcccucugcgaggcccugacgcuggccaccggccccaucaccacccucugggagggcuccccggggaaguucuggaacacgaccaucgccgugagcauggcgaacaucuuccgcggcuccuaccuggccggggccggccuggccuucagcaucaugaaguccgucgggaccggccggcgcggcaccgggagccagggcgagacgcucggggagaaguggaagaagaagcugaaccagcugagccggaaggaguucgaccucuacaagaaguccggcaucaccgagguggaccgcaccgaggcgaaggaggggcugaagcggggcgagaccacccaccacgccgugagccgcggcuccgccaagcugcagugguucgucgagcggaacauggugauccccgaggggcgcgugaucgaccucggcugcgggcgcggcggguggagcuacuacugcgccggccugaagaaggucacggaggugcggggcuacaccaaggggggccccgggcacgaggagcccgugccgauguccaccuacggcuggaacaucgucaagcugaugagcgggaaggacguguucuaccucccccccgagaagugcgacacccugcugugcgacaucggcgaguccagccccuccccgacgguggaggagagccgcaccauccggguccugaagaugguggagcccuggcucaagaacaaccaguucugcaucaaggugcugaaccccuacaugcccaccgucaucgagcaccuggagcgccuccagcggaaguacggcgggaugcuggugcgcaacccgcugucccggaacagcacccacgagauguacuggaucuccaacggcacggggaacaucgugagcuccgucaacauggugagccgccuccugcugaaccgguucaccaugacccaccgccggcccaccaucgagaaggacgucgaccucggcgccggcacgcgccacgugaacgcggagcccgagaccccgaacauggacgugaucggggagcggaucaagcgcaucaaggaggagcacuccagcaccuggcacuacgacgacgagaaccccuacaagaccugggccuaccacggcuccuacgaggucaaggccacggggagcgccagcuccaugaucaacggcguggugaagcugcugaccaagcccugggacgucgugcccauggugacccagauggccaugaccgacacgaccccguucgggcagcagcgggucuucaaggagaagguggacacccgcaccccccggcccaugcccggcacgcgcaaggugauggagaucaccgcggaguggcucuggcggacccugggccgcaacaagaagccgcgccugugcacccgggaggaguucacgaagaagguccgcaccaacgccgccaugggggccguguucaccgaggagaaccagugggacagcgcccgggcggccguggaggacgaggaguucuggaagcucgucgaccgcgagcgggagcugcacaagcugggcaagugcggguccugcguguacaacaugaugggcaagcgcgagaagaagcucggggaguucggcaaggccaagggcagccgggccaucugguacauguggcugggggcgcgcuaccuggaguucgaggcccucggcuuccugaacgaggaccacugguucucccgggagaacagcuacuccgggguggagggcgaggggcugcacaagcucggcuacauccugcgcgacaucagcaagauccccggcggggccauguacgccgacgacaccgccggcugggacacgcggaucaccgaggacgaccugcacaacgaggagaagaucacccagcagauggaccccgagcaccgccagcucgcguccgccaucuucaagcugaccuaccagaacaaggucgugaaggugcagcggcccacgccgaaggggaccgucauggacaucaucagccgcaaggaccagcggggcuccggccagguggggaccuacggccugaacaccuucaccaacauggaggcccagcucgugcgccagauggagggggagggcguccugagcaaggccgaccuggagaacccccaccuccuggagaagaagaucacgcaguggcuggagaccaaggggguggagcggcucaagcgcauggccaucuccggcgacgacugcguggucaagcccaucgacgaccgguucgcgaacgcccugcuggcccucaacgacaugggcaaggugcgcaaggacaucccccaguggcagccgagcaagggguggcacgacuggcagcaggugcccuucugcucccaccacuuccacgagcugaucaugaaggacggccggaagcuggucgugcccugccgcccccaggacgagcucaucgggcgcgcccggaucagccagggcgccggguggucccugaaggagaccgcgugccugggcaaggccuacgcccagauguggagccucauguacuuccaccgccgggaccugcgccuggccuccaacgccaucugcagcgcggugccgguccacugggugcccaccagccggacgaccugguccauccacgcccaccaccaguggaugaccaccgaggacaugcucacgguguggaaccgcgucuggaucgaggacaaccccuggauggaggacaagacccccgugaccaccugggaggacgugccguaccugggcaagcgggaggaccaguggugcgggagccugaucggccucacgucccgcgccaccugggcccagaacauccugaccgcgauccagcagguccggagccugaucggggacgaggaguuccucgacuacaugcccuccaugaagcgcuuccggaaggaggaggagagcgagggcgccaucugguga

SEQ ID NO: 10403 - RNA, 9873 nt, Artificial Sequence
  derived and/or modified CDS sequence (opt1) from DENV-3__DQ675528__SS-prME
accagcuucugccugaugaugaugcuccccgccacccuggccuuccaccugacgucccgcgacggcgagccgcggaugaucguggggaagaacgagcgcggcaagagccuccuguucaagaccgcguccgggaucaacaugugcacccugaucgccauggaccucggcgagaugugcgacgacaccgucacguacaagugcccccugaucgccgagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccauccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacaccgugaucaucacggugcacaccggggaccagcaccaggucggcaacgacacccagggggugaccgucgagaucacgccccaggccagcaccguggaggccgugcugcccgaguacggcacccuggggcucgagugcuccccgcgcaccggccuggacuucaacgagaugauccugcucaccaugaagaacaaggcguggaugguccaccggcagugguucuucgaccugccccugcccuggacgagcggcgccaccaccgagacccccacguggaaccgcaaggagcuccuggugaccuucaagaacgcccacgccaagaagcaggagguggucgugcuggggucccaggagggcgccaugcacaccgugcucaccggggcgacggagauccagaacagcggcgggaccuccaucuucgccggccaccugaagugccggcugaagauggacaagcucgagcugaagggcaugagcuacgccaugugccugaacaccuucguccucaagaaggagguguccgagacccagcacgggacgauccugaucaagguggaguacaagggcgaggacgccccgugcaagauccccuucagcaccgaggacgggcagggcaaggcccacaacggccgccugaucaccgcgaaccccgucgugaccaagaaggaggagcccgugaacaucgaggccgagccgcccuucggggagagcaacaucgucaucggcaucggggacaaggcccugaagaucaacugguacaagaagggcuccagcaucgggaagauguucgaggccacggcgcggggcgcccgccggauggccauccucggcgacaccgccugggacuucggguccgugggcggggugcugaacagccugggcaagaugguccaccagaucuucggguccgccuacaccgcgcucuucagcggcguguccuggaucaugaagaucggcaucggggugcugcugaccuggaucggccucaacagcaagaacacguccaugagcuucuccugcaucgucaucgggaucaucacccuguaccugggcgccguggugcaggccgacauggggugcgucaucaacuggaagggcaaggagcucaagugcggcagcgggaucuucgugaccaacgaggugcacaccuggacggagcaguacaaguuccaggccgacucccccaagcgccuggccaccgcgaucgccggcgccugggagaacggggucugcggcauccgcagcaccacccggauggagaaccugcucuggaagcagaucgccaacgagcugaacuacauccugugggagaacaacaucaagcucacggugguggucggggacaucaucggcgugcuggagcagggcaagcgcacccugaccccccagccgauggagcucaaguacuccuggaagaccugggggaaggccaagaucgugacggcggagauccagaacagcuccuucaucaucgacggccccaacacccccgagugccccagcgccucccgggccuggaacgucugggagguggaggacuacggguucggcguguucaccaccaacaucuggcugaagcugcgcgagauguacacgcagagcugcgaccaccggcucaugagcgccgcgaucaaggacgagcgcgccguccacgccgacaugggcuacuggaucgagucccagaagaacgggagcuggaagcuggagaaggccuccuucaucgaggugaagaccugcaccuggccgaagagccacacccugugguccaacggcgugcucgagagcgacaugaucauccccaagucccuggccgggcccaucagccagcacaaccaccggccgggcuaccacacccagacggcggggcccuggcaccugggcaagcucgagcuggacuucaacuacugcgagggcaccaccgucgugaucaccgagaacugcgggacgcgcggccccucccugcggaccaccaccgugagcgggaagcucauccacgaguggugcugccgcuccugcacgcugcccccgcugcgguacaugggcgaggacgggugcugguacggcauggagauccgccccaucaacgagaaggaggagaacauggucaagagccucguguccgccggcagcgggaagguggacaacuucaccaugggcguccugugccuggccauccucuucgaggaggugaugcgggggaaguucggcaagaagcacaugaucguggggguccuguucaccuucgugcugcuccuguccggccagaucaccuggcgcgacauggcccacacgcugaucaugaucggcagcaacgccuccgaccggauggggaugggcgugaccuaccucgcgcugaucgccaccuucaagauccagcccuuccuggcccucggguucuuccugcgcaagcugaccagccgggagaaccuccugcugggcgucggccucgccauggccacgacccugcagcugcccgaggacaucgagcagauggcgaacgggaucgcccucggccugaugacccugaagcucaucacccaguucgagacguaccagcuguggaccgcccuggugagccucaccugcuccaacaccaucuucacgcugaccgucgccuggcgcaccgcgacccugauccucgccggggugagccugcugccgcucugccaguccagcuccaugcggaagacggacuggcugcccaugaccguggccgccaugggcguccccccccugccgcucuucaucuucagccugaaggacacccccaagcgccgcuccuggccccugaacgagggggugauggccgugggccucgucagcauccuggcguccagccugcuccggaacgacgugcccauggccggcccgcugguggccgggggccugcucaucgccugcuacgucaucaccgggacguccgccgaccugaccguggagaaggcggccgacgugaccugggaggaggaggccgagcagaccggcgucagccacaaccugaugaucacgguggacgacgacgggaccaugcgcaucaaggacgacgagaccgagaacauccucaccgugcugcugaagaccgcccuccugaucgucuccggcaucuuccccuacagcauccccgccacgcugcucguguggcacaccuggcagaagcagacccagcgguccggcgugcugugggacguccccagcccgcccgagacccagaaggcggagcuggaggaggggguguaccgcaucaagcagcagggcaucuucgggaagacgcaggugggcgucggggugcagaaggagggcguguuccacaccauguggcacgucacccggggcgccgugcucacccacaacgggaagcgccuggagcccaacugggccuccgugaagaaggaccugaucagcuacggcgggggcuggcggcucuccgcccaguggcagaagggggaggagguccaggugaucgccguggagcccggcaagaacccgaagaacuuccagacgaugcccggcaucuuccagaccaccaccggggagaucggcgcgaucgcccuggacuucaagcccgggacgagcggcagcccgaucaucaaccgcgagggcaaggucguggggcuguacggcaacgggguggucaccaagaacggcggguacguguccggcaucgcccagaccaacgccgagcccgacggccccacccccgagcuggaggaggagauguucaagaagcggaaccucacgaucauggaccugcacccggggagcggcaagacccgcaaguaccugcccgcgaucgugcgggaggccaucaagcgccggcuccgcacccugauccuggcccccacccgggucguggccgccgagauggaggaggcgcucaaggggcugcccauccgcuaccagacgaccgccaccaaguccgagcacaccggccgggagaucguggaccugaugugccacgccacguucaccaugcgccuccugagcccgguccgggugcccaacuacaaccugaucaucauggacgaggcccacuucaccgaccccgccuccaucgcggcccgcggguacaucagcacccgggugggcaugggcgaggccgccgccaucuucaugacggcgacccccccggggaccgccgaggccuucccccaguccaacgcccccauccaggacgaggagcgcgacauccccgagcgcagcuggaacuccggcaacgaguggaucaccgacuucgucgggaagacggugugguucgugccgagcaucaaggcgggcaacgacaucgccaacugccuccggaagaacgggaagaaggucauccagcugucccgcaagaccuucgacaccgaguaccagaagacccggcugaacgacugggacuucguggugacgaccgacaucagcgagaugggcgccaacuucaaggccgaccgcgucaucgacccccggcgcugccucaagcccgugauccugaccgacggccccgagcgggugauccuggccgggccgaugcccgucaccgcggccuccgccgcccagcgccggggccgcguggggcggaacccccagaaggagaacgaccaguacaucuucacgggccagccccucaacaacgacgaggaccacgcccacuggaccgaggcgaagaugcugcuggacaacaucaacaccccggaggggaucauccccgcccucuucgagcccgagcgcgagaagagcgccgccaucgacggcgaguaccggcugaagggcgagucccgcaagaccuucgucgagcugaugcggcgcggggaccuccccguguggcuggcccacaagguggcgagcgagggcaucaaguacaccgaccggaaguggugcuucgacggggagcgcaacaaccagauccuggaggagaacauggacgucgagaucuggacgaaggagggcgagcggaagaagcuccgcccgcgcuggcuggacgcccggaccuacuccgacccccuggcccucaaggaguucaaggacuucgccgcgggccgcaagagcaucgcccuggaccuggugaccgagaucgggcgggugcccucccaccucgcccaccgcacccggaacgcccuggacaaccuggucaugcuccacacgagcgagcacggcgggcgcgccuaccggcacgcgguggaggagcugccggagaccauggagacccugcuccugcugggccucaugauccugcugaccgggggcgccaugcucuuccugaucagcggcaaggggaucggcaagacguccaucgggcugaucugcgugaucgucagcuccggcaugcucuggauggccgacgugccccugcaguggaucgccagcgccaucgugcuggaguucuucaugaugguccuccugauccccgagcccgagaagcagcgcaccccgcaggacaaccagcuggcguacguggugaucgggauccucacccuggccgccaucgucgccgccaacgagaugggccugcucgagaccacgaagcgggaccugggcauguccaaggagcccgggguggugagccccaccuccuaccuggacgucgaccuccaccccgcgagcgccuggacccuguacgccguggccaccacggugaucaccccgaugcugcgccacaccaucgagaacuccaccgccaacgucagccucgcggccaucgccaaccaggccguggugcugaugggccuggacaagggguggcccaucuccaagauggaccucggcgucccccugcuggcgcucgggugcuacagccaggugaacccccugacgcugaccgccgccgugcuccugcuggucacccacuacgccaucaucggcccgggccuccaggccaaggcgacccgggaggcccagaagcgcacggccgccgggaucaugaagaaccccaccguggacggcaucaugaccaucgaccuggaccccgugaucuacgacuccaaguucgagaagcagcuggggcaggucaugcuccuggugcugugcgccgugcagcuccugcugaugcggaccagcugggcgcucugcgaggcccugacgcuggccaccggccccaucaccacccucugggagggcuccccggggaaguucuggaacacgaccaucgccgucagcauggccaacaucuuccgcggcuccuaccuggcgggggccggccuggccuucagcaucaugaaguccguggggaccggccggcgcggcaccgggagccagggcgagacgcucggggagaaguggaagaagaagcugaaccagcugagccggaaggaguucgaccucuacaagaaguccggcaucaccgagguggaccgcaccgaggccaaggaggggcugaagcggggcgagaccacccaccacgcggucagccgcggcuccgccaagcugcagugguucguggagcggaacauggugauccccgaggggcgcgucaucgaccucggcugcgggcgcggcggguggagcuacuacugcgccggccugaagaaggugacggaggugcggggcuacaccaaggggggccccgggcacgaggagcccgucccgauguccaccuacggcuggaacaucgugaagcugaugagcgggaaggacguguucuaccucccccccgagaagugcgacacccugcugugcgacaucggcgaguccagccccuccccgacggucgaggagagccgcaccauccgggugcugaagaugguggagcccuggcucaagaacaaccaguucugcaucaagguccugaaccccuacaugcccaccgugaucgagcaccuggagcgccuccagcggaaguacggcgggaugcuggugcgcaacccgcugucccggaacagcacccacgagauguacuggaucuccaacggcacggggaacaucgucagcuccgugaacauggucagccgccuccugcugaaccgguucaccaugacccaccgccggcccaccaucgagaaggacguggaccucggcgccggcacgcgccacgugaacgccgagcccgagaccccgaacauggacgucaucggggagcggaucaagcgcaucaaggaggagcacuccagcaccuggcacuacgacgacgagaaccccuacaagaccugggcguaccacggcuccuacgaggugaaggccacggggagcgccagcuccaugaucaacggcguggucaagcugcugaccaagcccugggacguggugcccauggucacccagauggccaugaccgacacgaccccguucgggcagcagcggguguucaaggagaagguggacacccgcaccccccggcccaugcccggcacgcgcaaggucauggagaucaccgccgaguggcucuggcggacccugggccgcaacaagaagccgcgccugugcacccgggaggaguucacgaagaaggugcgcaccaacgcggccaugggggccguguucaccgaggagaaccagugggacagcgcccgggccgcggucgaggacgaggaguucuggaagcucguggaccgcgagcgggagcugcacaagcugggcaagugcggguccugcguguacaacaugaugggcaagcgcgagaagaagcucggggaguucggcaaggccaagggcagccgggccaucugguacauguggcugggggcccgcuaccuggaguucgaggcgcucggcuuccugaacgaggaccacugguucucccgggagaacagcuacuccggggucgagggcgaggggcugcacaagcucggcuacauccugcgcgacaucagcaagauccccggcggggccauguacgccgacgacaccgccggcugggacacgcggaucaccgaggacgaccugcacaacgaggagaagaucacccagcagauggaccccgagcaccgccagcucgccuccgcgaucuucaagcugaccuaccagaacaagguggugaagguccagcggcccacgccgaaggggaccgugauggacaucaucagccgcaaggaccagcggggcuccggccagguggggaccuacggccugaacaccuucaccaacauggaggcccagcucguccgccagauggagggggagggcgugcugagcaaggccgaccuggagaacccccaccuccuggagaagaagaucacgcaguggcuggagaccaaggggguggagcggcucaagcgcauggccaucuccggcgacgacugcgucgugaagcccaucgacgaccgguucgccaacgcgcugcuggcccucaacgacaugggcaaggugcgcaaggacaucccccaguggcagccgagcaagggguggcacgacuggcagcagguccccuucugcucccaccacuuccacgagcugaucaugaaggacggccggaagcugguggugcccugccgcccccaggacgagcucaucgggcgcgcccggaucagccagggcgccggguggucccugaaggagaccgccugccugggcaaggcguacgcccagauguggagccucauguacuuccaccgccgggaccugcgccuggccuccaacgccaucugcagcgccgucccggugcacugggugcccaccagccggacgaccugguccauccacgcgcaccaccaguggaugaccaccgaggacaugcucacggucuggaaccgcguguggaucgaggacaaccccuggauggaggacaagacccccgugaccaccugggaggacgucccguaccugggcaagcgggaggaccaguggugcgggagccugaucggccucacgucccgcgccaccugggcccagaacauccugaccgccauccagcaggugcggagccugaucggggacgaggaguuccucgacuacaugcccuccaugaagcgcuuccggaaggaggaggagagcgagggcgcgaucugguga

SEQ ID NO: 10404 - RNA, 9873 nt, Artificial Sequence
  derived and/or modified CDS sequence (opt1) from DENV-3__DQ675530__SS-prME
accagcuucugccugaugaugaugcuccccgccacccuggccuuccaccugacgucccgcgacggcgagccgcggaugaucguggggaagaacgagcgcggcaagagccuccuguucaagaccgcguccgggaucaacaugugcacccugaucgccauggaccucggcgagaugugcgacgacaccgucacguacaagugcccccugaucgccgagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccccacccagaagguggugaucuucauccuccugaugcuggucacgcccagcaugaccaugcggugcgugggggugggcaaccgcgacuucgucgagggccucuccggggccaccuggguggacgugguccuggagcacggcgggugcgugaccacgauggccaagaacaagcccacccuggacaucgagcuccagaagaccgaggccacccagcuggcgacgcugcggaagcucugcaucgagggcaagaucaccaacaucaccaccgacagccgcugcccgacgcagggcgaggccauccugcccgaggagcaggaccagaacuacgugugcaagcacaccuacgucgaccggggguggggcaacgggugcggccuguucgggaagggcucccucgugaccugcgccaaguuccagugccuggagcccaucgagggcaaggugguccaguacgagaaccugaaguacaccgugaucaucacggugcacaccggggaccagcaccaggucggcaacgacacccagggggugaccgucgagaucacgccccaggccagcaccguggaggccgugcucccggaguacggcacccuggggcuggagugcuccccccgcaccggccucgacuucaacgagaugauccugcugaccaugaagaacaaggcguggaugguccaccggcagugguucuucgaccucccccugcccuggacgagcggcgccaccaccgagaccccgacguggaaccgcaaggagcugcucgugaccuucaagaacgcccacgccaagaagcaggagguggucgugcuggggucccaggagggcgccaugcacaccgcgcugaccggggccacggagauccagaacagcggcgggaccuccaucuucgccggccaccucaagugccggcugaagauggacaagcuggagcucaagggcaugagcuacgccaugugccugaacaccuucgugcugaagaaggaggucuccgagacccagcacgggacgauccucaucaagguggaguacaagggcgaggacgcccccugcaagauccccuucagcaccgaggacgggcagggcaaggcgcacaacggccgccugaucaccgccaaccccguggucaccaagaaggaggagccggugaacaucgaggccgagccccccuucggggagagcaacaucgugaucggcaucggggacaaggcccugaagaucaacugguacaagaagggcuccagcaucgggaagauguucgaggcgacggcccggggcgcccgccggauggccauccugggcgacaccgccugggacuucggguccgucggcggggugcucaacagccugggcaagauggugcaccagaucuucggguccgcguacaccgcccuguucagcggcgucuccuggaucaugaagaucggcaucggggugcuccugaccuggaucggccugaacagcaagaacacguccaugagcuucuccugcaucgugaucgggaucaucacccucuaccugggcgccgucgugcaggccgacauggggugcgugaucaacuggaagggcaaggagcugaagugcggcagcgggaucuucgucaccaacgaggugcacaccuggacggagcaguacaaguuccaggccgacucccccaagcgccucgcgaccgccaucgccggcgccugggagaacggggugugcggcauccgcagcaccacccggauggagaaccugcuguggaagcagaucgccaacgagcucaacuacauccugugggagaacaacaucaagcugacggucguggugggggacaucaucggcguccucgagcagggcaagcgcacccugaccccgcagcccauggagcugaaguacuccuggaagaccugggggaaggcgaagaucgugacggccgagauccagaacagcuccuucaucaucgacggccccaacacccccgagugcccgagcgccucccgggccuggaacgugugggaggucgaggacuacggguucggcguguucaccaccaacaucuggcucaagcugcgcgagauguacacgcagagcugcgaccaccggcugaugagcgcggccaucaaggacgagcgcgccgugcacgccgacaugggcuacuggaucgagucccagaagaacgggagcuggaagcucgagaaggccuccuucaucgaggucaagaccugcaccuggcccaagagccacacccugugguccaacggcgugcuggagagcgacaugaucauccccaagucccucgcggggccgaucagccagcacaaccaccggcccggcuaccacacccagacggccgggcccuggcaccugggcaagcuggagcucgacuucaacuacugcgagggcaccaccguggucaucaccgagaacugcgggacgcgcggccccucccugcggaccaccaccgugagcgggaagcugauccacgaguggugcugccgcuccugcacgcucccgccccugcgguacaugggcgaggacgggugcugguacggcauggagauccgccccaucaacgagaaggaggagaacauggugaagagccuggucuccgccggcagcgggaagguggacaacuucaccaugggcgugcucugccuggccauccuguucgaggaggucaugcgggggaaguucggcaagaagcacaugaucgugggggugcucuucaccuucguccugcugcucuccggccagaucaccuggcgcgacauggcccacacgcugaucaugaucggcagcaacgcguccgaccggauggggaugggcgugaccuaccuggcccucaucgccaccuucaagauccagcccuuccuggcccugggguucuuccuccgcaagcugaccagccgggagaaccugcuccugggcgugggccuggccauggcgacgacccuccagcugccggaggacaucgagcagauggccaacgggaucgcccugggccucaugacccugaagcugaucacccaguucgagacguaccagcucuggaccgcccuggucagccugaccugcuccaacaccaucuucacgcucaccguggcguggcgcaccgccacccugauccuggccggggucagccuccugccccugugccaguccagcuccaugcggaagacggacuggcuccccaugaccguggccgccaugggcgugcccccgcugccccuguucaucuucagccucaaggacacccccaagcgccgcuccuggccccugaacgagggggucauggcggugggccuggugagcauccucgccuccagccugcugcggaacgacgucccgauggccggcccccucguggccgggggccugcugaucgccugcuacgugaucaccgggacguccgcggaccucaccgucgagaaggccgccgacgugaccugggaggaggaggccgagcagaccggcgugagccacaaccugaugaucacggucgacgacgacgggaccaugcgcaucaaggacgacgagaccgagaacauccugaccgugcuccugaagaccgcccugcucaucguguccggcaucuuccccuacagcauccccgcgacgcugcuggucuggcacaccuggcagaagcagacccagcgguccggcgugcucugggacgugccgagcccccccgagacccagaaggccgagcuggaggagggggucuaccgcaucaagcagcagggcaucuucgggaagacgcaggugggcguggggguccagaaggagggcguguuccacaccauguggcacgugacccggggcgccguccugacccacaacgggaagcgccucgagcccaacugggccuccgugaagaaggaccugaucagcuacggcgggggcuggcggcuguccgcccaguggcagaagggggaggaggugcaggucaucgcgguggagccgggcaagaaccccaagaacuuccagacgaugcccggcaucuuccagaccaccaccggggagaucggcgccaucgcccucgacuucaagccggggacgagcggcagccccaucaucaaccgcgagggcaagguggucgggcuguacggcaacgggguggugaccaagaacggcggguacgucuccggcaucgcccagaccaacgcggagcccgacggccccaccccggagcuggaggaggagauguucaagaagcggaaccugacgaucauggaccuccaccccgggagcggcaagacccgcaaguaccugcccgccaucgugcgggaggccaucaagcgccggcugcgcacccucauccuggcccccacccggguggucgccgcggagauggaggaggcccugaaggggcucccgauccgcuaccagacgaccgccaccaaguccgagcacaccggccgggagaucguggaccugaugugccacgccacguucaccaugcgccugcucagccccgugcggguccccaacuacaaccugaucaucauggacgaggcccacuucaccgaccccgcguccaucgccgcccgcggguacaucagcacccgggugggcaugggcgaggccgccgcgaucuucaugacggccaccccgcccgggaccgccgaggccuucccccaguccaacgcgcccauccaggacgaggagcgcgacaucccggagcgcagcuggaacuccggcaacgaguggaucaccgacuucguggggaagacggucugguucgugcccagcaucaaggccggcaacgacaucgccaacugccugcggaagaacgggaagaaggugauccagcucucccgcaagaccuucgacaccgaguaccagaagacccggcugaacgacugggacuucgucgugacgaccgacaucagcgagaugggcgccaacuucaaggccgaccgcgugaucgacccccggcgcugccugaagcccgucauccucaccgacggcccggagcgggugauccuggcggggcccaugcccgugaccgccgccuccgccgcccagcgccggggccgcgucgggcggaacccccagaaggagaacgaccaguacaucuucacgggccagccgcugaacaacgacgaggaccacgcgcacuggaccgaggccaagaugcuccuggacaacaucaacacccccgaggggaucauccccgcccuguucgagcccgagcgcgagaagagcgccgccaucgacggcgaguaccggcucaagggcgagucccgcaagaccuucguggagcugaugcggcgcggggaccugccggucuggcucgcgcacaagguggccagcgagggcaucaaguacaccgaccggaaguggugcuucgacggggagcgcaacaaccagauccuggaggagaacauggacguggagaucuggacgaaggagggcgagcggaagaagcugcgcccccgcuggcucgacgcccggaccuacuccgacccccuggcccugaaggaguucaaggacuucgcggccggccgcaagagcaucgcccucgaccuggucaccgagaucgggcgggugccgucccaccuggcccaccgcacccggaacgcccucgacaaccuggugaugcugcacacgagcgagcacggcgggcgcgcguaccggcacgccgucgaggagcuccccgagaccauggagacccugcugcuccugggccugaugauccuccugaccgggggcgccaugcuguuccucaucagcggcaaggggaucggcaagacguccaucgggcugaucugcgugaucgugagcuccggcaugcuguggauggccgacgucccccuccaguggaucgccagcgcgaucgugcuggaguucuucaugauggugcugcucauccccgagccggagaagcagcgcaccccccaggacaaccagcuggccuacgucgugaucgggauccugacccucgccgccaucguggccgcgaacgagaugggccugcuggagaccacgaagcgggaccucggcauguccaaggagcccggggucgugagccccaccuccuaccuggacguggaccugcacccggccagcgccuggacccucuacgccgucgccaccacggugaucacccccaugcugcgccacaccaucgagaacuccaccgcgaacgugagccuggccgccaucgccaaccaggcggucgugcucaugggccuggacaagggguggcccaucuccaagauggaccugggcgugccccuccuggcccuggggugcuacagccaggucaacccgcucacgcugaccgccgccgugcugcuccuggugacccacuacgccaucaucggccccggccugcaggcgaaggccacccgggaggcccagaagcgcacggccgccgggaucaugaagaaccccaccgucgacggcaucaugaccaucgaccucgaccccgugaucuacgacuccaaguucgagaagcagcuggggcaggugaugcugcucguccugugcgcggugcagcugcuccugaugcggaccagcugggcccugugcgaggcccucacgcuggccaccggcccgaucaccacccugugggagggcucccccgggaaguucuggaacacgaccaucgccgugagcauggcgaacaucuuccgcggcuccuaccucgccggggccggccuggccuucagcaucaugaaguccgucgggaccggccggcgcggcaccgggagccagggcgagacgcugggggagaaguggaagaagaagcucaaccagcugagccggaaggaguucgaccuguacaagaaguccggcaucaccgagguggaccgcaccgaggcgaaggaggggcucaagcggggcgagaccacccaccacgccgugagccgcggcuccgccaagcugcagugguucgucgagcggaacauggugauccccgaggggcgcgugaucgaccugggcugcgggcgcggcggguggagcuacuacugcgccggccucaagaaggucacggaggugcggggcuacaccaaggggggccccgggcacgaggagccggugcccauguccaccuacggcuggaacaucgucaagcugaugagcgggaaggacguguucuaccugccccccgagaagugcgacacccuccugugcgacaucggcgaguccagcccgucccccacgguggaggagagccgcaccauccggguccugaagaugguggagcccuggcugaagaacaaccaguucugcaucaaggugcucaaccccuacaugccgaccgucaucgagcaccuggagcgccugcagcggaaguacggcgggaugcucgugcgcaacccccugucccggaacagcacccacgagauguacuggaucuccaacggcacggggaacaucgugagcuccgucaacauggugagccgccugcuccugaaccgguucaccaugacccaccgccggcccaccaucgagaaggacgucgaccugggcgccggcacgcgccacgugaacgcggagccggagacccccaacauggacgugaucggggagcggaucaagcgcaucaaggaggagcacuccagcaccuggcacuacgacgacgagaaccccuacaagaccugggccuaccacggcuccuacgaggucaaggccacggggagcgccagcuccaugaucaacggcguggugaagcuccugaccaagcccugggacgucgugccgauggugacccagauggccaugaccgacacgacccccuucgggcagcagcgggucuucaaggagaagguggacacccgcaccccccggcccaugccgggcacgcgcaaggugauggagaucaccgcggaguggcuguggcggacccucggccgcaacaagaagccccgccugugcacccgggaggaguucacgaagaagguccgcaccaacgccgccaugggggccguguucaccgaggagaaccagugggacagcgcccgggcggccguggaggacgaggaguucuggaagcuggucgaccgcgagcgggagcuccacaagcugggcaagugcggguccugcguguacaacaugaugggcaagcgcgagaagaagcugggggaguucggcaaggccaagggcagccgggccaucugguacauguggcucggggcgcgcuaccuggaguucgaggcccugggcuuccucaacgaggaccacugguucucccgggagaacagcuacuccgggguggagggcgaggggcugcacaagcugggcuacauccuccgcgacaucagcaagauccccggcggggccauguacgccgacgacaccgccggcugggacacgcggaucaccgaggacgaccugcacaacgaggagaagaucacccagcagauggaccccgagcaccgccagcuggcguccgccaucuucaagcucaccuaccagaacaaggucgugaaggugcagcggccgacgcccaaggggaccgucauggacaucaucagccgcaaggaccagcggggcuccggccagguggggaccuacggccugaacaccuucaccaacauggaggcccagcuggugcgccagauggagggggagggcguccucagcaaggccgaccuggagaacccccaccugcucgagaagaagaucacgcaguggcuggagaccaaggggguggagcggcugaagcgcauggccaucuccggcgacgacugcguggucaagcccaucgacgaccgguucgcgaacgcccuccuggcccugaacgacaugggcaaggugcgcaaggacaucccgcaguggcagcccagcaagggguggcacgacuggcagcaggugcccuucugcucccaccacuuccacgagcucaucaugaaggacggccggaagcuggucgugcccugccgcccgcaggacgagcugaucgggcgcgcccggaucagccagggcgccggguggucccucaaggagaccgcgugccugggcaaggccuacgcccagauguggagccugauguacuuccaccgccgggaccuccgccuggccuccaacgccaucugcagcgcggugcccguccacugggugcccaccagccggacgaccugguccauccacgcccaccaccaguggaugaccaccgaggacaugcugacgguguggaaccgcgucuggaucgaggacaaccccuggauggaggacaagaccccggugaccaccugggaggacgugcccuaccucggcaagcgggaggaccaguggugcgggagccugaucggccugacgucccgcgccaccugggcccagaacauccucaccgcgauccagcagguccggagccugaucggggacgaggaguuccuggacuacaugcccuccaugaagcgcuuccggaaggaggaggagagcgagggcgccaucugguga

SEQ ID NO: 10405 - RNA, 9873 nt, Artificial Sequence
  derived and/or modified CDS sequence (opt1) from DENV-3__DQ675533__SS-prME
accagccugugccugaugaugauccugcccgccgcccuggcguuccaccucaccagccgggacggggagccccggaugaucguggggaagaacgagcggggcaagagccugcuguucaagaccgccagcgggaucaacaugugcacccucaucgccauggaccugggcgagaugugcgacgacaccgugaccuacaagugcccccacaucaccgagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccgugcugccggaggagcaggaccagaacuacgucugcaagcacaccuacguggaccggggguggggcaacgggugcggccucuucgggaagggcucccuggugaccugcgccaaguuccagugccuggagcccaucgagggcaaggucgugcaguacgagaaccucaaguacaccgugaucaucacgguccacaccggggaccagcaccaggugggcaacgagacccagggggucaccgccgagaucacgccccaggccagcacccacgaggcgcugcugcccgaguacggcacccucgggcuggagugcuccccgcgcaccggccuggacuucaacgagaugauccuccugaccaugaagaacaaggccuggauggugcaccggcagugguucuucgaccugccccuccccugggccagcggcgccacgaccgagacccccaccuggaaccgcaaggagcugcuggugacguucaagaacgcccacgcgaagaagcaggaggucguggugcucgggucccaggagggcgccaugcacaccgcccugaccggggccaccgagauccagaacagcggcgggacguccaucuucgccggccaccugaagugccggcucaagauggacaagcuggagcugaagggcaugagcuacgcgaugugcaccaacaccuucguccucaagaaggagguguccgagacccagcacgggacgauccugaucaagguggaguacaagggcgaggacgccccgugcaagauccccuucagcaccgaggacgggcagggcaaggcccacaacggccgccugaucaccgccaaccccgucgugaccaagaaggaggagcccgugaacaucgaggcggagccgcccuucggggagagcaacaucgucaucggcaucggggacaacgcccugaagaucaacugguacaagaagggcuccagcaucgggaagauguucgaggccacggcccggggcgcccgccggauggcgauccucggcgacaccgccugggacuucggguccgugggcggggugcugaacagccugggcaagaugguccaccagaucuucggguccgccuacaccgcccucuucagcggcguguccugggugaugaagaucggcaucgggguccugcugaccuggaucggccucaacagcaagaacacguccaugagcuucuccugcaucgccaucgggaucaucacccuguaccugggcgcgguggugcaggccgacauggggugcgucaucaacuggaagggcaaggagcucaagugcggcagcgggaucuucgugaccaacgaggugcacaccuggacggagcaguacaaguuccaggccgacucccccaagcgccuggccaccgccaucgcgggcgccugggagaacggggucugcggcauccgcagcaccacccggauggagaaccugcucuggaagcagaucgccaacgagcugaacuacauccugugggagaacaacaucaagcucacggugguggucggggacacccugggcgugcuggagcagggcaagcgcacccucacgccccagccgauggagcugaaguacuccuggaagacgugggggaaggccaagaucgugaccgcggagacccagaacagcuccuucaucaucgacggccccaacacccccgagugccccagcgccucccgggccuggaacgucugggagguggaggacuacggguucggcguguucacgaccaacaucuggcugaagcuccgcgaggucuacacccagcugugcgaccaccggcugaugagcgccgccgugaaggacgagcgcgcggugcacgccgacaugggcuacuggaucgagagccagaagaacggguccuggaagcucgagaaggccagccugaucgaggucaagaccugcaccuggccgaagucccacacgcuguggagcaacggcgugcucgaguccgacaugaucauccccaagagccuggccgggcccaucucccagcacaacuaccggccgggcuaccacacccagaccgccgggcccuggcaccugggcaagcucgagcuggacuucaacuacugcgagggcaccacgguggucaucaccgagagcugcgggacccgcggccccucccugcggaccacgaccgugagcgggaagcucauccacgaguggugcugccgcuccugcacccugcccccgcugcgguacaugggcgaggacgggugcugguacggcauggagauccgccccaucagcgagaaggaggagaacauggugaagucccucgucagcgcgggcuccgggaagguggacaacuucaccaugggcgugcugugccuggccauccucuucgaggagguccugcgggggaaguucggcaagaagcacaugaucgccgggguguucuucacguucgugcugcuccugagcggccagaucaccuggcgcgacauggcccacacccugaucaugaucggcuccaacgccagcgaccggauggggaugggcgucaccuaccucgcgcugaucgccacguucaagauccagcccuuccuggcccucggguucuuccugcgcaagcugaccagccgggagaaccuccugcugggcgugggccucgccauggcgaccacccugcagcugcccgaggacaucgagcagauggccaacgggaucgcccucggccugauggcccugaagcucaucacgcaguucgagaccuaccagcuguggaccgcccuggugucccugaccugcagcaacacgaucuucacccugaccgucgcguggcgcaccgccacgcugauccucgccggggugucccugcugccggucugccagagcuccagcaugcggaagaccgacuggcuccccaugaccguggccgccaugggcgugccgccccucccgcugcucaucuucucccugaaggacacccugaagcgccgcagcuggccccucaacgagggggucauggcggugggccugguguccauccuggccagcucccuccugcggaacgacguccccauggccggcccccugguggccgggggccuccugaucgccugcuacgugaucacggggaccagcgcggaccugaccgucgagaaggccgccgacgugaccugggaggaggaggccgagcagacgggcgugucccacaaccucaugaucaccgucgacgacgacgggaccaugcgcaucaaggacgacgagaccgagaacauccugaccgugcugcucaagacggcccugcugaucgugagcggcaucuucccguacuccauccccgcgacccuccuggucuggcacaccuggcagaagcagacccagcggagcggcgugcugugggacgugcccagcccgcccgagacgcagaaggccgagcucgaggagggggucuaccgcaucaagcagcagggcaucuucgggaagacccaggugggcguggggguccagaaggagggcguguuccacaccauguggcacgugacccggggcgccguccugacgcacaacgggaagcgccuggagcccaacugggccagcgugaagaaggaccugaucuccuacggcgggggcuggcggcucagcgcgcaguggcagaagggggaggaggugcaggucaucgccguggagcccggcaagaaccccaagaacuuccagaccaugcccggcaccuuccagaccacgaccggggagaucggcgccaucgcccuggacuucaagcccgggaccagcggcucccccaucaucaaccgcgagggcaagguggucgggcuguacggcaacgggguggugaccaagaacggcggguacgucagcggcaucgcccagacgaacgcggagccggacggccccacccccgagcucgaggaggagauguucaagaagcggaaccugaccaucauggaccugcaccccggguccggcaagacccgcaaguaccucccggccaucgugcgggaggccaucaagcgccggcugcgcacgcugauccucgcccccacccggguggucgccgcggagauggaggaggcccugaaggggcugcccauccgcuaccagaccaccgccaccaaguccgagcacaccggccgggagaucguggaccucaugugccacgccaccuucaccaugcgccugcugucccccgugcgggucccgaacuacaaccucaucaucauggacgaggcccacuucacggaccccgcgagcaucgccgcccgcggguacaucuccacccgggugggcaugggcgaggccgcggccaucuucaugaccgccacgccgcccgggacggccgacgccuucccgcagagcaacgcgcccauccaggacgaggagcgcgacauccccgagcgcuccuggaacagcggcaacgaguggaucaccgacuucgccgggaagaccgugugguucguccccuccaucaaggccggcaacgacaucgccaacugccugcggaagaacgggaagaaggugauccagcugagccgcaagaccuucgacacggaguaccagaagaccaagcucaacgacugggacuucguggucaccaccgacaucuccgagaugggcgccaacuucaaggcggaccgggugaucgacccgcgccggugccugaagcccgugauccugacggacggccccgagcgcgucauccucgccgggcccaugccggugaccgccgccagcgccgcgcagcggcgcggccggguggggcgcaacccccagaaggagaacgaccaguacaucuucaccggccagccccugaacaacgacgaggaccacgcccacuggaccgaggccaagaugcugcucgacaacaucaacacccccgaggggaucaucccggcccuguucgagcccgagcgggagaaguccgcggccaucgacggcgaguaccgccugaagggcgagagccggaagacguucgucgagcucaugcgccgcggggaccugcccguguggcuggcccacaaggucgccuccgagggcaucaaguacaccgaccgcaaguggugcuucgacggggagcggaacaaccagauccucgaggagaacauggacguggagaucuggaccaaggagggcgagcgcaagaagcugcggccccgcuggcuggacgcccgcaccuacagcgacccgcucgcgcugaaggaguucaaggacuucgccgccggccggaaguccaucgcccuggaccucgugacggagaucgggcgcguccccagccaccuggcccaccggacccgcaacgcgcuggacaaccucgugaugcugcacaccagcgagcacggcgggcgggccuaccgccacgccguggaggagcugcccgagaccauggagacgcuccugcugcucggccugaugauccugcucaccgggggcgccaugcuguuccugaucuccggcaaggggaucggcaagaccagcaucgggcucaucugcgucaucgccuccagcggcaugcuguggauggcggaggugccgcugcaguggaucgccuccgccaucgugcucgaguucuucaugaugguccugcugauccccgagcccgagaagcagcggacgccccaggacaaccagcucgccuacguggugaucgggauccugacgcuggccgcgaucaucgccgccaacgagaugggccuccuggagaccaccaagcgcgaccugggcaugagcaaggagccgggggucgugucccccaccagcuaccucgacguggaccugcaccccgccuccgcguggacgcuguacgccgucgccaccaccgugaucacccccaugcuccggcacacgaucgagaacagcaccgccaacgugucccuggccgcgaucgccaaccaggccgucgugcugaugggccucgacaagggguggccgaucagcaagauggaccugggcgugccccugcucgcccuggggugcuacucccaggucaacccccugacccucaccgccgcggugcugcugcucaucacgcacuacgccaucaucggccccggccugcaggccaaggccacccgcgaggcccagaagcggaccgcggccgggaucaugaagaacccgaccguggacggcaucaugacgaucgaccuggaccccgucaucuacgacagcaaguucgagaagcagcucggccaggugaugcugcuggugcucugcgccguccagcugcugcucaugcgcaccuccugggcccugugcgaggcgcugacccucgccaccggccccaucacgacccugugggagggcagccccgggaaguucuggaacaccaccaucgccguguccauggccaacaucuuccggggcagcuaccuggccggggcgggccucgccuucuccaucaugaaguccguggggacgggcaagcgcggcaccgggagccagggcgagacccugggggagaaguggaagaagaagcugaaccagcucucccggaaggaguucgaccuguacaagaaguccggcaucaccgaggucgaccgcaccgaggccaaggaggggcugaagcggggcgagacgacccaccacgccgugucccgcggcagcgccaagcuccagugguucguggagcggaacauggucgugccggaggggcgcgugaucgaccugggcugcgggcggggcgggugguccuacuacugcgcgggccugaagaaggucaccgaggugcgcggcuacaccaagggcgggcccgggcacgaggagcccgugcccaugagcacguacggcuggaacaucgucaagcugauguccgggaaggacguguucuaccucccgcccgagaagugcgacacccugcugugcgacaucggcgagagcucccccagccccaccguggaggagucccgcaccauccggguccucaagaugguggagccguggcugaagaacaaccaguucugcaucaaggugcugaaccccuacaugcccacggucaucgagcaccucgagcgccugcagcggaagcacggcgggaugcuggugcgcaacccccucagccggaacuccacccacgagauguacuggaucagcaacggcaccgggaacaucguguccagcgucaacauggugucccgccugcugcucaaccgguucaccaugacgcaccgccggccgaccaucgagaaggacguggaccugggcgccggcacccgccacgucaacgccgagcccgagacccccaacauggacgugaucggggagcggaucaagcgcaucaaggaggagcacaacagcacguggcacuacgacgacgagaacccguacaagaccugggccuaccacggcuccuacgaggucaaggccaccgggagcgcgagcuccaugaucaacggcguggugaagcugcucaccaagcccugggacgucgugcccauggugacgcagauggccaugaccgacaccacccccuucgggcagcagcgggucuucaaggagaagguggacacgcgcaccccgcggcccaugcccggcacccgcaaggugauggagaucaccgccgaguggcuguggcggacgcugggccgcaacaagcggccccgccucugcacccgcgaggaguucaccaagaagguccggaccaacgccgcgaugggggccguguucacggaggagaaccagugggacagcgccaaggccgccguggaggacgaggaguucuggaagcuggucgaccgcgagcgggagcugcacaagcucggcaagugcggguccugcguguacaacaugaugggcaagcgcgagaagaagcugggggaguucggcaaggcgaagggcagccgggccaucugguacauguggcugggggcccgcuaccucgaguucgaggcccugggcuuccugaacgaggaccacugguucucccgggagaacagcuacuccgggguggagggcgaggggcuccacaagcugggcuacauccugcgcgacaucagcaagaucccgggcggggccauguacgcggacgacaccgccggcugggacacccggaucaccgaggacgaccuccacaacgaggagaagaucauccagcagauggaccccgagcaccgccagcuggccaacgccaucuucaagcugacguaccagaacaaggucgugaaggugcagcggcccacccccaccgggaccgucauggacaucaucucccgcaaggaccagcggggcagcggccagguggggaccuacggccucaacacguucaccaacauggaggcccagcuggugcgccagauggagggggagggcguccugaccaaggcggaccucgagaacccgcaccuccuggagaagaagaucacccaguggcucgagacgaaggggguggagcggcugaagcgcauggccaucuccggcgacgacugcguggucaagcccaucgacgaccgguucgccaacgcccugcucgcccugaacgacaugggcaaggugcgcaaggacaucccccaguggcagcccagcaagggguggcacgacuggcagcaggucccguucugcucccaccacuuccacgagcugaucaugaaggacggccggaagcucgucgugcccugccgcccccaggacgagcugaucgggcgggcgcgcaucagccagggcgccggguggucccugcgcgagaccgccugccucggcaaggccuacgcgcagauguggagccugauguacuuccaccggcgcgaccugcggcucgccuccaacgccaucugcagcgccgugcccguccacugggugccgaccucccgcaccacguggagcauccacgcccaccaccaguggaugaccaccgaggacaugcugaccguguggaaccgggucuggaucgaggagaaccccuggauggaggacaagacgcccgugaccaccugggagaacgugcccuaccugggcaagcgcgaggaccaguggugcgggagccucaucggccugaccucccgggcgacgugggcccagaacaucccgaccgccauccagcagguccgcagccugaucgggaacgaggaguuccucgacuacaugcccuccaugaagcgguuccgcaaggaggaggagagcgagggcgccaucugguga

SEQ ID NO: 10406 - RNA, 9873 nt, Artificial Sequence
  derived and/or modified CDS sequence (opt1) from DENV-3__AY744677__SS-prME
accagccugugccucaugaugaugcugcccgccacccuggccuuccaccucaccagccgcgacggcgagccccggaugaucguggggaagaacgagcggggcaagagccugcuguucaagaccgccagcgggaucaacaugugcacccucaucgccauggaccugggcgagaugugcgacgacaccgugaccuacaagugcccccugaucaccgagguggagcccgaggacaucgacugcuggugcaaccucaccagcaccugggugaccuacgggaccugcaaccaggccggcgagcaccggcgcgacaagcggagcguggcccuggcgccccacgugggcauggggcuggacacccgcacccagaccuggaugagcgcggagggcgccuggcggcaggucgagaaggucgagaccugggccuuccgccaccccggguucaccauccucgcccuguuccuggcgcacuacaucggcaccucccucacccagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacgugaccacggacagccgcugccccacccagggcgaggcgauccugcccgaggagcaggaccagaacuacgucugcaagcacaccuacguggaccggggguggggcaacgggugcggccucuucgggaagggcucccuggugaccugcgccaaguuccagugccuggagagcaucgagggcaaggccguccagcacgagaaccucaaguacacggugaucaucaccgugcacaccggggaccagcaccaggucggcaacgagacccagggggugacggccgagaucacgccccaggccuccaccgucgaggcgauccugcccgaguacggcacccuggggcucgagugcagcccccgcaccggccuggacuucaacgagaugauccugcucacgaugaagaacaaggccuggauggugcaccggcagugguucuucgaccugccgcugcccuggaccuccggcgccaccaccgagacgcccaccuggaacaagaaggagcuccuggugaccuucaagaacgcccacgccaagaagcaggaggucguggugcuggggagccaggagggcgcgaugcacaccgcccucacgggggccaccgagauccagaccuccggcgggaccagcaucuucgccggccaccugaagugccgccugaagauggacaagcucgagcugaagggcauguccuacgccaugugccugaacgcguucguccucaagaaggaggugagcgagacgcagcacgggaccauccugaucaagguggaguacaagggcgaggacgcccccugcaagaucccguucagcaccgaggacgggcagggcaaggcccacaacggccggcugaucaccgccaaccccaucgucacgaagaaggaggagcccgugaacaucgaggcggagcccccguucggggaguccaacaucgugaucggcaucggggacaaggcccugaagaucaacugguacaagaagggcagcuccaucgggaagauguucgaggccaccgcccgcggcgcccggcgcauggcgauccucggcgacaccgccugggacuucgggagcgucggcggggugcugaacucccugggcaagauggugcaccagaucuucgggagcgccuacaccgcccucuucuccggcgucagcuggaucaugaagaucggcaucggggugcugcugacguggaucggccucaacuccaagaacaccagcauguccuucagcugcaucgugaucgggaucaucacccuguaccugggcgccgucgugcaggcggacauggggugcgugaucaacuggaagggcaaggagcucaagugcggcuccgggaucuucgucaccaacgaggugcacacguggaccgagcaguacaaguuccaggccgacagccccaagcggcuggccaccgccaucgccggcgcgugggagaacggggugugcggcauccgcuccaccacgcgcauggagaaccugcucuggaagcagaucgccaacgagcugaacuacauccugugggagaacaacaucaagcucaccaucgucgugggggacgugaucggcguccuggagcagggcaagcggacccugacgccccagcccauggagcucaaguacagcuggaagacgugggggaaggccaagaucgugaccgccgagacccagaacuccagcuucaucaucgacggcccgaacacccccgagugccccuccgcgagccgcgccuggaacgugugggaggucgaggacuacggguucggcguguucacgaccaacaucuggcugaagcugcgggagauguacacccagcucugcgaccaccgccugaugagcgccgccgugaaggacgagcgggccguccacgcggacaugggcuacuggaucgagucccagaagaacgggagcuggaagcuggagaaggccucccucaucgaggugaagaccugcaccuggcccaagagccacacgcugugguccaacggcgugcuggagagcgacaugaucaucccgaagucccucgccgggcccaucagccagcacaacuaccgccccggcuaccacacccagaccgccgggccguggcaccugggcaagcuggagcucgacuucaacuacugcgagggcaccacggucgugaucaccgagaacugcgggacccggggccccucccugcgcaccacgaccgugagcgggaagcugauccacgaguggugcugccgguccugcacccugccgccccuccgcuacaugggcgaggacgggugcugguacggcauggagauccggccgaucaacgagaaggaggagaacauggucaagagccugguguccgccggcagcgggaaggcggacaacuucaccaugggcgugcucugccuggccauccuguucgaggaggucaugcgcgggaaguucggcaagaagcacaugaucgccggggcccucuucacguucgugcugcugcucuccggccagaucaccuggcgggacauggcccacacccugaucaugaucggcagcaacgcguccgaccgcauggggaugggcgugaccuaccuggcccucaucgccacguucaagauccagcccuuccuggcccugggguucuuccuccggaagcugaccagccgcgagaaccugcuccugggcgucggccuggcgauggccaccacccuccagcugcccgaggacaucgagcagauggccaacgggaucgcccugggccucauggcccugaagcugaucacgcaguucgagaccuaccagcucuggaccgcgcuggugagccugaugugcuccaacaccaucuucacgcucaccguggccuggcggaccgccacccugauccuggccgucaucagccuccugcccgugugccaguccagcuccaugcgcaagacggacuggcugccgaugaccguggccgcgaugggggugccgccccucccccuguucaucuucagccugaaggacacccucaagcggcgcuccuggccgcugaacgagggcgugauggccgucgggcuggugagcauccucgccuccagcuuccugcgcaacgacgugcccauggccggcccccuggucgccggcgggcuccugaucgcgugcuacgugaucaccggcacguccgccgaccugaccguggagaaggccgccgacgucaccugggaggaggaggccgagcagaccggggugagccacaaccucaugaucacgguggacgacgacggcaccaugcggaucaaggacgacgagaccgagaacauccugaccguccugcucaagaccgcgcugcugaucguguccgggaucuuccccuacagcaucccggccacgcuccugguguggcacaccuggcagaagcagacccagcgcuccggcguccugugggacgugcccuccccgcccgagacccagaaggccgagcucgaggagggcguguaccggaucaagcagcaggggaucuucggcaagacgcaggucggggugggcgugcagaaggagggggucuuccacaccauguggcacgugacccgcggcgccgugcugacccacaacggcaagcggcuggagccgaacugggcgaacgucaagaaggaccucaucuccuacgggggcggguggaagcugagcgcccaguggcagaagggcgaggagguccaggugaucgccgucgagcccgggaagaaccccaagaacuuccagacgaugcccggcaucuuccagaccaccaccggcgagaucggggccaucgcccuggacuucaagccgggcacguccgggagccccaucaucaaccgcgagggcaagguggugggccuguacgggaacggcgucgugaccaagaacgggggcuacgugagcgggaucgcgcagaccaacgccgagcccgacggcccgacccccgagcucgaggaggagauguucaagaagcggaaccugacgaucauggaccugcaccccggcuccgggaagacccgcaaguaccuccccgccaucguccgggaggccaucaagcgccggcugcgcacccugauccucgccccgacccgggugguggcggccgagauggaggaggcccugaagggccugcccauccgcuaccagacgaccgccaccaagagcgagcacaccgggcgggagaucgucgaccucaugugccacgccacguucaccaugcgccugcugucccccgugcgggugcccaacuacaaccucaucgucauggacgaggcgcacuucaccgacccggccagcaucgccgcccgcggcuacaucuccacccggguggggaugggcgaggcggccgccaucuucaugacggccacgccgcccggcaccgccgacgcguucccccagagcaacgccccgauccaggacgaggagcgcgacauccccgagcgguccuggaacagcgggaacgaguggaucaccgacuucgccggcaagacggugugguucguccccuccaucaaggccgggaacgacaucgccaacugccugcgcaagaacggcaagaaggugauccagcugagccgcaagaccuucgacaccgaguaccagaagaccaagcucaacgacugggacuucguggucacgaccgacaucuccgagaugggggcgaacuucaaggccgaccgggugaucgacccccgccggugccugaagccggugauccugaccgacggccccgagcgcgucauccucgccggccccaugcccgugaccguggccagcgccgcgcagcggcgcgggcgggucggccgcaacccgcagaaggagaacgaccaguacaucuucacggggcagccccugaacaacgacgaggaccacgcccacuggaccgaggccaagaugcugcucgacaacaucaacacccccgagggcaucauccccgcccuguucgagccggagcgggagaaguccgcggccaucgacggggaguaccgccugaagggcgagagccggaagaccuucguggagcucaugcgccggggcgaccugcccguguggcuggcccacaaggucgccuccgaggggaucaaguacaccgaccgcaaguggugcuucgacggcgagcggaacaaccagauccucgaggagaacauggacguggagaucuggacgaaggagggggagaagaagaagcugcgcccccgguggcuggacgcccgcaccuacagcgacccccucgcgcugaaggaguucaaggacuucgccgccggccggaaguccaucgcccuggaccucgucaccgagaucggccgcgugccgagccaccuggcccaccgcacccggaacgcgcuggacaaccucgugaugcugcacacguccgagcacgggggccgcgccuaccggcacgccgucgaggagcugcccgagaccauggagacccuccugcugcucgggcugaugauccugcucaccggcggggccaugcuguuccugaucagcggcaagggcaucgggaagacgagcaucggccucaucugcgugguggccuccagcgggaugcuguggauggcggacgucccccugcaguggaucgccuccgccaucgugcucgaguucuucaugauggugcugcugaucccggagcccgagaagcagcgcacgccccaggacaaccagcucgccuacgucgugaucggcauccugacccuggccgcgaucguggccgccaacgagauggggcuccuggagaccacgaagcgggaccugggcaugagcaaggagcccggcgucguguccccgaccagcuaccucgacguggaccugcaccccgccuccgcguggacccuguacgccgucgccaccacggugaucacccccaugcuccgccacaccaucgagaacagcaccgccaacgugucccuggccgcgaucgccaaccaggccgucgugcugauggggcucgacaagggcuggcccaucagcaagauggaccugggggugccgcugcucgcccugggcugcuacucccaggucaacccccugacgcucaccgccgcggugcugcugcucgugacccacuacgccaucaucgggcccggccugcaggccaaggccacccgggaggcccagaagcgcacggcggccggcaucaugaagaaccccaccgucgacgggaucaugaccaucgaccuggacccggugaucuacgacagcaaguucgagaagcagcucggccaggugaugcugcugguccucugcgccgugcagcugcugcucaugcggaccuccugggccuucugcgaggcgcugacgcuggccaccgggcccaucaccacccucugggagggcagccccggcaaguucuggaacacgaccaucgccguguccauggccaacaucuuccgcgggagcuaccuggccggcgcggggcuggccuucuccaucaugaaguccgucggcaccgggaagcggggcaccggcucccagggggagacgcucggcgagaaguggaagaagcgccugaaccagcugagccggaaggaguucgaccucuacaagaaguccgggaucaccgagguggaccgcaccgaggccaaggagggccugaagcgcggggagaucacccaccacgccgugucccgcggcagcgccaagcugcagugguucgucgagcggaacauggugauccccgagggccgcgugaucgaccucgggugcggccgcgggggcugguccuacuacugcgcggggcugaagaaggucaccgaggugcgcggcuacacgaagggcgggccgggccacgaggagcccgugcccaugagcaccuacggguggaacaucgucaagcugauguccggcaaggacguguucuaccucccgcccgagaagugcgacacccugcugugcgacaucggggagagcucccccagccccaccguggaggagucccggacgauccgcguccugaagaugguggagcccuggcucaagaacaaccaguucugcaucaaggugcugaaccccuacaugcccaccgucaucgagcaccuggagcgccuccagcggaagcacggcggcaugcuggugcgcaacccccugagccggaacuccacccacgagauguacuggaucagcaacgggaccggcaacaucguguccagcgucaacauggugucccgccuccugcugaaccgguucacgaugacccaccgccggcccaccaucgagaaggacguggaccucggggccggcacccgccacgucaacgccgagccggagacgcccaacauggacgugaucggcgagcggauccgccggaucaaggaggagcacagcuccaccuggcacuacgacgacgagaaccccuacaagaccugggccuaccacgggagcuacgaggucaaggccaccggcuccgcgagcagcaugaucaacgggguggugaagcugcugacgaagccgugggacgucgugcccauggugacccagauggccaugaccgacaccacgcccuucggccagcagcgcgucuucaaggagaagguggacacccggacgccccggccgaugcccgggacccggaaggugauggagaucacggccgaguggcucuggcgcacccugggccggaacaagcgcccccggcugugcacccgcgaggaguucaucaagaagguccgcaccaacgccgcgaugggcgccguguucacggaggagaaccagugggacuccgcccgggccgccguggaggacgaggaguucuggaagcucgucgaccgcgagcgggagcugcacaagcuggggaagugcggcagcugcguguacaacaugauggggaagcgcgagaagaagcucggcgaguucgggaaggcgaagggcucccgggccaucugguacauguggcugggcgcccgcuaccuggaguucgaggcccucggguuccugaacgaggaccacugguucagccgggagaacuccuacagcggcguggagggggagggccugcacaagcucggguacauccugcgcgacaucuccaagauccccggcggcgccauguacgcggacgacaccgccgggugggacacccggaucaccgaggacgaccugcacaacgaggagaagaucacgcagcagauggacccggagcaccgccagcucgccaacgccaucuucaagcugaccuaccagaacaaggucgugaaggugcagcggcccacccccaagggcaccgucauggacaucaucagccgcaaggaccagcggggguccggccaggugggcacguacgggcugaacaccuucaccaacauggaggcccagcucauccgccagauggagggcgagggggugcugagcaaggcggaccuggagaacccccaccuccuggagaagaaggucacccaguggcuggagaccaagggcguggagcggcucaagcgcauggccaucuccggggacgacugcguggucaagccgaucgacgaccgguucgccaacgcccugcuggcccucaacgacaugggcaaggugcgcaaggacaucccccaguggcagcccagcaagggcuggcacgacuggcagcagguccccuucugcucccaccacuuccacgagcugaucaugaaggacgggcggaagcuggucgugccgugccgcccccaggacgagcucaucggccgggcgcgcaucagccagggggccggcuggucccugcgcgagacggccugccuggggaaggccuacgcgcagaugugggcccucauguacuuccaccggcgcgaccugcggcuggccagcaacgccaucugcuccgccgugcccguccacugggugcccaccagccgcaccaccugguccauccacgcgcaccaccaguggaugacgaccgaggacaugcucaccguguggaaccgggucuggaucgaggacaacccguggauggaggacaagacccccgugacgaccugggaggacgugcccuaccugggcaagcgcgaggaccaguggugcggcagccugaucgggcucaccagccgggccaccugggcccagaacauccugacggccauccagcagguccgcucccugaucggcaacgaggaguuccucgacuacaugcccagcaugaagcgguuccgcaaggaggaggaguccgagggggccaucugguga

SEQ ID NO: 10407 - RNA, 9873 nt, Artificial Sequence
  derived and/or modified CDS sequence (opt1) from DENV-3__AY744678__SS-prME
accagccugugccucaugaugaugcugcccgccacccuggccuuccaccucaccagccgcgacggcgagccccggaugaucguggggaagaacgagcgcggcaagagccugcuguucaagaccgccagcgggaucaacaugugcacccucaucgccauggaccugggcgagaugugcgacgacaccgugaccuacaagugcccccugaucaccgagguggagcccgaggacaucgacugcuggugcaaccucaccagcaccugggugaccuacgggaccugcaaccaggccggcgagcaccggcgcgacaagcggagcguggcccuggcgccccacgugggcauggggcuggacacccgcacccagaccuggaugagcgcggagggcgccuggcggcaggucgagaaggucgagaccugggccuuccgccaccccggguucaccauccucgcccuguuccuggcgcacuacaucggcaccucccucacccagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacgugaccacggacagccgcugccccacccagggcgaggcgauccugcccgaggagcaggaccagaacuacgucugcaagcacaccuacguggaccggggguggggcaacgggugcggccucuucgggaagggcucccuggugaccugcgccaaguuccagugccuggagagcaucgagggcaaggccguccagcacgagaaccucaaguacacggugaucaucaccgugcacaccggggaccagcaccaggucggcaacgagacccagggggugacggccgagaucacgccccaggccuccaccgucgaggcgauccugcccgaguacggcacccuggggcucgagugcagcccccgcaccggccuggacuucaacgagaugauccugcucacgaugaagaacaaggccuggauggugcaccggcagugguucuucgaccugccgcugcccuggaccuccggcgccaccaccgagacgcccaccuggaacaagaaggagcuccuggugaccuucaagaacgcccacgccaagaagcaggaggucguggugcuggggagccaggagggcgcgaugcacaccgcccucacgggggccaccgagauccagaccuccggcgggaccagcaucuucgccggccaccugaagugccgccugaagauggacaagcucgagcugaagggcauguccuacgccaugugccugaacgcguucguccucaagaaggaggugagcgagacgcagcacgggaccauccugaucaagguggaguacaagggcgaggacgcccccugcaagaucccguucagcaccgaggacgggcagggcaaggcccacaacggccggcugaucaccgccaaccccaucgucacgaagaaggaggagcccgugaacaucgaggcggagcccccguucggggaguccaacaucgugaucggcaucggggacaaggcccugaagaucaacugguacaagaagggcagcuccaucgggaagauguucgaggccaccgcccgcggcgcccggcgcauggcgauccucggcgacaccgccugggacuucgggagcgucggcggggugcugaacucccugggcaagauggugcaccagaucuucgggagcgccuacaccgcccucuucuccggcgucagcuggaucaugaagaucggcaucggggugcugcugacguggaucggccucaacuccaagaacaccagcauguccuucagcugcaucgugaucgggaucaucacccuguaccugggcgccgucgugcaggcggacauggggugcgugaucaacuggaagggcaaggagcucaagugcggcuccgggaucuucgucaccaacgaggugcacacguggaccgagcaguacaaguuccaggccgacagccccaagcggcuggccaccgccaucgccggcgcgugggagaacggggugugcggcauccgcuccaccacgcgcauggagaaccugcucuggaagcagaucgccaacgagcugaacuacauccugugggagaacaacaucaagcucaccaucgucgugggggacgugaucggcguccuggagcagggcaagcggacccugacgccccagcccauggagcucaaguacagcuggaagacgugggggaaggccaagaucgugaccgccgagacccagaacuccagcuucaucaucgacggcccgaacacccccgagugccccuccgcgagccgcgccuggaacgugugggaggucgaggacuacggguucggcguguucacgaccaacaucuggcugaagcugcgggagauguacacccagcucugcgaccaccgccugaugagcgccgccgugaaggacgagcgggccguccacgcggacaugggcuacuggaucgagucccagaagaacgggagcuggaagcuggagaaggccucccucaucgaggugaagaccugcaccuggcccaagagccacacgcugugguccaacggcgugcuggagagcgacaugaucaucccgaagucccucgccgggcccaucagccagcacaacuaccgccccggcuaccacacccagaccgccgggccguggcaccugggcaagcuggagcucgacuucaacuacugcgagggcaccacggucgugaucaccgagaacugcgggacccggggccccucccugcgcaccacgaccgugagcgggaagcugauccacgaguggugcugccgguccugcacccugccgccccuccgcuacaugggcgaggacgggugcugguacggcauggagauccggccgaucaacgagaaggaggagaacauggucaagagccugguguccgccggcagcgggaaggcggacaacuucaccaugggcgugcucugccuggccauccuguucgaggaggucaugcgcgggaaguucggcaagaagcacaugaucgccggggcccucuucacguucgugcugcugcucuccggccagaucaccuggcgggacauggcccacacccugaucaugaucggcagcaacgcguccgaccgcauggggaugggcgugaccuaccuggcccucaucgccacguucaagauccagcccuuccuggcccugggguucuuccuccggaagcugaccagccgcgagaaccugcuccugggcgucggccuggcgauggccaccacccuccagcugcccgaggacaucgagcagauggccaacgggaucgcccugggccucauggcccugaagcugaucacgcaguucgagaccuaccagcucuggaccgcgcuggugagccugaugugcuccaacaccaucuucacgcucaccguggccuggcggaccgccacccugauccuggccgucaucagccuccugcccgugugccaguccagcuccaugcgcaagacggacuggcugccgaugaccguggccgcgaugggggugccgccccucccccuguucaucuucagccugaaggacacccucaagcggcgcuccuggccgcugaacgagggcgugauggccgucgggcuggugagcauccucgccuccagcuuccugcgcaacgacgugcccauggccggcccccuggucgccggcgggcuccugaucgcgugcuacgugaucaccggcacguccgccgaccugaccguggagaaggccgccgacgucaccugggaggaggaggccgagcagaccggggugagccacaaccucaugaucacgguggacgacgacggcaccaugcggaucaaggacgacgagaccgagaacauccugaccguccugcucaagaccgcgcugcugaucguguccgggaucuuccccuacagcaucccggccacgcuccugguguggcacaccuggcagaagcagacccagcgcuccggcguccugugggacgugcccuccccgcccgagacccagaaggccgagcucgaggagggcguguaccggaucaagcagcaggggaucuucggcaagacgcaggucggggugggcgugcagaaggagggggucuuccacaccauguggcacgugacccgcggcgccgugcugacccacaacggcaagcggcuggagccgaacugggcgaacgucaagaaggaccucaucuccuacgggggcggguggaagcugagcgcccaguggcagaagggcgaggagguccaggugaucgccgucgagcccgggaagaaccccaagaacuuccagacgaugcccggcaucuuccagaccaccaccggcgagaucggggccaucgcccuggacuucaagccgggcacguccgggagccccaucaucaaccgcgagggcaagguggugggccuguacgggaacggcgucgugaccaagaacgggggcuacgugagcgggaucgcgcagaccaacgccgagcccgacggcccgacccccgagcucgaggaggagauguucaagaagcggaaccugacgaucauggaccugcaccccggcuccgggaagacccgcaaguaccuccccgccaucguccgggaggccaucaagcgccggcugcgcacccugauccucgccccgacccgggugguggcggccgagauggaggaggcccugaagggccugcccauccgcuaccagacgaccgccaccaagagcgagcacaccgggcgggagaucgucgaccucaugugccacgccacguucaccaugcgccugcugucccccgugcgggugcccaacuacaaccucaucgucauggacgaggcgcacuucaccgacccggccagcaucgccgcccgcggcuacaucuccacccggguggggaugggcgaggcggccgccaucuucaugacggccacgccgcccggcaccgccgacgcguucccccagagcaacgccccgauccaggacgaggagcgcgacauccccgagcgguccuggaacagcgggaacgaguggaucaccgacuucgccggcaagacggugugguucguccccuccaucaaggccgggaacgacaucgccaacugccugcgcaagaacggcaagaaggugauccagcugagccgcaagaccuucgacaccgaguaccagaagaccaagcucaacgacugggacuucguggucacgaccgacaucuccgagaugggggcgaacuucaaggccgaccgggugaucgacccccgccggugccugaagccggugauccugaccgacggccccgagcgcgucauccucgccggccccaugcccgugaccguggccagcgccgcgcagcggcgcgggcgggucggccgcaacccgcagaaggagaacgaccaguacaucuucacggggcagccccugaacaacgacgaggaccacgcccacuggaccgaggccaagaugcugcucgacaacaucaacacccccgagggcaucauccccgcccuguucgagccggagcgggagaaguccgcggccaucgacggggaguaccgccugaagggcgagagccggaagaccuucguggagcucaugcgccggggcgaccugcccguguggcuggcccacaaggucgccuccgaggggaucaaguacaccgaccgcaaguggugcuucgacggcgagcggaacaaccagauccucgaggagaacauggacguggagaucuggacgaaggagggggagaagaagaagcugcgcccccgguggcuggacgcccgcaccuacagcgacccccucgcgcugaaggaguucaaggacuucgccgccggccggaaguccaucgcccuggaccucgucaccgagaucggccgcgugccgagccaccuggcccaccgcacccggaacgcgcuggacaaccucgugaugcugcacacguccgagcacgggggccgcgccuaccggcacgccgucgaggagcugcccgagaccauggagacccuccugcugcucgggcugaugauccugcucaccggcggggccaugcuguuccugaucagcggcaagggcaucgggaagacgagcaucggccucaucugcgugguggccuccagcgggaugcuguggauggcggacgucccccugcaguggaucgccuccgccaucgugcucgaguucuucaugauggugcugcugaucccggagcccgagaagcagcgcacgccccaggacaaccagcucgccuacgucgugaucggcauccugacccuggccgcgaucguggccgccaacgagauggggcuccuggagaccacgaagcgggaccugggcaugagcaaggagcccggcgucguguccccgaccagcuaccucgacguggaccugcaccccgccuccgcguggacccuguacgccgucgccaccacggugaucacccccaugcuccgccacaccaucgagaacagcaccgccaacgugucccuggccgcgaucgccaaccaggccgucgugcugauggggcucgacaagggcuggcccaucagcaagauggaccugggggugccgcugcucgcccugggcugcuacucccaggucaacccccugacgcucaccgccgcggugcugcugcucgugacccacuacgccaucaucgggcccggccugcaggccaaggccacccgggaggcccagaagcgcacggcggccggcaucaugaagaaccccaccgucgacgggaucaugaccaucgaccuggacccggugaucuacgacagcaaguucgagaagcagcucggccaggugaugcugcugguccucugcgccgugcagcugcugcucaugcggaccuccugggccuucugcgaggcgcugacgcuggccaccgggcccaucaccacccucugggagggcagccccggcaaguucuggaacacgaccaucgccguguccauggccaacaucuuccgcgggagcuaccuggccggcgcggggcuggccuucuccaucaugaaguccgucggcaccgggaagcggggcaccggcucccagggggagacgcucggcgagaaguggaagaagaagcugaaccagcugagccgcaaggaguucgaccucuacaagaaguccgggaucaccgagguggaccggaccgaggccaaggagggccugaagcgcggggagaucacccaccacgccgugucccggggcagcgccaagcugcagugguucgucgagcgcaacauggugauccccgagggccgggugaucgaccucgggugcggccgcgggggcugguccuacuacugcgcggggcugaagaaggucaccgaggugcggggcuacacgaagggcgggccgggccacgaggagcccgugcccaugagcaccuacggguggaacaucgucaagcugauguccggcaaggacguguucuaccucccgcccgagaagugcgacacccugcugugcgacaucggggagagcucccccagccccaccguggaggagucccgcacgauccggguccugaagaugguggagcccuggcucaagaacaaccaguucugcaucaaggugcugaaccccuacaugcccaccgucaucgagcaccuggagcgccuccagcgcaagcacggcggcaugcuggugcggaacccccugagccgcaacuccacccacgagauguacuggaucagcaacgggaccggcaacaucguguccagcgucaacauggugucccggcuccugcugaaccgcuucacgaugacccaccggcgccccaccaucgagaaggacguggaccucggggccggcacccggcacgucaacgccgagccggagacgcccaacauggacgugaucggcgagcgcauccggcgcaucaaggaggagcacagcuccaccuggcacuacgacgacgagaaccccuacaagaccugggccuaccacgggagcuacgaggucaaggccaccggcuccgcgagcagcaugaucaacgggguggugaagcugcugacgaagccgugggacgucgugcccauggugacccagauggccaugaccgacaccacgcccuucggccagcagcgggucuucaaggagaagguggacacccgcacgccccggccgaugcccgggacccgcaaggugauggagaucacggccgaguggcucuggcggacccugggccgcaacaagcggccccgccugugcacccgggaggaguucaucaagaagguccgcaccaacgccgcgaugggcgccguguucacggaggagaaccagugggacuccgcccgcgccgccguggaggacgaggaguucuggaagcucgucgaccgggagcgcgagcugcacaagcuggggaagugcggcagcugcguguacaacaugauggggaagcgggagaagaagcucggcgaguucgggaaggcgaagggcucccgcgccaucugguacauguggcugggcgcccgguaccuggaguucgaggcccucggguuccugaacgaggaccacugguucagccgcgagaacuccuacagcggcguggagggggagggccugcacaagcucggguacauccugcgggacaucuccaagauccccggcggcgccauguacgcggacgacaccgccgggugggacacccgcaucaccgaggacgaccugcacaacgaggagaagaucacgcagcagauggacccggagcaccggcagcucgccaacgccaucuucaagcugaccuaccagaacaaggucgugaaggugcagcgccccacccccaagggcaccgucauggacaucaucagccggaaggaccagcgcggguccggccaggugggcacguacgggcugaacaccuucaccaacauggaggcccagcucauccggcagauggagggcgagggggugcugagcaaggcggaccuggagaacccccaccuccuggagaagaaggucacccaguggcuggagaccaagggcguggagcgccucaagcggauggccaucuccggggacgacugcguggucaagccgaucgacgaccgcuucgccagcgcccugcuggcccucaacgacaugggcaaggugcggaaggacaucccccaguggcagcccuccaagggcuggcacgacuggcagcagguccccuucugcagccaccacuuccacgagcugaucaugaaggacgggcgcaagcuggucgugccgugccggccccaggacgagcucaucggccgcgcgcggaucucccagggggccggcuggagccugcgcgagacggccugccuggggaaggccuacgcgcagaugugggcccucauguacuuccaccgccgggaccugcgccuggccuccaacgccaucugcagcgccgugcccguccacugggugcccaccucccggaccaccuggagcauccacgcgcaccaccaguggaugacgaccgaggacaugcucaccguguggaaccgcgucuggaucgaggacaacccguggauggaggacaagacccccgugacgaccugggaggacgugcccuaccugggcaagcgggaggaccaguggugcggcagccugaucgggcucaccucccgcgccaccugggcccagaacauccugacggccauccagcagguccggagccugaucggcaacgaggaguuccucgacuacaugcccuccaugaagcgcuuccggaaggaggaggagagcgagggggccaucugguga

SEQ ID NO: 10408 - RNA, 9873 nt, Artificial Sequence
  derived and/or modified CDS sequence (opt1) from DENV-3__AY744679__SS-prME
accagccugugccucaugaugaugcugcccgccacccuggccuuccaccucaccagccgcgacggcgagccccggaugaucguggggaagaacgagcgcggcaagagccugcuguucaagaccgccagcgggaucaacaugugcacccucaucgccauggaccugggcgagaugugcgacgacaccgugaccuacaagugcccccugaucaccgagguggagcccgaggacaucgacugcuggugcaaccucaccagcaccugggugaccuacgggaccugcaaccaggccggcgagcaccggcgcgacaagcggagcguggcccuggcgccccacgugggcauggggcuggacacccgcacccagaccuggaugagcgcggagggcgccuggcggcaggucgagaaggucgagaccugggccuuccgccaccccggguucaccauccucgcccuguuccuggcgcacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacgugaccacggacagccgcugccccacccagggcgaggcgauccugcccgaggagcaggaccagaacuacgucugcaagcacaccuacguggaccggggguggggcaacgggugcggccucuucgggaagggcucccuggugaccugcgccaaguuccagugccuggagagcaucgagggcaaggucgugcagcacgagaaccucaaguacacggugaucaucaccguccacaccggggaccagcaccaggugggcaacgagacccagggggucacggccgagaucacgccccaggccuccaccguggaggccauccugcccgaguacggcacccuggggcucgagugcagcccccgcaccggccuggacuucaacgagaugauccugcucacgaugaagaacaaggcguggauggugcaccggcagugguucuucgaccugccgcugcccuggaccuccggcgccaccaccgagacgcccaccuggaacaagaaggagcuccuggucaccuucaagaacgcccacgccaagaagcaggagguggugguccuggggagccaggagggcgccaugcacaccgcgcucacgggggccaccgagauccagaccuccggcgggaccagcaucuucgccggccaccugaagugccgccugaagauggacaagcucgagcugaagggcauguccuacgccaugugccugaacgccuucgugcucaagaaggaggugagcgagacgcagcacgggaccauccugaucaaggucgaguacaagggcgaggacgcgcccugcaagaucccguucagcaccgaggacgggcagggcaaggcccacaacggccggcugaucaccgccaaccccaucgugacgaagaaggaggagcccgugaacaucgaggccgagcccccguucggggaguccaacaucgucaucggcaucggggacaaggcgcugaagaucaacugguacaagaagggcagcuccaucgggaagauguucgaggccaccgcccgcggcgcccggcgcauggccauccucggcgacaccgcgugggacuucgggagcgugggcggggugcugaacucccugggcaagaugguccaccagaucuucgggagcgccuacaccgcccucuucuccggcgugagcuggaucaugaagaucggcaucggggugcugcugacguggaucggccucaacuccaagaacaccagcauguccuucagcugcaucgucaucgggaucaucacccuguaccugggcgccguggugcaggccgacauggggugcgucaucaacuggaagggccaggagcucaagugcggcuccgggaucuucgugaccaacgaggugcacacguggaccgagcaguacaaguuccaggcggacagccccaagcggcuggccaccgccaucgccggcgccugggagaacggggucugcggcauccgcuccaccacgcgcauggagaaccugcucuggaagcagaucgcgaacgagcugaacuacauccugugggagaacaacaucaagcucaccgugguggucggggacgugaucggcgugcuggagcagggcaagcggacccugacgccccagcccauggagcucaaguacagcuggaagacgugggggaaggccaagaucgucaccgccgagacccagaacuccagcuucaucaucgacggcccgaacacccccgagugccccuccgccagccgcgcguggaacgugugggagguggaggacuacggguucggcgucuucacgaccaacaucuggcugaagcugcgggagauguacacccagcucugcgaccaccgccugaugagcgccgccgugaaggacgagcgggccgugcacgccgacaugggcuacuggaucgagucccagaagaacgggagcuggaagcuggagaaggcgucccucaucgaggucaagaccugcaccuggcccaagagccacacgcugugguccaacggcgugcuggagagcgacaugaucaucccgaagucccucgccgggcccaucagccagcacaacuaccgccccggcuaccacacccagaccgccgggccguggcaccugggcaagcuggagcucgacuucaacuacugcgagggcaccacgguggucaucaccgagaacugcgggacccggggccccucccugcgcaccacgaccgugagcgggaagcugauccacgaguggugcugccgguccugcacccugccgccccuccgcuacaugggcgaggacgggugcugguacggcauggagauccggccgaucaacgagaaggaggagaacauggucaagagccuggucuccgccggcagcgggaaggccgacaacuucaccaugggcgugcucugccuggcgauccuguucgaggaggugaugcgcgggaaguucggcaagaagcacaugaucgccggggcccucuucacguucguccugcugcucuccggccagaucaccuggcgggacauggcccacacccugaucaugaucggcagcaacgccuccgaccgcauggggaugggcgugaccuaccuggcgcucaucgccacguucaagauccagcccuuccuggcccugggguucuuccuccggaagcugaccagccgcgagaaccugcuccugggcgugggccuggccauggcgaccacccuccagcugcccgaggacaucgagcagauggccaacgggaucgcccugggccucauggcccugaagcugaucacgcaguucgagaccuaccagcucuggaccgcccuggucagccugaugugcuccaacaccaucuucacgcucaccguggcguggcggaccgccacccugauccuggccgugaucagccuccugcccgucugccaguccagcuccaugcgcaagacggacuggcugccgaugaccguggccgccaugggggugccgccccucccccuguucaucuucagccugaaggacacccucaagcggcgcuccuggccgcugaacgagggcgugauggcgguggggcuggucagcauccucgccuccagcuuccugcgcaacgacgugcccauggccggcccccugguggccggcgggcuccugaucgccugcuacgucaucaccggcacguccgcggaccugaccguggagaaggccgccgacgugaccugggaggaggaggccgagcagaccggggucagccacaaccucaugaucacgguggacgacgacggcaccaugcggaucaaggacgacgagaccgagaacauccugaccgugcugcucaagaccgcccugcugaucgucuccgggaucuuccccuacagcaucccggcgacgcuccugguguggcacaccuggcagaagcagacccagcgcuccggcgugcugugggacguccccuccccgcccgagacccagaaggccgagcucgaggagggcguguaccggaucaagcagcaggggaucuucggcaagacccaggugggggucggcgugcagaaggaggggguguuccacaccauguggcacgucacccgcggcgccgugcugacccacaacggcaagcggcuggagccgaacugggccaacgugaagaaggaccucaucuccuacgggggcggguggaagcugagcgcgcaguggcagaagggcgaggagguccaggugaucgccguggagcccgggaagaaccccaagaacuuccagacgaugcccggcaucuuccagaccaccaccggcgagaucggggccaucgcccuggacuucaagccgggcacguccgggagccccaucaucaaccgcgagggcaaggucgugggccuguacgggaacggcguggucaccaagaacgggggcuacgugagcgggaucgcccagaccaacgcggagcccgacggcccgacccccgagcucgaggaggagauguucaagaagcggaaccugacgaucauggaccugcaccccggcuccgggaagacccgcaaguaccuccccgccaucgugcgggaggccaucaagcgccggcugcgcacccugauccucgccccgacccgggucguggccgcggagauggaggaggcccugaagggccugcccauccgcuaccagacgaccgccaccaagagcgagcacaccgggcgggagaucguggaccucaugugccacgccacguucaccaugcgccugcugucccccguccgggugcccaacuacaaccucaucgugauggacgaggcccacuucaccgacccggcgagcaucgccgcccgcggcuacaucuccacccgggucgggaugggcgaggccgcggccaucuucaugacggccacgccgcccggcaccgccgacgccuucccccagagcaacgcgccgauccaggacgaggagcgcgacauccccgagcgguccuggaacagcgggaacgaguggaucaccgacuucgccggcaagacggugugguucgugcccuccaucaaggccgggaacgacaucgccaacugccugcgcaagaacggcaagaaggucauccagcugagccgcaagaccuucgacaccgaguaccagaagaccaagcucaacgacugggacuucguggugacgaccgacaucuccgagaugggggccaacuucaaggcggaccgggucaucgacccccgccggugccugaagccggugauccugaccgacggccccgagcgcgugauccucgccggccccaugcccgucaccguggccagcgccgcccagcggcgcgggcgggugggccgcaacccgcagaaggagaacgaccaguacaucuucacggggcagccccugaacaacgacgaggaccacgcgcacuggaccgaggccaagaugcugcucgacaacaucaacacccccgagggcaucauccccgcccuguucgagccggagcgggagaaguccgccgcgaucgacggggaguaccgccugaagggcgagagccggaagaccuucgucgagcucaugcgccggggcgaccugcccguguggcuggcccacaaggucgccuccgaggggaucaaguacaccgaccgcaaguggugcuucgacggcgagcggaacaaccagauccucgaggagaacauggacguggagaucuggacgaaggagggggagaagaagaagcugcgcccccgguggcuggacgcccgcaccuacagcgacccccucgcccugaaggaguucaaggacuucgcggccggccggaaguccaucgcccuggaccucgugaccgagaucggccgcgucccgagccaccuggcccaccgcacccggaacgcccuggacaaccucgugaugcugcacacguccgagcacgggggccgcgcguaccggcacgccguggaggagcugcccgagaccauggagacccuccugcugcucgggcugaugauccugcucaccggcggggccaugcuguuccugaucagcggcaagggcaucgggaagacgagcaucggccucaucugcgucguggccuccagcgggaugcuguggauggccgacgugccccugcaguggaucgcguccgccaucguccucgaguucuucaugauggugcugcugaucccggagcccgagaagcagcgcacgccccaggacaaccagcucgccuacguggucaucggcauccugacccuggccgccaucguggcggccaacgagauggggcuccuggagaccacgaagcgggaccugggcaugagcaaggagcccggcguggucuccccgaccagcuaccucgacguggaccugcaccccgccuccgccuggacccuguacgcgguggccaccacggucaucacccccaugcuccgccacaccaucgagaacagcaccgccaacgugucccuggccgccaucgcgaaccaggccgugguccugauggggcucgacaagggcuggcccaucagcaagauggaccugggggugccgcugcucgcccugggcugcuacucccaggugaacccccugacgcucaccgccgccguccugcugcucgugacccacuacgcgaucaucgggcccggccugcaggccaaggccacccgggaggcccagaagcgcacggccgcgggcaucaugaagaaccccaccguggacgggaucaugaccaucgaccuggacccggucaucuacgacagcaaguucgagaagcagcucggccaggugaugcugcuggugcucugcgccguccagcugcugcucaugcggaccuccugggccuucugcgaggcccugacgcuggcgaccgggcccaucaccacccucugggagggcagccccggcaaguucuggaacacgaccaucgccguguccauggccaacaucuuccgcgggagcuaccuggccggcgccgggcuggcguucuccaucaugaaguccgugggcaccgggaagcggggcaccggcucccagggggagacgcucggcgagaaguggaagaagaagcugaaccagcugagccgcaaggaguucgaccucuacaagaaguccgggaucaccgaggucgaccggaccgaggccaaggagggccugaagcgcggggagaucacccaccacgccgugucccggggcagcgccaagcugcagugguucguggagcgcaacauggucauccccgagggccgggugaucgaccucgggugcggccgcgggggcugguccuacuacugcgccgggcugaagaaggugaccgagguccggggcuacacgaagggcgggccgggccacgaggagcccgugcccaugagcaccuacggguggaacaucgugaagcugauguccggcaaggacgucuucuaccucccgcccgagaagugcgacacccugcugugcgacaucggggagagcucccccagccccaccguggaggagucccgcacgauccgggugcugaagauggucgagcccuggcucaagaacaaccaguucugcaucaaggugcugaaccccuacaugcccaccgugaucgagcaccuggagcgccuccagcgcaagcacggcggcaugcugguccggaacccccugagccgcaacuccacccacgagauguacuggaucagcaacgggaccggcaacaucguguccagcgugaacauggucucccggcuccugcugaaccgcuucacgaugacccaccggcgccccaccaucgagaaggacguggaccucggggcgggcacccggcacgucaacgccgagccggagacgcccaacauggacaucaucggcgagcgcauccggcgcaucaaggaggagcacagcuccaccuggcacuacgacgacgagaaccccuacaagaccugggccuaccacgggagcuacgaggugaaggccaccggcuccgccagcagcaugaucaacgggguggucaagcugcugacgaagccgugggacguggugcccauggucacccagauggcgaugaccgacaccacgcccuucggccagcagcggguguucaaggagaagguggacacccgcacgccccggccgaugcccgggacccgcaaggucauggagaucacggccgaguggcucuggcggacccugggccgcaacaagcggccccgccugugcacccgggaggaguucaugaagaaggugcgcaccaacgccgccaugggcgcgguguucacggaggagaaccagugggacuccgcccgcgccgccgucgaggacgaggaguucuggaagcucguggaccgggagcgcgagcugcacaagcuggggaagugcggcagcugcguguacaacaugauggggaagcgggagaagaagcucggcgaguucgggaaggccaagggcucccgcgcgaucugguacauguggcugggcgcccgguaccuggaguucgaggcccucggguuccugaacgaggaccacugguucagccgcgagaacuccuacagcggcgucgagggggagggccugcacaagcucggguacauccugcgggacaucuccaagauccccggcggcgccauguacgccgacgacaccgcggggugggacacccgcaucaccgaggacgaccugcacaacgaggagaagaucacgcagcagauggacccggagcaccggcagcucgccaacgccaucuucaagcugaccuaccagaacaagguggugaagguccagcgccccacccccaagggcaccgugauggacaucaucagccggaaggaccagcgcggguccggccaggugggcacguacgggcugaacaccuucaccaacauggaggcccagcucauccggcagauggagggcgaggggguccugagcaaggccgaccuggagaacccccaccuccuggagaagaaggugacccaguggcuggagaccaagggcguggagcgccucaagcggauggcgaucuccggggacgacugcgucgugaagccgaucgacgaccgcuucgccaacgcccugcuggcccucaacgacaugggcaaggugcggaaggacaucccccaguggcagcccagcaagggcuggcacgacuggcagcagguccccuucugcucccaccacuuccacgagcugaucaugaaggacgggcgcaagcugguggugccgugccggccccaggacgagcucaucggccgcgcccggaucagccagggggcgggcuggucccugcgcgagacggccugccuggggaaggccuacgcccagaugugggcgcucauguacuuccaccgccgggaccugcgccuggccagcaacgccaucugcuccgccguccccgugcacugggugcccaccagccggaccaccugguccauccacgcccaccaccaguggaugacgaccgaggacaugcucaccgucuggaaccgcguguggaucgaggacaacccguggauggaggacaagacccccgugagcacgugggaggacguccccuaccugggcaagcgggaggaccaguggugcggcagccugaucgggcucaccucccgcgcgaccugggcccagaacauccugaccgccauccagcagguccggagccugaucggcaacgaggaguuccucgacuacaugcccuccaugaagcgcuuccggaaggaggaggagagcgagggggccaucugguga

SEQ ID NO: 10409 - RNA, 9873 nt, Artificial Sequence
  derived and/or modified CDS sequence (opt1) from DENV-3__AY744680__SS-prME
accagccugugccucaugaugaugcugcccgccacccuggccuuccaccucaccagccgcgacggcgagccccggaugaucguggggaagaacgagcgcggcaagagccugcuguucaagaccgccagcgggaucaacaugugcacccucaucgccauggaccugggcgagaugugcgacgacaccgugaccuacaagugcccccugaucaccgagguggagcccgaggacaucgacugcuggugcaaccucaccagcaccugggugaccuacgggaccugcaaccaggccggcgagcaccggcgcgacaagcggagcguggcccuggcgccccacgugggcauggggcuggacacccgcacccagaccuggaugagcgcggagggcgccuggcggcaggucgagaaggucgagaccugggccuuccgccaccccggguucaccauccucgcccuguuccuggcgcacuacaucggcaccucccucacccagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacgugaccacggacagccgcugccccacccagggcgaggcgauccugcccgaggagcaggaccagaacuacgucugcaagcacaccuacguggaccggggguggggcaacgggugcggccucuucgggaagggcucccuggugaccugcgccaaguuccagugccuggagagcaucgagggcaaggccguccagcacgagaaccucaaguacacggugaucaucaccgugcacaccggggaccagcaccaggucggcaacgagacccagggggugacggccgagaucacgccccaggccuccaccgucgaggcgauccugcccgaguacggcacccuggggcucgagugcagcccccgcaccggccuggacuucaacgagaugauccugcucacgaugaagaacaaggccuggauggugcaccggcagugguucuucgaccugccgcugcccuggaccuccggcgccaccaccgagacgcccaccuggaacaagaaggagcuccuggugaccuucaagaacgcccacgccaagaagcaggaggucguggugcuggggagccaggagggcgcgaugcacaccgcccucacgggggccaccgagauccagaccuccggcgggaccagcaucuucgccggccaccugaagugccgccugaagauggacaagcucgagcugaagggcauguccuacgccaugugccugaacgcguucguccucaagaaggaggugagcgagacgcagcacgggaccauccugaucaagguggaguacaagggcgaggacgcccccugcaagaucccguucagcaccgaggacgggcagggcaaggcccacaacggccggcugaucaccgccaaccccaucgucacgaagaaggaggagcccgugaacaucgaggcggagcccccguucggggaguccaacaucgugaucggcaucggggacaaggcccugaagaucaacugguacaagaagggcagcuccaucgggaagauguucgaggccaccgcccgcggcgcccggcgcauggcgauccucggcgacaccgccugggacuucgggagcgucggcggggugcugaacucccugggcaagauggugcaccagaucuucgggagcgccuacaccgcccucuucuccggcgucagcuggaucaugaagaucggcaucggggugcugcugacguggaucggccucaacuccaagaacaccagcauguccuucagcugcaucgugaucgggaucaucacccuguaccugggcgccgucgugcaggcggacauggggugcgugaucaacuggaagggcaaggagcucaagugcggcuccgggaucuucgucaccaacgaggugcacacguggaccgagcaguacaaguuccaggccgacagccccaagcggcuggccaccgccaucgccggcgcgugggagaacggggugugcggcauccgcuccaccacgcgcauggagaaccugcucuggaagcagaucgccaacgagcugaacuacauccugugggagaacaacaucaagcucaccaucgucgugggggacgugaucggcguccuggagcagggcaagcggacccugacgccccagcccauggagcucaaguacagcuggaagacgugggggaaggccaagaucgugaccgccgagacccagaacuccagcuucaucaucgacggcccgaacacccccgagugccccuccgcgagccgcgccuggaacgugugggaggucgaggacuacggguucggcguguucacgaccaacaucuggcugaagcugcgggagauguacacccagcucugcgaccaccgccugaugagcgccgccgugaaggacgagcgggccguccacgcggacaugggcuacuggaucgagucccagaagaacgggagcuggaagcuggagaaggccucccucaucgaggugaagaccugcaccuggcccaagagccacacgcugugguccaacggcgugcuggagagcgacaugaucaucccgaagucccucgccgggcccaucagccagcacaacuaccgccccggcuaccacacccagaccgccgggccguggcaccugggcaagcuggagcucgacuucaacuacugcgagggcaccacggucgugaucaccgagaacugcgggacccggggccccucccugcgcaccacgaccgugagcgggaagcugauccacgaguggugcugccgguccugcacccugccgccccuccgcuacaugggcgaggacgggugcugguacggcauggagauccggccgaucaacgagaaggaggagaacauggucaagagccugguguccgccggcagcgggaaggcggacaacuucaccaugggcgugcucugccuggccauccuguucgaggaggucaugcgcgggaaguucggcaagaagcacaugaucgccggggcccucuucacguucgugcugcugcucuccggccagaucaccuggcgggacauggcccacacccugaucaugaucggcagcaacgcguccgaccgcauggggaugggcgugaccuaccuggcccucaucgccacguucaagauccagcccuuccuggcccugggguucuuccuccggaagcugaccagccgcgagaaccugcuccugggcgucggccuggcgauggccaccacccuccagcugcccgaggacaucgagcagauggccaacgggaucgcccugggccucauggcccugaagcugaucacgcaguucgagaccuaccagcucuggaccgcgcuggugagccugaugugcuccaacaccaucuucacgcucaccguggccuggcggaccgccacccugauccuggccgucaucagccuccugcccgugugccaguccagcuccaugcgcaagacggacuggcugccgaugaccguggccgcgaugggggugccgccccucccccuguucaucuucagccugaaggacacccucaagcggcgcuccuggccgcugaacgagggcgugauggccgucgggcuggugagcauccucgccuccagcuuccugcgcaacgacgugcccauggccggcccccuggucgccggcgggcuccugaucgcgugcuacgugaucaccggcacguccgccgaccugaccguggagaaggccgccgacgucaccugggaggaggaggccgagcagaccggggugagccacaaccucaugaucacgguggacgacgacggcaccaugcggaucaaggacgacgagaccgagaacauccugaccguccugcucaagaccgcgcugcugaucguguccgggaucuuccccuacagcaucccggccacgcuccugguguggcacaccuggcagaagcagacccagcgcuccggcguccugugggacgugcccuccccgcccgagacccagaaggccgagcucgaggagggcguguaccggaucaagcagcaggggaucuucggcaagacgcaggucggggugggcgugcagaaggagggggucuuccacaccauguggcacgugacccgcggcgccgugcugacccacaacggcaagcggcuggagccgaacugggcgaacgucaagaaggaccucaucuccuacgggggcggguggaagcugagcgcccaguggcagaagggcgaggagguccaggugaucgccgucgagcccgggaagaaccccaagaacuuccagacgaugcccggcaucuuccagaccaccaccggcgagaucggggccaucgcccuggacuucaagccgggcacguccgggagccccaucaucaaccgcgagggcaagguggugggccuguacgggaacggcgucgugaccaagaacgggggcuacgugagcgggaucgcgcagaccaacgccgagcccgacggcccgacccccgagcucgaggaggagauguucaagaagcggaaccugacgaucauggaccugcaccccggcuccgggaagacccgcaaguaccuccccgccaucguccgggaggccaucaagcgccggcugcgcacccugauccucgccccgacccgggugguggcggccgagauggaggaggcccugaagggccugcccauccgcuaccagacgaccgccaccaagagcgagcacaccgggcgggagaucgucgaccucaugugccacgccacguucaccaugcgccugcugucccccgugcgggugcccaacuacaaccucaucgucauggacgaggcgcacuucaccgacccggccagcaucgccgcccgcggcuacaucuccacccggguggggaugggcgaggcggccgccaucuucaugacggccacgccgcccggcaccgccgacgcguucccccagagcaacgccccgauccaggacgaggagcgcgacauccccgagcgguccuggaacagcgggaacgaguggaucaccgacuucgccggcaagacggugugguucguccccuccaucaaggccgggaacgacaucgccaacugccugcgcaagaacggcaagaaggugauccagcugagccgcaagaccuucgacaccgaguaccagaagaccaagcucaacgacugggacuucguggucacgaccgacaucuccgagaugggggcgaacuucaaggccgaccgggugaucgacccccgccggugccugaagccggugauccugaccgacggccccgagcgcgucauccucgccggccccaugcccgugaccguggccagcgccgcgcagcggcgcgggcgggucggccgcaacccgcagaaggagaacgaccaguacaucuucacggggcagccccugaacaacgacgaggaccacgcccacuggaccgaggccaagaugcugcucgacaacaucaacacccccgagggcaucauccccgcccuguucgagccggagcgggagaaguccgcggccaucgacggggaguaccgccugaagggcgagagccggaagaccuucguggagcucaugcgccggggcgaccugcccguguggcuggcccacaaggucgccuccgaggggaucaaguacaccgaccgcaaguggugcuucgacggcgagcggaacaaccagauccucgaggagaacauggacguggagaucuggacgaaggagggggagaagaagaagcugcgcccccgguggcuggacgcccgcaccuacagcgacccccucgcgcugaaggaguucaaggacuucgccgccggccggaaguccaucgcccuggaccucgucaccgagaucggccgcgugccgagccaccuggcccaccgcacccggaacgcgcuggacaaccucgugaugcugcacacguccgagcacgggggccgcgccuaccggcacgccgucgaggagcugcccgagaccauggagacccuccugcugcucgggcugaugauccugcucaccggcggggccaugcuguuccugaucagcggcaagggcaucgggaagacgagcaucggccucaucugcgugguggccuccagcgggaugcuguggauggcggacgucccccugcaguggaucgccuccgccaucgugcucgaguucuucaugauggugcugcugaucccggagcccgagaagcagcgcacgccccaggacaaccagcucgccuacgucgugaucggcauccugacccuggccgcgaucguggccgccaacgagauggggcuccuggagaccacgaagcgggaccugggcaugagcaaggagcccggcgucguguccccgaccagcuaccucgacguggaccugcaccccgccuccgcguggacccuguacgccgucgccaccacggugaucacccccaugcuccgccacaccaucgagaacagcaccgccaacgugucccuggccgcgaucgccaaccaggccgucgugcugauggggcucgacaagggcuggcccaucagcaagauggaccugggggugccgcugcucgcccugggcugcuacucccaggucaacccccugacgcucaccgccgcggugcugcugcucgugacccacuacgccaucaucgggcccggccugcaggccaaggccacccgggaggcccagaagcgcacggcggccggcaucaugaagaaccccaccgucgacgggaucaugaccaucgaccuggacccggugaucuacgacagcaaguucgagaagcagcucggccaggugaugcugcugguccucugcgccgugcagcugcugcucaugcggaccuccugggccuucugcgaggcgcugacgcuggccaccgggcccaucaccacccucugggagggcagccccggcaaguucuggaacacgaccaucgccguguccauggccaacaucuuccgcgggagcuaccuggccggcgcggggcuggccuucuccaucaugaaguccgucggcaccgggaagcggggcaccggcucccagggggagacgcucggcgagaaguggaagaagaagcugaaccagcugagccgcaaggaguucgaccucuacaagaaguccgggaucaccgagguggaccggaccgaggccaaggagggccugaagcgcggggagaucacccaccacgccgugucccggggcagcgccaagcugcagugguucgucgagcgcaacauggugauccccgagggccgggugaucgaccucgggugcggccgcgggggcugguccuacuacugcgcggggcugaagaaggucaccgaggugcggggcuacacgaagggcgggccgggccacgaggagcccgugcccaugagcaccuacggguggaacaucgucaagcugauguccggcaaggacguguucuaccucccgcccgagaagugcgacacccugcugugcgacaucggggagagcucccccagccccaccguggaggagucccgcacgauccggguccugaagaugguggagcccuggcucaagaacaaccaguucugcaucaaggugcugaaccccuacaugcccaccgucaucgagcaccuggagcgccuccagcgcaagcacggcggcaugcuggugcggaacccccugagccgcaacuccacccacgagauguacuggaucagcaacgggaccggcaacaucguguccagcgucaacauggugucccggcuccugcugaaccgcuucacgaugacccaccggcgccccaccaucgagaaggacguggaccucggggccggcacccggcacgucaacgccgagccggagacgcccaacauggacgugaucggcgagcgcauccggcgcaucaaggaggagcacagcuccaccuggcacuacgacgacgagaaccccuacaagaccugggccuaccacgggagcuacgaggucaaggccaccggcuccgcgagcagcaugaucaacgggguggugaagcugcugacgaagccgugggacgucgugcccauggugacccagauggccaugaccgacaccacgcccuucggccagcagcgggucuucaaggagaagguggacacccgcacgccccggccgaugcccgggacccgcaaggugauggagaucacggccgaguggcucuggcggacccugggccgcaacaagcggccccgccugugcacccgggaggaguucaucaagaagguccgcaccaacgccgcgaugggcgccguguucacggaggagaaccagugggacuccgcccgcgccgccguggaggacgaggaguucuggaagcucgucgaccgggagcgcgagcugcacaagcuggggaagugcggcagcugcguguacaacaugauggggaagcgggagaagaagcucggcgaguucgggaaggcgaagggcucccgcgccaucugguacauguggcugggcgcccgguaccuggaguucgaggcccucggguuccugaacgaggaccacugguucagccgcgagaacuccuacagcggcguggagggggagggccugcacaagcucggguacauccugcgggacaucuccaagauccccggcggcgccauguacgcggacgacaccgccgggugggacacccgcaucaccgaggacgaccugcacaacgaggagaagaucacgcagcagauggacccggagcaccggcagcucgccaacgccaucuucaagcugaccuaccagaacaaggucgugaaggugcagcgccccacccccaagggcaccgucauggacaucaucagccggaaggaccagcgcggguccggccaggugggcacguacgggcugaacaccuucaccaacauggaggcccagcucauccggcagauggagggcgagggggugcugagcaaggcggaccuggagaacccccaccuccuggagaagaaggucacccaguggcuggagaccaagggcguggagcgccucaagcggauggccaucuccggggacgacugcguggucaagccgaucgacgaccgcuucgccaacgcccugcuggcccucaacgacaugggcaaggugcggaaggacaucccccaguggcagcccagcaagggcuggcacgacuggcagcagguccccuucugcucccaccacuuccacgagcugaucaugaaggacgggcgcaagcuggucgugccgugccggccccaggacgagcucaucggccgcgcgcggaucagccagggggccggcuggucccugcgcgagacggccugccuggggaaggccuacgcgcagaugugggcccucauguacuuccaccgccgggaccugcgccuggccagcaacgccaucugcuccgccgugcccguccacugggugcccaccagccggaccaccugguccauccacgcgcaccaccaguggaugacgaccgaggacaugcucaccguguggaaccgcgucuggaucgaggacaacccguggauggaggacaagacccccgugacgaccugggaggacgugcccuaccugggcaagcgggaggaccaguggugcggcagccugaucgggcucaccagccgcgccaccugggcccagaacauccugacggccauccagcagguccggucccugaucggcaacgaggaguuccucgacuacaugcccagcaugaagcgcuuccggaaggaggaggaguccgagggggccaucugguga

SEQ ID NO: 10410 - RNA, 9873 nt, Artificial Sequence
  derived and/or modified CDS sequence (opt1) from DENV-3__AY744681__SS-prME
accucccugugccucaugaugaugcugcccgccacccuggccuuccaccucaccucccgggacggcgagccccggaugaucguggggaagaacgagcgcggcaagagccugcuguucaagaccgccuccgggaucaacaugugcacccucaucgccauggaccugggcgagaugugcgacgacaccgugaccuacaagugcccccugaucaccgagguggagcccgaggacaucgacugcuggugcaaccucaccagcaccugggugaccuacgggaccugcaaccaggccggcgagcaccggcgggacaagcgguccguggcccuggcgccccacgugggcauggggcuggacacccgcacccagaccuggaugagcgcggagggcgccuggcggcaggucgagaaggucgagaccugggccuuccgccaccccggguucaccauccucgcccuguuccuggcgcacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggccgcaucaccaacgugaccacggacagccggugccccacccagggcgaggcgauccugccggaggagcaggaccagaacuacgucugcaagcacaccuacguggaccgcggguggggcaacgggugcggccucuucgggaagggcucccuggugaccugcgccaaguuccagugccuggagagcaucgagggcaaggccguccagcacgagaaccucaaguacacggugaucaucaccgugcacaccggggaccagcaccaggucggcuccgagacccagggggugacggccgagaucacgccccaggccagcaccgucgaggcgauccugcccgaguacggcacccuggggcucgagugcagcccccggaccggccuggacuucaacgagaugauccugcucacgaugaagaacaaggccuggauggugcaccgccagugguucuucgaccugccgcugcccuggaccagcggcgccaccaccgagacgcccaccuggaacaagaaggagcuccuggugaccuucaagaacgcccacgccaagaagcaggaggucguggugcuggggucccaggagggcgcgaugcacaccgcccucacgggggccaccgagauccagaccagcggcgggaccuccaucuucgccggccaccugaagugccggcugaagauggacaagcucgagcugaagggcaugagcuacgccaugugccugaacgcguucguccucaagaaggaggugagcgagacgcagcacgggaccauccugaucaagguggaguacaagggcgaggacgcccccugcaagaucccguucuccaccgaggacgggcagggcaaggcccacaacggccgccugaucaccgccaaccccaucgucacgaagaaggaggagcccgugaacaucgaggcggagcccccguucggggagagcaacaucgugaucggcaucggggacaaggcccugaagaucaacugguacaagaagggcuccagcaucgggaagauguucgaggccaccgcccggggcgcccgccggauggcgauccucggcgacaccgccugggacuucggguccgucggcggggugcugaacagccugggcaagauggugcaccagaucuucggguccgccuacaccgcccucuucagcggcgucuccuggaucaugaagaucggcaucggggugcugcugacguggaucggccucaacagcaagaacaccuccaugagcuucuccugcaucgugaucgggaucaucacccuguaccugggcgccgucgugcaggcggacauggggugcgugaucaacuggaagggcaaggagcucaagugcggcagcgggaucuucgucaccaacgaggugcacacguggaccgagcaguacaaguuccaggccgacucccccaagcgccuggccaccgccaucgccggcgcgugggagaacggggugugcggcauccgcagcaccacgcggauggagaaccugcucuggaagcagaucgccaacgagcugaacuacauccugugggagaacaacaucaagcucaccaucgucgugggggacgugaucggcguccuggagcagggcaagcgcacccugacgccccagcccauggagcucaaguacuccuggaagacgugggggaaggccaagaucgugaccgccgagacccagaacagcuccuucaucaucgacggcccgaacacccccgagugccccagcgcgagccgggccuggaacgugugggaggucgaggacuacggguucggcguguucacgaccaacaucuggcugaagcugcgcgagauguacacccagcucugcgaccaccggcugauguccgccgccgugaaggacgagcgcgccguccacgcggacaugggcuacuggaucgagagccagaagaacggguccuggaagcuggagaaggccagccucaucgaggugaagaccugcaccuggcccaagucccacacgcuguggagcaacggcgugcuggaguccgacaugaucauccccaagucccucgccgggcccaucucccagcacaacuaccggcccggcuaccacacccagaccgccgggccguggcaccugggcaagcuggagcucgacuucaacuacugcgagggcaccacggucgugaucaccgagaacugcgggacccgcggccccagccugcggaccacgaccguguccgggaagcugauccacgaguggugcugccgcagcugcacccugccgccccuccgguacaugggcgaggacgggugcugguacggcauggagauccgcccgaucaacgagaaggaggagaacauggucaagucccuggugagcgccggcuccgggaaggcggacaacuucaccaugggcgugcucugccuggccauccuguucgaggaggucaugcgggggaaguucggcaagaagcacaugaucgccggggcccucuucacguucgugcugcugcucagcggccagaucaccuggcgcgacauggcccacacccugaucaugaucggcuccaacgcgagcgaccggauggggaugggcgugaccuaccuggcccucaucgccacguucaagauccagcccuuccuggcccugggguucuuccuccgcaagcugaccagccgggagaaccugcuccugggcgucggccuggcgauggccaccacccuccagcugcccgaggacaucgagcagauggccaacgggaucgcccugggccucauggcccugaagcugaucacgcaguucgagaccuaccagcucuggaccgcgcuggugucccugaugugcagcaacaccaucuucacgcucaccguggccuggcgcaccgccacccugauccuggccgucaucucccuccugcccgugugccagagcuccagcaugcggaagacggacuggcugccgaugaccguggccgcgaugggggugccgccccucccccuguucaucuucucccugaaggacacccucaagcgccgcagcuggccgcugaacgagggcgugauggccgucgggcugguguccauccucgccagcuccuuccugcggaacgacgugcccauggccggcccccuggucgccggcgggcuccugaucgcgugcuacgugaucaccggcacgagcgccgaccugaccguggagaaggccgccgacgucaccugggaggaggaggccgagcagaccggggugucccacaaccucaugaucacgguggacgacgacggcaccaugcgcaucaaggacgacgagaccgagaacauccugaccguccugcucaagaccgcgcugcugaucgugagcgggaucuuccccuacuccaucccggccacgcuccugguguggcacaccuggcagaagcagacccagcggagcggcguccugugggacgugcccagcccgcccgagacccagaaggccgagcucgaggagggcguguaccgcaucaagcagcaggggaucuucggcaagacgcaggucggggugggcgugcagaaggagggggucuuccacaccauguggcacgugacccggggcgccgugcugacccacaacggcaagcgccuggagccgaacugggcgaacgucaagaaggaccucaucagcuacgggggcggguggaagcuguccgcccaguggcagaagggcgaggagguccaggugaucgccgucgagcccgggaagaaccccaagaacuuccagacgaugcccggcaucuuccagaccaccaccggcgagaucggggccaucgcccuggacuucaagccgggcacgagcgggagccccaucaucaaccgggagggcaagguggugggccuguacgggaacggcgucgugaccaagaacgggggcuacguguccgggaucgcgcagaccaacgccgagcccgacggcccgacccccgagcucgaggaggagauguucaagaagcgcaaccugacgaucauggaccugcaccccggcagcgggaagacccggaaguaccuccccgccaucguccgcgaggccaucaagcggcgccugcggacccugauccucgccccgacccgcgugguggcggccgagauggaggaggcccugaagggccugcccauccgguaccagacgaccgccaccaaguccgagcacaccgggcgcgagaucgucgaccucaugugccacgccacguucaccaugcggcugcugagccccgugcgcgugcccaacuacaaccucaucgucauggacgaggcgcacuucaccgacccggccuccaucgccgcccggggcuacaucagcacccgcguggggaugggcgaggcggccgccaucuucaugacggccacgccgcccggcaccgccgacgcguucccccaguccaacgccccgauccaggacgaggagcgggacauccccgagcgcagcuggaacuccgggaacgaguggaucaccgacuucgccggcaagacggugugguucguccccagcaucaaggccgggaacgacaucgccaacugccugcgcaagaacggcaagaaggugauccagcugucccggaagaccuucgacaccgaguaccagaagaccaagcucaacgacugggacuucguggucacgaccgacaucagcgagaugggggcgaacuucaaggccgaccgcgugaucgacccccggcgcugccugaagccggugauccugaccgacggccccgagcgggucauccucgccggccccaugcccgugaccguggccuccgccgcgcagcgccgggggcgcgucggccggaacccgcagaaggagaacgaccaguacaucuucacggggcagccccugaacaacgacgaggaccacgcccacuggaccgaggccaagaugcugcucgacaacaucaacacccccgagggcaucauccccgcccuguucgagccggagcgcgagaaguccgcggccaucgacggggaguaccggcugaagggcgagagccgcaagaccuucguggagcucaugcggcgcggcgaccugcccguguggcuggcccacaaggucgccagcgaggggaucaaguacaccgaccggaaguggugcuucgacggcgagcgcaacaaccagauccucgaggagaacauggacguggagaucuggacgaaggagggggagaagaagaagcugcggccccgcuggcuggacgcccggaccuacuccgacccccucgcgcugaaggaguucaaggacuucgccgccggccgcaagagcaucgcccuggaccucgucaccgagaucggccgcgugccgucccaccuggcccaccggacccgcaacgcgcuggacaaccucgugaugcugcacacgagcgagcacgggggccgggccuaccgccacgccgucgaggagcugcccgagaccauggagacccuccugcugcucgggcugaugauccugcucaccggcggggccaugcuguuccugaucagcggcaagggcaucgggaagacguccaucggccucaucugcgugguggccagcuccgggaugcuguggauggcggacgucccccugcaguggaucgccagcgccaucgugcucgaguucuucaugauggugcugcugaucccggagcccgagaagcagcggacgccccaggacaaccagcucgccuacgucgugaucggcauccugacccuggccgcgaucguggccgccaacgagauggggcuccuggagaccacgaagcgcgaccugggcauguccaaggagcccggcgucgugagcccgaccuccuaccucgacguggaccugcaccccgccagcgcguggacccuguacgccgucgccaccacggugaucacccccaugcuccggcacaccaucgagaacuccaccgccaacgugagccuggccgcgaucgccaaccaggccgucgugcugauggggcucgacaagggcuggcccaucuccaagauggaccugggggugccgcugcucgcccugggcugcuacagccaggucaacccccugacgcucaccgccgcggugcugcugcucgugacccacuacgccaucaucgggcccggccugcaggccaaggccacccgcgaggcccagaagcggacggcggccggcaucaugaagaaccccaccgucgacgggaucaugaccaucgaccuggacccggugaucuacgacuccaaguucgagaagcagcucggccaggugaugcugcugguccucugcgccgugcagcugcugcucaugcgcaccagcugggccuucugcgaggcgcugacgcuggccaccgggcccaucaccacccucugggagggcucccccggcaaguucuggaacacgaccaucgccgugagcauggccaacaucuuccggggguccuaccuggccggcgcggggcuggccuucagcaucaugaaguccgucggcaccgggaagcgcggcaccggcagccagggggagacgcucggcgagaaguggaagaagaagcugaaccagcugagccggaaggaguucgaccucuacaagaaguccgggaucaccgagguggaccgcaccgaggccaaggagggccugaagcgcggggagaucacccaccacgccgugagccgcggcuccgccaagcugcagugguucgucgagcggaacauggugauccccgagggccgcgugaucgaccucgggugcggccgcgggggcuggagcuacuacugcgcggggcugaagaaggucaccgaggugcgcggcuacacgaagggcgggccgggccacgaggagcccgugcccauguccaccuacggguggaacaucgucaagcugaugagcggcaaggacguguucuaccucccgcccgagaagugcgacacccugcugugcgacaucggggaguccagccccucccccaccguggaggagagccggacgauccgcguccugaagaugguggagcccuggcucaagaacaaccaguucugcaucaaggugcugaaccccuacaugcccaccgucaucgagcaccuggagcgccuccagcggaagcacggcggcaugcuggugcgcaacccccugucccggaacagcacccacgagauguacuggaucuccaacgggaccggcaacaucgugagcuccgucaacauggugagccgccuccugcugaaccgguucacgaugacccaccgccggcccaccaucgagaaggacguggaccucggggccggcacccgccacgucaacgccgagccggagacgcccaacauggacgugaucggcgagcggauccgccggaucaaggaggagcacuccagcaccuggcacuacgacgacgagaaccccuacaagaccugggccuaccacggguccuacgaggucaaggccaccggcagcgcgagcuccaugaucaacgggguggugaagcugcugacgaagccgugggacgucgugcccauggugacccagauggccaugaccgacaccacgcccuucggccagcagcgcgucuucaaggagaagguggacacccggacgccccgcccgaugcccgggacccggaaggugauggagaucaccgccgaguggcucuggcgcacccugggccggaacaagcgcccccggcugugcacccgcgaggaguucaucaagaagguccgcaccaacgccgcgaugggcgccguguucacggaggagaaccagugggacagcgcccgggccgccguggaggacgaggaguucuggaagcucgucgaccgcgagcgggagcugcacaagcuggggaagugcggcuccugcguguacaacaugauggggaagcgcgagaagaagcucggcgaguucgggaaggcgaagggcagccgggccaucugguacauguggcugggcgcccgcuaccuggaguucgaggcccucggguuccugaacgaggaccacugguucucccgggagaacagcuacuccggcguggagggggagggccugcacaagcucggguacauccugcgcgacaucagcaagauccccggcggcgccauguacgcggacgacaccgccgggugggacacccggaucaccgaggacgaccugcacaacgaggagaagaucacgcagcagauggacccggagcaccgccggcucgccaacgccaucuucaagcugaccuaccagaacaaggucgugaaggugcagcgccccacccccaagggcaccgucauggacaucaucucccggaaggaccagcgcgggagcggccaggugggcacguacgggcugaacaccuucaccaacauggaggcccagcucauccggcagauggagggcgagggggugcuguccaaggcggaccuggagaacccccaccuccuggagaagaaggucacccaguggcuggagaccaagggcguggagcgccucaagcggauggccaucagcggggacgacugcguggucaagccgaucgacgaccgcuucgccaacgcccugcuggcccucaacgacaugggcaaggugcggaaggacaucccccaguggcagcccuccaagggcuggcacgacuggcagcagguccccuucugcagccaccacuuccacgagcugaucaugaaggacgggcgcaagcuggucgugccgugccggccccaggacgagcucaucggccgcgcgcgcaucucccagggggccggcuggagccugcgggagacggccugccuggggaaggccuacgcgcagaugugggcccucauguacuuccaccgccgggaccugcgccuggccuccaacgccaucugcagcgccgugcccguccacugggugcccaccucccggaccaccuggagcauccacgcgcaccaccaguggaugacgaccgaggacaugcucaccguguggaaccgcgucuggaucgaggacaacccguggauggaggacaagacccccgugacgaccugggaggacgugcccuaccugggcaagcgggaggaccaguggugcggcagccugaucgggcucaccucccgcgccaccugggcccagaacauccugacggccauccagcagguccggagccugaucggcaacgaggaguuccucgacuacaugcccuccaugaagcgcuuccggaaggaggaggagagcgagggggccaucugguga

SEQ ID NO: 10411 - RNA, 9873 nt, Artificial Sequence
  derived and/or modified CDS sequence (opt1) from DENV-3__AY744682__SS-prME
accagccugugccucaugaugaugcugcccgccacccuggccuuccaccucaccucccgggacggcgagccccggaugaucguggggaagaacgagcgcggcaagagccugcuguucaagaccgccuccgggaucaacaugugcacccucaucgccauggaccugggcgagaugugcgacgacaccgugaccuacaagugcccccugaucaccgagguggagcccgaggacaucgacugcuggugcaaccucaccagcaccugggugaccuacgggaccugcaaccaggccggcgagcaccggcgcgacaagcgguccguggcccuggcgccccacgugggcauggggcuggacacccgcacccagaccuggaugagcgcggagggcgccuggcgccagguggagaaggucgagaccugggccuuccgccaccccggguucaccauccucgcccuguuccuggcgcacuacaucggcaccucccucacgcagaagguggugaucuucauccugcugaugcucgucacccccagcaugaccaugcggugcgugggggugggcaaccgcgacuucgucgagggccuguccggggccaccuggguggacgugguccuggagcacggcgggugcgugacgaccauggccaagaacaagcccacccucgacaucgagcugcagaagaccgaggccacgcagcuggccacccuccggaagcugugcaucgagggcaagaucaccaacgugaccacggacagccgcugccccacccagggcgaggcgauccugcccgaggagcaggaccagaacuacgucugcaagcacaccuacguggaccggggguggggcaacgggugcggccucuucgggaagggcucccuggugaccugcgccaaguuccagugccuggagagcaucgagggcaaggccguccagcacgagaaccucaaguacacggugaccaucaccgugcacaccggggaccagcaccaggucggcaacgagacgcagggggugaccgccgagaucacgccccaggccuccaccgucgaggcgauccugcccgaguacggcacccuggggcucgagugcagcccccgcacgggccuggacuucaacgagaugauccugcucaccaugaagaacaaggccuggauggugcaccggcagugguucuucgaccugccgcugcccuggaccuccggcgccaccacggagacccccaccuggaacaagaaggagcuccuggugaccuucaagaacgcccacgccaagaagcaggaggucguggugcuggggagccaggagggcgcgaugcacacggcccucaccggggccaccgagauccagaccuccggcgggacgagcaucuucgccggccaccugaagugccgccugaagauggacaagcucgagcugaagggcauguccuacgccaugugccugaacgcguucguccucaagaaggaggugagcgagacccagcacgggaccauccugaucaagguggaguacaagggcgaggacgcccccugcaagaucccguucagcaccgaggacgggcagggcaaggcccacaacggccggcugaucacggccaaccccaucgucaccaagaaggaggagcccgugaacaucgaggcggagcccccguucggggaguccaacaucgugaucggcaucggggacaaggcccugaagaucaacugguacaagaagggcagcuccaucgggaagauguucgaggccaccgcccgcggcgcccggcgcauggcgauccucggcgacaccgccugggacuucgggagcgucggcggggugcugaacucccugggcaagauggugcaccagaucuucgggagcgccuacacggcccucuucuccggcgucagcuggaucaugaagaucggcaucggggugcugcugaccuggaucggccucaacuccaagaacaccagcauguccuucagcugcaucgugaucgggaucaucacccuguaccugggcgccgucgugcaggcggacauggggugcgugaucaacuggaagggcaaggagcucaagugcggcuccgggaucuucgucacgaacgaggugcacaccuggaccgagcaguacaaguuccaggccgacagccccaagcggcuggccaccgccaucgccggcgcgugggagaacggggugugcggcauccgcuccacgacccgcauggagaaccugcucuggaagcagaucgccaacgagcugaacuacauccugugggagaacaacaucaagcucaccaucgucgugggggacgugaucggcguccuggagcagggcaagcggacccugacgccccagcccauggagcucaaguacagcuggaagaccugggggaaggccaagaucgugaccgccgagacccagaacuccagcuucaucaucgacggcccgaacacgcccgagugccccuccgcgagccgcgccuggaacgugugggaggucgaggacuacggguucggcguguucaccaccaacaucuggcugaagcugcgggagguguacacccagcucugcgaccaccgccugaugagcgccgccgucaaggacgagcgggccgugcacgcggacaugggcuacuggaucgagucccagaagaacgggagcuggaagcuggagaaggccucccucaucgaggugaagaccugcacguggcccaagagccacacccugugguccaacggcguccuggagagcgacaugaucaucccgaagucccucgccgggcccaucagccagcacaacuaccgccccggcuaccacacccagaccgccgggccguggcaccugggcaagcuggagcucgacuucaacuacugcgagggcacgaccguggugaucaccgagaacugcgggacccggggccccucccugcgcacgaccaccgucagcgggaagcugauccacgaguggugcugccgguccugcacccugccgccccuccgcuacaugggcgaggacgggugcugguacggcauggagauccggccgaucaacgagaaggaggagaacauggucaagagccugguguccgccggcagcgggaaggcggacaacuucacgaugggcguccucugccuggccauccuguucgaggaggugaugcgcgggaaguucggcaagaagcacaugaucuccggggcccucuucaccuucgugcugcugcucagcggccagaucaccuggcgggacauggcccacacccugaucaugaucggcuccaacgccagcgaccgcauggggaugggcgucacguaccuggcgcucaucgccaccuucaagauccagcccuuccuggcccugggguucuuccuccggaagcugaccagccgcgagaaccugcuccugggcgugggccuggccauggcgaccacgcuccagcugcccgaggacaucgagcagauggccaacgggaucgcccugggccucauggcccugaagcugaucacccaguucgagaccuaccagcucuggaccgcccuggugucccugaugugcagcaacacgaucuucacccucaccgucgcguggcggaccgccacgcugauccuggccgugaucucccuccugcccgugugccagagcuccagcaugcgcaagaccgacuggcugccgaugaccgucgccgccaugggggugccgccccucccccuguucaucuucucccugaaggacacccucaagcggcgcagcuggccgcugaacgagggcgucauggcgguggggcugguguccauccucgccagcuccuuccugcgcaacgacguccccauggccggcccccugguggccggcgggcuccugaucgccugcuacgugaucacgggcaccagcgcggaccugaccgucgagaaggccgccgacgugaccugggaggaggaggccgagcagacgggggugucccacaaccucaugaucaccgucgacgacgacggcaccaugcggaucaaggacgacgagaccgagaacauccugaccgugcugcucaagacggcccugcugaucgugagcgggaucuuccccuacuccaucccggcgacccuccuggucuggcacaccuggcagaagcagacccagcgcagcggcgugcugugggacgugcccagcccgcccgagacgcagaaggccgagcucgaggagggcgucuaccggaucaagcagcaggggaucuucggcaagacccaggugggggugggcguccagaaggaggggguguuccacaccauguggcacgugacccgcggcgccguccugacgcacaacggcaagcggcuggagccgaacugggccaacgugaagaaggaccucaucagcuacgggggcggguggaagcuguccgcgcaguggcagaagggcgaggaggugcaggucaucgccguggagcccgggaagaaccccaagaacuuccagaccaugcccggcaucuuccagaccaccacgggcgagaucggggccaucgcccuggacuucaagccgggcaccagcgggagccccaucaucaaccgcgagggcaagguggucggccuguacgggaacggcguggugaccaagaacgggggcuacgucuccgggaucgcccagaccaacgcggagcccgacggcccgacgcccgagcucgaggaggagauguucaagaagcggaaccugaccaucauggaccugcaccccggcagcgggaagacccgcaaguaccuccccgccaucgugcgggaggccaucaagcgccggcugcgcacccugauccucgccccgacgcggguggucgccgcggagauggaggaggcccugaagggccugcccauccgcuaccagaccaccgccaccaaguccgagcacacggggcgggagaucguggaccucaugugccacgccaccuucaccaugcgccugcugagccccgugcggguccccaacuacaaccucaucgugauggacgaggcccacuucaccgacccggcguccaucgccgcccgcggcuacaucagcacgcggguggggaugggcgaggccgcggccaucuucaugaccgccacgccgcccggcaccgccgacgccuucccccaguccaacgcgccgauccaggacgaggagcgcgacauccccgagcggagcuggaacuccgggaacgaguggaucacggacuucgccggcaagaccgucugguucgugcccagcaucaaggccgggaacgacaucgccaacugccugcgcaagaacggcaagaaggugauccagcugucccgcaagaccuucgacaccgaguaccagaagacgaagcucaacgacugggacuucgucgugaccaccgacaucagcgagaugggggccaacuucaaggcggaccgggugaucgacccccgccggugccugaagccggucauccugaccgacggccccgagcgcgugauccucgccggccccaugcccgugacggucgccuccgccgcccagcggcgcgggcgggugggccgcaacccgcagaaggagaacgaccaguacaucuucaccgggcagccccugaacaacgacgaggaccacgcgcacuggaccgaggccaagaugcugcucgacaacaucaacacccccgagggcaucauccccgcccuguucgagccggagcgggagaaguccgccgcgaucgacggggaguaccgccugaagggcgagagccggaagaccuucguggagcucaugcgccggggcgaccugcccgucuggcuggcccacaagguggccagcgaggggaucaaguacacggaccgcaaguggugcuucgacggcgagcggaacaaccagauccucgaggagaacauggacgucgagaucuggaccaaggagggggagaagaagaagcugcgcccccgguggcuggacgcccgcaccuacuccgacccccucgcccugaaggaguucaaggacuucgcggccggccggaaguccaucgcccuggaccucgugaccgagaucggccgcgugccgucccaccuggcccaccgcacgcggaacgcccuggacaaccucgucaugcugcacaccagcgagcacgggggccgcgcguaccggcacgccguggaggagcugcccgagaccauggagacccuccugcugcucgggcugaugauccugcucacgggcggggccaugcuguuccugaucagcggcaagggcaucgggaagaccuccaucggccucaucugcguggucgccagcuccgggaugcuguggauggccgacgugccccugcaguggaucgcgagcgccaucgugcucgaguucuucaugaugguccugcugaucccggagcccgagaagcagcgcacgccccaggacaaccagcucgccuacguggugaucggcauccugacccuggccgccaucgucgcggccaacgagauggggcuccuggagacgaccaagcgggaccugggcauguccaaggagcccggcguggugagcccgaccuccuaccucgacgucgaccugcaccccgccagcgccuggacccuguacgcgguggccacgaccgugaucacccccaugcuccgccacaccaucgagaacuccacggccaacgucagccuggccgccaucgcgaaccaggccguggugcugauggggcucgacaagggcuggcccaucuccaagauggaccugggggucccgcugcucgcccugggcugcuacagccaggugaacccccugacccucaccgccgccgugcugcugcucgucacccacuacgcgaucaucgggcccggccugcaggccaaggccacgcgggaggcccagaagcgcaccgccgcgggcaucaugaagaaccccaccguggacgggaucaugaccaucgaccuggacccggugaucuacgacuccaaguucgagaagcagcucggccaggucaugcugcuggugcucugcgccgugcagcugcugcucaugcggacgagcugggccuucugcgaggcccugacccuggcgaccgggcccaucaccacgcucugggagggcucccccggcaaguucuggaacaccaccaucgccgucagcauggccaacaucuuccgcggguccuaccuggccggcgccgggcuggcguucagcaucaugaaguccgugggcaccgggaagcggggcacgggcagccagggggagacccucggcgagaaguggaagaagaagcugaaccagcugagccgcaaggaguucgaccucuacaagaaguccgggaucaccgagguggaccggaccgaggccaaggagggccugaagcgcggggagaucacccaccacgccgucagccggggcuccgccaagcugcagugguucguggagcgcaacauggugauccccgagggccgggucaucgaccucgggugcggccgcgggggcuggagcuacuacugcgccgggcugaagaaggugacggaggugcggggcuacaccaagggcgggccgggccacgaggagcccguccccauguccaccuacggguggaacaucgugaagcugaugagcggcaaggacguguucuaccucccgcccgagaagugcgacacccugcugugcgacaucggggaguccagccccucccccacggucgaggagagccgcaccauccgggugcugaagaugguggagcccuggcucaagaacaaccaguucugcaucaagguccugaaccccuacaugcccaccgugaucgagcaccuggagcgccuccagcgcaagcacggcggcaugcuggugcggaacccccugucccgcaacagcacccacgagauguacuggaucuccaacgggacgggcaacaucgucagcuccgugaacauggugagccggcuccugcugaaccgcuucaccaugacccaccggcgccccaccaucgagaaggacgucgaccucggggcgggcacgcggcacgugaacgccgagccggagacccccaacauggacgucaucggcgagcgcauccggcgcaucaaggaggagcacuccagcaccuggcacuacgacgacgagaaccccuacaagaccugggccuaccacggguccuacgaggugaaggccacgggcagcgccagcuccaugaucaacgggguggucaagcugcugaccaagccgugggacguggugcccauggucacccagauggcgaugaccgacacgacccccuucggccagcagcggguguucaaggagaagguggacacccgcacgccccggccgaugcccgggacgcgcaaggucauggagaucaccgccgaguggcucuggcggacccugggccgcaacaagcggccccgccugugcacccgggaggaguucaucaagaaggugcgcacgaacgccgccaugggcgcgguguucaccgaggagaaccagugggacagcgcccgcgccgccgucgaggacgaggaguucuggaagcucguggaccgggagcgcgagcugcacaagcuggggaagugcggcuccugcguguacaacaugauggggaagcgggagaagaagcucggcgaguucgggaaggccaagggcagccgcgcgaucugguacauguggcugggcgcccgguaccuggaguucgaggcccucggguuccugaacgaggaccacugguucucccgcgagaacagcuacuccggcgucgagggggagggccugcacaagcucggguacauccugcgggacaucagcaagauccccggcggcgccauguacgccgacgacaccgcggggugggacacccgcaucacggaggacgaccugcacaacgaggagaagaucacccagcagauggacccggagcaccggcagcucgccaacgccaucuucaagcugaccuaccagaacaagguggugaagguccagcgccccacccccaagggcacggugauggacaucaucucccggaaggaccagcgcgggagcggccaggugggcaccuacgggcugaacaccuucaccaacauggaggcccagcucauccggcagauggagggcgaggggguccuguccaaggccgaccuggagaaccccuaccuccuggagaagaaggugacccaguggcuggagacgaagggcguggagcgccucaagcggauggcgaucagcggggacgacugcgucgugaagccgaucgacgaccgcuucgccaacgcccugcuggcccucaacgacaugggcaaggugcggaaggacaucccccaguggcagcccuccaagggcuggcacgacuggcagcagguccccuucugcagccaccacuuccacgagcugaucaugaaggacgggcgcaagcugguggugccgugccggccccaggacgagcucaucggccgcgcccggaucucccagggggcgggcuggagccugcgcgagaccgccugccuggggaaggccuacgcccagaugugggcgcucauguacuuccaccgccgggaccugcgccuggccuccaacgccaucugcagcgccguccccgugcacugggugcccaccucccggaccacguggagcauccacgcccaccaccaguggaugaccaccgaggacaugcucaccgucuggaaccgcguguggaucgaggacaacccguggauggaggacaagacgcccgugaccaccugggaggacguccccuaccugggcaagcgggaggaccaguggugcggcagccugaucgggcucaccucccgcgcgacgugggcccagaacauccugaccgccauccagcagguccggagccugaucggcaacgaggaguuccucgacuacaugcccuccaugaagcgcuuccggaaggaggaggagagcgagggggccaucugguga
